United States Patent 7,745,391 (HUMAN THROMBOSPONDIN POLYPEPTIDE) - sequence listing, part 51

SEQ ID NO: 145021 - DNA, 485 bp, Homo sapiens
tgcagtcagccgagatcccaccactgcactccagccttggtgacagagtaagactccatctcaaaacaaaaaaacaaaaaaacaaacaaacaaaaaaacctgcttgtggctggtgattatggtattgaagagtgcaggactaggttctagaaggtgtcactagttaaagtaagacttgtcttgttacttgaagaaagggaggattcgaaaaacagaataaagaaaagtgtcccagaagaaggcaaagtatgaatgggctgtactcaagtcacactaagggtgggaaagtgcttcatgcctggataggggtttgtgctgtgttgctacacagggcagaccatgtccttgagagaggatctgaagctgtaggtaatgaggagtcattgattatttgtgatcagtggattatcatggctcttaccttgtgccaggcattttgttgagtgccttaaatggaatatttcatactataacaaccctttgaa

SEQ ID NO: 145022 - DNA, 242 bp, Homo sapiens
cgtagctcacttctgtcgctatgaaggctagagcacctgtaacacacggcgagtcttgtgtcttattcccataaccaaaccaagagactgtgtttagcatttcttctgcacacccccacccctacctcgcgccctaaaactagcagcgtcgttaatgaaaagcaagaaactgtgaaggccacgaggggaggcgtggtactgtcgactgcactggccaccacaacacatgggctgaagctcct

SEQ ID NO: 145023 - DNA, 210 bp, Homo sapiens
tacctgggctaagaaccaagggttggaagttgctaaaaataaggatgaagtagatctaaattgtgtttcaatggcagaatctgatccagatcttcactgggcctacgtatcaccctagaagacagatgtacacagaataaagatcaagtgtctaaacagattaaataaagcaattttgctttatatttgcatggagaaaggaggttcctt

SEQ ID NO: 145024 - DNA, 226 bp, Homo sapiens
agtaaccgagcctgagggaaagtgaggtgtgaggcgatggcaaacagctccagcaaatgcacaagtaccaggccctagcactgcagagcacacagggagaggtggactgtggcccttggaagccttggactgagagagaaaattcctagtctcagagcaaatcccaggccaccagccacagctaccagcaagaggcaaaggagctcccacctctgcaggggacaat

SEQ ID NO: 145025 - DNA, 545 bp, Homo sapiens
aagcttctttggcctgggtctcactaaggaagtggaacggcagccaagaattattatgctgaaaatgttgtggtgatagaaaaaagatgattagaagtgaggctaaaattataatttaatatgttaccaagtgtaattagtcacttaacagtataagaaaataccattaataactgatgtggaaccttgtaaaatatttcttggcgaattttaatgtcttttttgtgtacttaggatcagttgagccccgtgggtaacttgggtgccctgtttgtgaccctggcttgctgtgcaggttccccttggacatctgtggagaggaagagtaagaaggagatggctgtgcccagccccggcctctcacacagccttctggattgttttacctctgctccttcactccttaatagctctctgtggttaacctttctgtcctcctcagtcgcactggacgctccttgaggaacgggagctgtgaccagggccagagcccaggaaggtgctgggtacagagcagcagattggtaactgtttatatcacatgc

SEQ ID NO: 145026 - DNA, 176 bp, Homo sapiens
gatttcgagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatg

SEQ ID NO: 145027 - DNA, 443 bp, Homo sapiens
tctgatccttgtgtttttctctccacattctaatgatgagcatttgggttgtttccagtctctagcaactagggcaaggaggggaagatgccagtgggacataccttcccaccagtattccaggttcctgcctggaacttgagttgtatttcccatagaggcagaggccagtgaggctagaagaagttatgttgagggtttggcaccattcgggttgtggtgggcttctgcaagatgatccaagcattgtttacaacttgaaaaatgtctgctaggctgggtgcagtggttcatacctgtaatcccagcactttgggaggccaaggtgggcagatcacctgagatcaggagttcaagaccagcctggccaacatggtgaaaccccatctctattaaaaatacaaaaaaaaaaaaaaaaaattagccaggcatggtggcacgtg

SEQ ID NO: 145028 - DNA, 510 bp, Homo sapiens
tgaaaaatatgaacacttctgtaatcccagcactctgggaggctgaagtgggtggatcccttgaggccaggagtctgagaccagcttgtgcaacatgcagaaaccttttcctaccgaaaaacaaagaaaatacaaaaattattcaggcatggtggtgcatgcttgtggtcctagctattggagaggctgaggtgggaggattgcctgagcccagggaggtcgatgctgcagtaagtaaaccatgattgcgccactgcactgtagccttggagacagagtgagaccttatctcaaaacaaacaaacaaaaaaccaaaaaaccctaatttttaactttattcatttttttttaaactttgccaagtcctgatggaaaaaaatattaccagttttatcttgtgacaagtgttttcattaaggctaatcagttttatagttgaagtatcttatagagataaactgtatgttaatttaaataaaggaaggtcatatttctcagatgtggctagta

SEQ ID NO: 145029 - DNA, 145 bp, Homo sapiens
tccacactcaggcatgatattgcacgtccacaaaacatttctgcgtggcctaaagctgtgcctactgcatccacaatcaatctccaaccttcaggcagttaagaccttcctgcatgctctgggtgtagatgcatgacagctaaca

SEQ ID NO: 145030 - DNA, 373 bp, Homo sapiens
accatcaatttgggaaattataacacctgggaaattatacaggggaaattatatagggcatcacctggcccacacctggcccatacctgtgacagtccacctggggctgaggaggcggtgcatccatggtggctgtgtgagaggtacacacatcctactatctcagcatgcctcccatgtaatggtgtcagagtactgatgggttgaaattcagagtagtttactgtggattactgttcttacctttctcttgtatcctaaagatagggatttaaatacatatatatttttaaaagttatatgtataggtgagttgtattatctttgaattccacttcaagacagtaaatgaggcatgcctaaatgttacaaa

SEQ ID NO: 145031 - DNA, 777 bp, Homo sapiens
ttttaatttatcttctcatgtaaaggtccttggcagtgatacctaatttcctaagatagccttgctttatattgtttgattaagatgtcatgcatatcagagaatctgaaaattcttcccaatgccgtcgacatacgtgattaatcacattaccaaaataacataccaaaacaaacaacagaaaattatttgttacttagttccttcaaatttgtttatctaattggtggttccttcatgcacaaaacgtttcatgtgtgtctggcactcttctggtcacaaatttcatcttaagtaacctaagtattgaaatgcttgtgctctttgattgatttttcctacataaatactttgataaaaagctacattgaggctgggcttagtggctcacacctccaatcccagctctttgggagcctgaggccagtggatcaggagatcaggagatcaaaaccatcctggccaacatggtgaaacctcatctcttcaaaaatacaaagaattagccaggagaggccaggtgctggatcatgcctgtaaccccacactttgggaggctgaggttggcagatcacctaaggtcaggaatttgagaccagtctgcccaacatggcaaaaccctgtttctactaaaaatacaaaaaattagccaggtgtggtggcaggcgcctgtaatcccagctacccaggaagctgaggcaggagaatcgcttgaacccaggatgcagaggttgcagtgagctgagatcatgccactgcactccagcctgggtgaca

SEQ ID NO: 145032 - DNA, 277 bp, Homo sapiens
actgatactaaattgcctgacagatcctagctttgactcgtggataattcaaatacaatttgcagctttcttgctaatgtagcttatgaaccatctcatgtgaagaaaattctggctaagctgggcaaagagttggtaagagtgcctgagaaatttcaaggaactctggagtgagcccaggggcaagacacattcaagagaactgcagtatcagtaagtgccacaccagtactcttgattaccactgctctggaatcacactgtatggtgctagctg

SEQ ID NO: 145033 - DNA, 414 bp, Homo sapiens
tgaggcaggagaatcagttgaacccgggaggcagaggttgcagtgagccgagatcatgccactgcactccagcctgggcgacaaagcaagactccgtccaaaaacaaaacaaaacaaaaccaagcagttatttcactagactcaagacatggctgcctcccctttgggaagtcaaaccccagtctctagcaaaataggatctagcagtaccactgtccaggggtatttctgatacctgctctgttctggtctgtagaacatttggcggggagcgtctatttgaatcctcacaacagacatgctagagagatgtctatcccgttattaacaaggaaaccagaatgtgaagtattcctagagctaaaaagggaaagaattggaacgtaggtcaggctgattctaaaccctgtgatc

SEQ ID NO: 145034 - DNA, 400 bp, Homo sapiens
gggatcccgtgtatacataacttggttccgtttattgtctccctttctcattagacctgagctggggaaacagtgatgctggccactgaggaagcatttaggccagtgctaaaaacaaaaactaaacacactgggggtggaggagggaggacagaggagacctgaaaagagggggagaatctggagcagctgagattgaggttgagcagaggggacgggcttctttgctgtttcagcatatagacccgagcaggtcctgaacctcactttcccctttgagatggggaaggttaaggggagagtagattgactcctagagggcacatggaatgaggagtgaggtggagctaagaggccccaagaggaagggcacccagagaaaggaaccagcactggccga

SEQ ID NO: 145035 - DNA, 309 bp, Homo sapiens
ggtttttaaaaatctttttattgatatctcgttttcttcatgcatcacttctaatattcttttgttgtctatgttctgtttttgttcattaagcacttttttctaattacattttaatgtaattagaatgtccacctttacaatacacaaatacagtaacggtaactcgaactaaaacaaagcatacttctgatagccattatttttctctttgggacaaatttaaagtttttcttttgtcacaaaaacaggaatgtacttatacaaaggctcaaaataggccatctttttaaacaaaaaggcaatgat

SEQ ID NO: 145036 - DNA, 616 bp, Homo sapiens
ccaggactgtttctttcccctgtttatcctgcttggggtttgttgaactttttgtgtctgtaagttaacattttccaccaaattctggaagtttttggccattgtatggacctggccaatgcacgcccttccctctccactcctgtgacggccattgtccacacgcagggtcactggctcttggccctcaggtctctgaggcttggctcatttttcttcaacctctgcattttgctttttttttttttttgagacagggtctcactctgtcacccaggctggagtgcagtgttgtgatcacggctcactgcagcttcgacctctcaggctgaagcaatccttctacctcagcttcccaagtagctggtactacaagtgtgcaccttcacgcccagccatttttttttgtactttttgtagaggtggggtctcactatgttgccctggctggtctccagctcctgggctcaagcgatctgcctgccttggtctcccaaagtgctaggatgacaggcgcgagccactgtgtccagctttctcttcattttgaatccagcaaattctattgctgtgttctcaagtttattttccttggccacctccagtgagtgatgtc

SEQ ID NO: 145037 - DNA, 246 bp, Homo sapiens
aactgttctcatataacacatcctgtaacctttgtcaaacccctgtaaacacttgtataagaattagaggagaaaagccaaaatggtagaattgtgaaaatggttttgagcttgtgcatcctgtaaaagagtctccgggatcccacaggattcaggaccacactttgagaaccactgcaatgagatcttgcctagctttccaagtagcttccaactagcttctcctggtgttcatactcaggacgt

SEQ ID NO: 145038 - DNA, 377 bp, Homo sapiens
cccccacactgccaccagctggctttctaaaataaaagtgctgaccacgtcactcacctcctgaaagatgtctactagatttgcactgcctatgaaataaactccaaagtcttcgcttgcatgcaggcatgcattaactcagtcatttgtccatccacccacctcgtgtttcaggatcgcccactgtgtgccaggctctgttttaggccctagagtgctgaatgcaatagataagaccaggtcccatcttcatggatttatattcttgtggggtaagacaaacactaaataagaagacaaacaaacatatcatataaagtcagagagtgatgagtgctaatgagagaaaccaaagcgaggtaggacagaatggttga

SEQ ID NO: 145039 - DNA, 824 bp, Homo sapiens
accccagtaattcatcagccttaattatatcagttggttcatcacctccagccaacttcttagagccagctttcctggagaaagagaggaggatcccttgatcattgaagcaagttagctgcttatacccagaaatctcagtgtaccacccccaccaaactcttttgccttttccatattccaccaactagccaacaacattagaggtaagaacacctccaggttttctggttaggaaattgggtgggccaggtgcagtgattcatgcctgtaatcccagcactttggggaggctaaggtgagaggattgcttgagcccaggagtgccagaccagcctgggcaacaaaggcagattgtgtctctgtttaaaaaaaaaaaaaaaaggaaattgggtattgggtgctgtcctgctcaatcacctgatgtgatgactcccaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtaagaaggattaatctgaaaatgtttctcatgggtcagctgttagttagtatacagttctgtagcagcccctttaagggaattgttcctttactttctgttctttctttagggcatacactctcactcttctgttactcagcaaatgtttgc

SEQ ID NO: 145040 - DNA, 5252 bp, Homo sapiens
aatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145041 - DNA, 4968 bp, Homo sapiens
tggggacctgtctgtacgacagccgctgtcgcggccagggagtgcaacctgggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145042 - DNA, 4873 bp, Homo sapiens
gcatatcttattactgggaatgctctcgtttgaaagtatcttgacaggattttttccctttctgtctcctatctctggaactagatcccatatgtacgttgatatggatcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145043 - DNA, 4320 bp, Homo sapiens
tcgagcgtcggtaccccgtataccaccctataccaccctataccactaggctataccaccaacagaataaactcctggaaaagatctatttgattaagagaaacagaggagataggaaatgtaaagccactgactatttttgttggtatctaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145044 - DNA, 4053 bp, Homo sapiens
taatctgtaccatgcggtagtggcacgcgcctataattccagctactctggaggctgaggcaggagaattgcttgagtctgggaggcagaggtgagcggagatcacaccactgcactccagcctgggtgacagaatgagactgcatctcaaaaaaagaaaaagaaagttgctgttgaaataaagctaaccaagtgtgaccagatactggtaaattctgcttcctttccatctccaactctgcagcccgagggtagagtggaagggaatgttatttcctcttttaatacctgccctccacttttgtctcctgggtccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145045 - DNA, 4406 bp, Homo sapiens
accccagtaattcatcagccttaattatatcagttggttcatcacctccagccaacttcttagagccagctttcctggagaaagagaggaggatcccttgatcattgaagcaagttagctgcttatacccagaaatctcagtgtaccacccccaccaaactcttttgccttttccatattccaccaactagccaacaacattagaggtaagaacacctccaggttttctggttaggaaattgggtgggccaggtgcagtgattcatgcctgtaatcccagcactttggggaggctaaggtgagaggattgcttgagcccaggagtgccagaccagcctgggcaacaaaggcagattgtgtctctgtttaaaaaaaaaaaaaaaaggaaattgggtattgggtgctgtcctgctcaatcacctgatgtgatgactcccaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145046 - DNA, 3714 bp, Homo sapiens
tcaggctgcatgtcgtgtggacaggatgtcatgcgagtctggcccgccgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145047 - DNA, 1246 bp, Homo sapiens
tgagatggcttttttctgagcaaacaaccatagcccctcccctcaactccaaactcatcggaaacatgattttctgcctttttatgcagcaacaaaaagacatggggttcagagacagcacccttgattgtctattcccttctctctccactcccgggagtggagagagaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145048 - DNA, 2475 bp, Homo sapiens
aatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145049 - DNA, 1922 bp, Homo sapiens
aatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggtaagaattctgactgctcactggccacctgtcccagtttgttttttccaaagggtcgcgccttctagtttgcaggagtggttcatgtgatccctacaggtccacaggttccctttttgtctccttatcattgtgtcctatttccatttgagcgagtattctgattaagaacatggtaaaatataatggctgaggttaacagaaagggacagaaagcttggggactcttggcttttccatagcactctattctcatcttcattttttcctaaaacaaataatagattttggtgggaggaatttatatttgtgctataaatctctttgaaacagttatttgcagtgcgtgtttgataagaaatgacgaaagaaagagtgaattatgaagtagcccagtgaagagtagtggttctagagtatgtgaacatctcatgtagcagttataggatgagaatatcttagagaaggaaaaatgtgttgggaaactcagatccttttcttcctatttcccactccacccatcagagtcccttgtttgagtagcatcatggactttttggaagatcgggtaggcaggagtcaaaaataaaaccccatttatgctctaggactggtggtaaaaaataaataaata

SEQ ID NO: 145050 - DNA, 1790 bp, Homo sapiens
aatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggtaagaattctgactgctcactggccacctgtcccagtttgttttttccaaagggtcgcgccttctagtttgcaggagtggttcatgtgatccctacaggtccacaggttccctttttgtctccttatcattgtgtcctatttccatttgagcgagtattctgattaagaacatggtaaaatataatggctgaggttaacagaaagggacagaaagcttggggactcttggcttttccatagcactctattctcatcttcattttttcctaaaacaaataatagattttggtgggaggaatttatatttgtgctataaatctctttgaaacagttatttgcagtgcgtgtttgataagaaatgacgaaagaaagagtgaattatgaagtagcccagtgaagagtagtggttctagagtatgtgaacatctcatgtagcagttataggatgagaatatcttagagaaggatctgagtttcccaacacatttttccgtcgacgc

SEQ ID NO: 145051 - DNA, 1141 bp, Homo sapiens
tcagaggattcgtgatgttatcccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacattttgtctcctttcctcagatttcatctgaaccccgctaaaggcagctgtttcacagtctgtctccttcaggggcccaatttccccacagcctgggctgagtactcctactctcttctttaggttctgggctgataaagcctggagagggtacagggtgatgggtgaagccctggtgaaggtgaaaggatagattggggttggggggtggggagcagggaggtgggatggggaatggccttccctgaatagggtgggtgggaggggaacaagacccttttgcacaactctctttaagtttcctttatttcttttttaactcattctgattttctgcattgtgtttgggaaataaaatgaaaaaactaagaccaatagaaactggttttcaaaaaggcaaatacactcccatctgtttcagatgctgctgagcatttcagcagtgacagattcaaataataagctaatttttggagaaaggattaaaagaaaaaaaaactttgtaatatttatcacttgcaagctatgtttaataaagaaaggaatggtttctaaaaaa

SEQ ID NO: 145052 - DNA, 1302 bp, Homo sapiens
gcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacattttgtctcctttcctcagatttcatctgaaccccgctaaaggcagctgtttcacagtctgtctccttcaggggcccaatttccccacagcctgggctgagtactcctactctcttctttaggttctgggctgataaagcctggagagggtacagggtgatgggtgaagccctggtgaaggtgaaaggatagattggggttggggggtggggagcagggaggtgggatggggaatggccttccctgaatagggtgggtgggaggggaacaagacccttttgcacaactctctttaagtttcctttatttcttttttaactcattctgattttctgcattgtgtttgggaaataaaatgaaaaaactaagaccaatagaaactggttttcaaaaaggcaaatacactcccatctgtttcagatgctgctgagcatttcagcagtgacagattcaaataataagctaatttttggagaaaggattaaaagaaaaaaaaactttgtaatatttatcacttgcaagctatgtttaataaagaaaggaatggtttctaaaaaa

SEQ ID NO: 145053 - DNA, 775 bp, Homo sapiens
tcagaggattcgtgatgttatcccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145054 - DNA, 644 bp, Homo sapiens
aatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacaggccatcaatacgggtacgagctcgaatcgtcacatggcaaactgtc

SEQ ID NO: 145055 - DNA, 542 bp, Homo sapiens
gcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145056 - DNA, 362 bp, Homo sapiens
tgctgggactgtaggggtgagccaccgcacccagccagaagctacatttcttcgacttctgtcctcatttgtaaatgaggatggtactgtctgaattccctaaagtgatactgttataatcagatgaaataaaagtattttgtaaattatagaatatcctttttgtaaagtctctttctttaattcaacagaataaactcctggaaaagatctatttgattaagagaaacagaggagataggaaatgtaaagccactgactatttttgttggtatctaggcaaaagctgtgcctcacttctgcgggttgaaccctttgtatgtgcccagtgccgcacagatttcacccctcactggaagcaa

SEQ ID NO: 145057 - DNA, 5240 bp, Homo sapiens
gaatcgtgctggtgctcagggaagtttgctggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145058 - DNA, 4945 bp, Homo sapiens
ggagcccaaataaaaaattttaagggggtaaggtttttaagaaccggcaacagcttttcaagcctttttaggaataagtacttatggaaaaagcccgattggtcctgttaaaggagttgaaacaaagtcagctacagaaaaaaaaatgtggtcaataaaactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaacctgaaaaagagaaaaaaaagccctagccatggatattg

SEQ ID NO: 145059 - DNA, 4469 bp, Homo sapiens
aatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccaggctttctgtcatcatctccacagggcacccatc

SEQ ID NO: 145060 - DNA, 1860 bp, Homo sapiens
aatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgcctaccaaactggggccttagtgtcctccggccta

SEQ ID NO: 145061 - DNA, 824 bp, Homo sapiens
  misc_feature (822)..(822): n is a, c, g, or t
aatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttacatggtcagcggtacaacagtccgaagcaggtgnac

SEQ ID NO: 145062 - DNA, 643 bp, Homo sapiens
gaatttttaatatacttgatattaaccatcctttgaaaactattaaccatcctttgaaaacaaatatcttggccaggtgcagtggctcacgcctgtaatcctaacactttggtagtccaaagcaagaggatcgcttgagctcaggagttcagaaccagcctaggcaacatagtgagaccttgtctctaccaaaaatacaaaaattagctgggcatggtgatgtgtgcctgtagtccagctactctggtgtctgaggtgggaggatcacttgagcctaggaggttgatgctgcggtgagctaagattgcatcactgctctctagcctgggcggcaagcaagaccttgtcttaaaacaaaaaaccaaaaatcttgccatatggaaagcatctgatttgcaaaatcagtgcctgcatttcagtttggggcctgtgagtaaaatagttgcttctgctgggcgtggtggctcatgcctgtaatcccagcacttttcggggctgaggcaggtggatcacttcaggtcaggagttcgagaccagcctggctaacatggtaaaaccccatctcccaggttcaatcaattttcctgcctcagcctcctgagtagttgggattacagatgcccgccaccacgcccaactaatt

SEQ ID NO: 145063 - DNA, 411 bp, Homo sapiens
tagatattccaacattgcaggagagttatttcaacttcttttttttgtctcatctaaaaagtgtggatttaatatagcaaagttgcttctagaatggaatcttttagagtgtatatgcgcttttgaaaaaaatggtttatgattttgttatgtaatactgttatataagttattttagaaattgcatgatttattataatatcagcagtgaatttaaacattacacaaatgcctgaatataaagaaataggatcacctgtgtccaagttaattgccttcttttgctgtattcattagccatcaatacctacataatctaaggccaagatacatatggagcaatctatggacaggcaatagcatcccatgggagctttggaattcaggagctcgagcctcaccccagatgta

SEQ ID NO: 145064 - DNA, 200 bp, Homo sapiens
agggtcctggcgacaaggcctctaaaaggggaagcaagaccagcacataagccagcacagagaattgctaagacatgaagcagtccgctgggaacagtggcataagcgaagcatttggcaacgcacgctcgaaccgcagccatccaacactcgggccagtacctgggagtttaggttatagtcctgcaccagctttctac

SEQ ID NO: 145065 - DNA, 561 bp, Homo sapiens
agcctaagcaacatagggaaacccctgtgatatagtttggatctgtgtccccacccaaatctcatgttgaactgtaatccccagtgtggtaggtggggtctggagggaggtgactggattaggagggtggatttctcatgaatggtttagtactatctccttggtactcctcatgatagcaggtgagctctcgcaagatctggttgtttaaaagtgtgtggtatctcccccctcactctcttgttcctgctttcactatgtgacatgcctgctcccccttcacaatctgccaataaattgtggcaggttatgagtgtgtgtaatttatgagtgctgataggatgaaagatagaaaatgattttagatagaaagaaaataattctggaagctttgagtcttcctcttgtaatctatgttggttcttttttaatataccctgtttcagcacttactgacttggagtctctctcacaatgactaaatgtaatatgagattctaggatgtatactagaacagaaaatggaaactaaataaaaactgaggaattctgaaaaagtat

SEQ ID NO: 145066 - DNA, 580 bp, Homo sapiens
ggctatagtagcgggcatggtggctcaagcctgtaatcccagcactttgggaggccgagacgggcagatcacgaggtcaggagatcgagaccatcctggctaacatggttaaaccccgtctctactaaaaatacaaaaaattagccgggcgtggtggcgggcacctgtagtcttagctacttgttgactcctggctttccacctgctaaccacatccctgccatcagggcaggctgatgtttcctggtcagtacaacagggctgcagaaatctattttgcagagttgccgggaggatcaaatgaagttatgtgtgtgaaagcatcttgtaaactgtaaacactagacatggtatacattagtttttggtgttacccagtaggtcatttctctctctcaaacatttattctctatcatgtgtccgggtgtttatccaaaagtaaacactgatcatggcatcatgattttgttttgttttattttgagacggagtctcgctctgttgcccaggttggagtgcagtggcgcaatctctgctcactgcaacctccgcctcccgggttcaagcaattctcctgcc

SEQ ID NO: 145067 - DNA, 356 bp, Homo sapiens
tgaccacctgggcacatgtcatcagttcctcctgaggctgtgtcacgagtgcgtgtccccaacttggcaaaatcaactttctaatttaactgagacctgcctcaaattttcagggttcacagtgggaatgtaaatgagtacaaccactatggagaacagtttggaggttcctcaaaaaactaatagagctaccatacaatccagcaatcccactgctgggtatatacccaaataaaggaaatcagcccatcgcagcgatatctgcactcccgtgtttgttgcggctctgttcacaacaaccaagatttggaagcaacctaagtgtccataacagacgaatggataaagaaaatgcg

SEQ ID NO: 145068 - DNA, 691 bp, Homo sapiens
ctctttagaaaactgaggctcagaggattaagtgacttggccaattacatgtctaataaatagcagaatactgcccaaggtaatttatagattcagtgccatccctgtcaagctaccaatgactttcttcacagaattggaaaaaactactttaaagttcatatggaaccaaaaaagagtgcacattgccaagtcaatcctaagccaaaagaacaaagctggaggcatcacactacctgacttcaaactatactacaaggctacagtcaccaaaacagcatggtactgataccaaaacagagatatagaccaatggaacagaacagagccctcagaaataatgccgcatatctacaaccatctgatctttgacaaacctgacaaaaacaagaaatggggaaaggattccctatttaataaatggtgctgggaaaactggctagccatatgcagaaagctgaaactggatcccttccttacaccttatacaaaaattaattcaagatggattaaagacttaaatgttagacctaaaaccataaaaaccctagaagaaaacctaggcaacaccattcaggacataggcatgggcaaggacttcatgtctaaaacaccaaaagcaatggcaacaaaagccaaaattgataaatgggatctaatgaaactaaagagcttctgcacagcaaaagaa

SEQ ID NO: 145069 - DNA, 752 bp, Homo sapiens
tttatggaggagtgatcttttaaaagattcccacagacaagtgtcctcctagttctgtaagattgttcagttagaaatgattccctttccagggagtatttagcctgctgcaaaagaatagcaagctactaggtgtaaaacaaatcacacagaagcattttcttttttcatcttacaggtttatttagacgagtaagatcttgttatattttaaatggcacttaaccacctatcactctccagtgctttctctcatgcttagaataaaatccagacttttaccatgacctgtggcccacatctggctctgcctgctttctgattccctcatgagactctgttctctcataaattgtggttccacttggcttctttctattcttatacatcaagatccctcctacctcctttgtgcttattgatcctaaagctcttgcctcagatcttcagcacttggctcaaatatatcctctagtaagggtcctttccttaccaagcaacctagagtagtcaccctgacatagttttttgtgttttgtgatcaagggctagaaaaagacaaatagccggtattcctgccacacacatgtagattgtttttaaactccaaaagtaaaaagcacatactttttgtgtttttttggacctaacagttctattttgttgtccttttgtataaatgttgttacattaattagcagaaattgtcttgctttgtcattgttggtttgctccctggaccatagactctg

SEQ ID NO: 145070 - DNA, 301 bp, Homo sapiens
tcacagactttactgtgaagagcccttggcttcaacgccagatgctgaactagcaggggtgtactggtgtatgtggcgtgtgtgtatgagtgtgtgtgtgtatgtgtattagtgtatgtgtgtggtgtgtatacatgtgtctgatgtacatatgcatatgtgtgagtgtgtttgtgtttttgtccgtacgcatgtgtgtgatgtgtctatgtgtgtatgcacatgtgtatgttgtgtgtgtgcatgttgggagcaggggctgcaggagcctgcttttcatagctgccccaggtgatgtacc

SEQ ID NO: 145071 - DNA, 393 bp, Homo sapiens
tctctgtgcttaccagtccaagcagaactcagcagaatctacttgagagaaagctcgcaggagactagaaagtcattttaatgatgccagctaaacttctctttcctctcctccatctgctgttttccccaggtggagaagtaaaagactgtaaggtagggagggggcatacagacttttccagtctctgatccggcactgaaactcagggcacacgctctcctctgtgggcatggatgattacgtcctctgtctgagaaaggagacacgcactgtgctttgatggataggccgtaagtggcttccctgggtactttccagggcgactaggcaggggactctagaaaatgttcaggatggaagcatctgaacaagtaaggcaatcagaaggga

SEQ ID NO: 145072 - DNA, 319 bp, Homo sapiens
ttttcagaaacctgcattagatttgcttgtttgaacaacctcaaacccaaactcttcacggtggcattcaaagacctccattatgttgtctcaacttattttccaatcttattttctattgccctataatatgagtgcattaatttttgctaagctggtctaatgattcaaaaacaaaaaaaaagtgcttctcacttgcaaaacaagcactcaatgcctctgtataatatttgacctatctcttaagggtctgctcaagtcccacctcttacactgaagattttctagtcaactccatctttcagggagctcatctacc

SEQ ID NO: 145073 - DNA, 950 bp, Homo sapiens
gagaccccatctctgcaccaccaacaaaaaattagccaggcatggtggctcacgcctatggtcccagcactttgggaagctgaggtgtgaggattgcttgaggccaggagctcaacaccagcctgggcaacatagcaagatcctgtccctacaaaaaaaagtttttaattagctgggtgtgatggcacacacctgtagccccacctacttgggaggctgaggcaggaggatcacctaagtccaggagtttgaggctgcagggagccgtgattgtgccactgcactccagcctgggcaacagagtgagaccctgtctctaagaagacatttcttctggtgctttggtgatgcttctgctcagcctttctgtctgtagtctcagtccgatagtccagtctgctttgagggcccaccaggacctggaggaggggccagtttcagtcaagggtctgcagttgaccttgagaacttagcacattcattatctttttgtgggcacttccacctcccattagaaagaaaaagatgggcccagtgcggtggtggcttatgcctgtaatcccagcacattgggtatccacggtgggtggatcacttgagctcaggagttcgagaccaatctgggcaacatggcaaaaccccatctctacaaaatccaaaaaaatgagctgggtgtggtgtcacatacctgtagtcttagccacttagggggccgaggcaggaagattacttgaacctgggaggttgaggaggctgcagtgagctgagatcacaccactgcattccagcctgggtgacaacgtgagaccctgtctcaaaaaaaaaaaaaaagaaaaactcgagggggggcccggtcccccctttggccctattagggagtcggtttacaatcacttgggcgcggtttacaacgcctggactgggaaaaccctggggtaacccaaattaat

SEQ ID NO: 145074 - DNA, 346 bp, Homo sapiens
aaacccccacgcacagtcctacacgtaaggacacgagtcacacaaagcaagacaagtgtattcataaacatcacacacatttaggtaggcacacttaggcactcacagacactggtagtcaccaccatttagtcacagtaaaaagatacaaatatatccacaatcataggcagaggctaagttccagccagacaactgtcagtgcgcacactcttgcctggacacactgcttctagcaggtgctacccttgctcccaaggctgctctcctcacaggccttgaggcagagagagagcctaatccagccaaactggcaaaatctttcttctctatctcctcctgtagg

SEQ ID NO: 145075 - DNA, 407 bp, Homo sapiens
ggccaagtggggcaacaggaggcccgcagaagtgaactgtttccaaggctccaaatctagcaggtgatgggcagagccaacttgcaacacctaaagtccctctgcaccacgccagggccttgggaagctgtgaaagtttactaacatgcagttctgtcctaaagatgccaggattctaattctttccccagatcgcatagtcctaagctcccccttgccaattagagagggaggggaccctgcccaactgacaaagtttgagggaggaggtactcagcaggctcaaggccattacaaacagcacgcaggaagatgttgatatttccatttcatgctgggtgagggggaagaaaggacgctcaatttcagagcctgatgagaagccagaagctaggatgtcagttatg

SEQ ID NO: 145076 - DNA, 449 bp, Homo sapiens
tgtcccattttccaccaaactggcacattttaaacatgagtagttaacgtttgctgaatttatactataaacgaggcagtgtggcaagtgatttatctgttttatttaatcctcacaataacttaagtaagtactattgtcccattttatagatgagaaaattaacgaatagaaagttaaaaaacttggccaagttcattctgctagtaagatccagagactggcacttattaaaaaattgtaataataggccgggcgcagtgactcacgcctgtattcccagccgaggcaggcagatcacgacgtcagatctaaaccatcctggctaacgtggtgaaaccccgtctctactaaaaatacaaaaacaaaattagccgggcatggtgacggtcgcctgtagtcccagctactctggaggctgaggcgggagaatggcgtgaacctgggag

SEQ ID NO: 145077 - DNA, 288 bp, Homo sapiens
ctttgatcattgggagtacagagcaaaaaacaagagcagaggttggtttgcttgttattaagaaagtgtcatgtttacaggagcaaatgtaaaaatctgttagattggagaagaggaacttccttaaatgagggagaagtagattacaagtcactcaagtaaccgtgaaaatataaagatgggattgggtttgcaatagtgtgtgacagaggtggtaatcatggccgtgcttcccttttacctgcattgaagtagtctgctacaattcagaattactgttgtgttaaa

SEQ ID NO: 145078 - DNA, 350 bp, Homo sapiens
cacacaacagttggcaagctctgccctataggtaatcactttttcctcagttcttttagctgcttcttcaatttacctgtctattctaaacaatgtgcttgttttatcaggatgcttttggatgcagctattgaacctgacccatactggcttaaaataagaggacttaactcacaattggaattccagggacaggctcaggggctaattgatttggtagcacagtgatgtcttcagggccccaggttttctcatttccccctttagtcactggcaggctctatcctcagattaatcagatggttgcggcagtgtcaggagttggattcagatgcaacagtgcccatggg

SEQ ID NO: 145079 - DNA, 743 bp, Homo sapiens
aggtaggcactgaaataaatatttggtatatgaaaaagggtgtattgctaaactacaaattgtatttaccttaacttcttaaattctaggatccaatgtcaaattccacagagtctaacattataggttatattccatttttaaaaatcaacttttattctactcaaaattttttttttttggagacagagtcttgctggagtgcaatggtgcgatctcggctcactgcaacctccgcctcccaggttcaagcacttctcctgcctcagcttcctgaggagctaggattacaggcctgcacaccacacccagctgatttttgcatttttagtagagacggggtcttaccatgttggccaggctggtctcgaactcctggcatcaagtgatccacctgcctcaccttcccgaagtgctgagattacaggcgtgagccacagcactgagatatattattttccattgtgaaaaattgaaagtgacctaaatttccattaacagacaatccatctagattatgtgtcctggagctggggcagtggggaaaacagcatcctctatttgaaattactcaggtaaaataactccattcctttgagaccttaaataaaaatatccaaagtccaatttctttaaaaaatgaaattttggctgggcatgtggctcacacctgtaaccccaacactttgatggaggtgggcggatcacttgaggtcaggagtttgagaccagcctgaccaaca

SEQ ID NO: 145080 - DNA, 371 bp, Homo sapiens
atgggtgatctagaggatcccagcggcgccttttttcaagtttatgcatgaacctgacctcagacatcggccatttagtttctgttagcttctaactgagcacatttatttagtgcctgggctgtgtcaggcactttgcatgaattattagtgtgtttggtcctcaaggcaaccttgaggcttggagaggtcaccagccagtcacagtggggctggagttgggatttggaccaggccagatgaggggctgccctcaaaactgccagagttagagggatcctgggggtaaaagggacccaaagatactatctttgctgattcaaaattttaaagcagtgcataggccggcgcattagcaaaagaatattttt

SEQ ID NO: 145081 - DNA, 271 bp, Homo sapiens
ctgccctagtagagaagtgcaacacgtcataagtggtcaaaacatttttattggaagtaatgcatctgtgtgattttctgtttagtccctatttcagagctctttgttttttcttaaaatgtaaaatactctcaactttagcttgagaatacctgaagtgtttagttggacatttattatgagccagtaacatatttgcacaggagctctggaggagagcagtatcacttgtggaactctgagcgagttgtatagccacccacccatgcca

SEQ ID NO: 145082 - DNA, 545 bp, Homo sapiens
tttttttttttttttggtacagttgggagccgggagtctctctgttgtccaggctggtctggaactcctggcctcaagcgatcctcttatctcagcctcccaaagttctgggattacataggtgaaacaccgcgcccggcccagaacatttaaaagtgaaagtttttacataattatcatgtctgtaagaagtgttaaaatcttcagataaagtcataattttaaatcagttgggggatagcagtaacaactgtgtttatgtagctctttcaaagcttcaaagaatttataaataacacaaaatactttcaaagcacattattctctgtaattcctgaaactctgtgatgtattggaactaatattaccacccttttacaaaggaaaataagatacaaagtttgagtacgagtaacatttctggtcataaatctagtcagtgacactgataggactagaactcaagtctccagaaataataacccagagctgtttttactacaacattcacagttttggaatgtagtccatagttatttatagca

SEQ ID NO: 145083 - DNA, 253 bp, Homo sapiens
ctcttatatctttcctctaacccctccccagtaactataattgatgttttattaagcattttaaaataatattccatagatatagcatataaatattttatgatttaatttttttggctttgactttataaaaataaaatataaattgattcagtcatttataaattttctgtgactagctgttttttaacatgatgtttattaatatcgttatatgtaattgtagtttgttcattttcactaccatatagta

SEQ ID NO: 145084 - DNA, 474 bp, Homo sapiens
ttcagccttactcttgctgccagctggggaatggggaatggctataggaagggctggagacagcatggcgttgtcattggttgcatcaggtggttggaaatgcagggattttcctctctagcccaccccacccctttatgcaaatgaaatggtaccacaggctgatgcaagcctggccactgctaagtaattctgcatgacaattcgctcttgcttgccatggccagcttcctccaaaccaagttttaaggggtccaatccccaaagctagaggtgtctcctgatgttccccttctttcttatgtaggggggaggcggccctgccttttgtctgggtgtgtcttggtccagatcctaatcctttgcacccttatggtgatagtcacactaatggttttgctagtggctctttttttttgtgggaaggggatagtgtctggaagtagatgaatgaacacttgctggtgcagggac

SEQ ID NO: 145085 - DNA, 240 bp, Homo sapiens
tgggcaacaaaagccaaatcccgttaaaacaaaacaaaacaaaaaaaaactccccgcaggaagcctgcttgggtgacgccctggacccttctaaaggcttggcccacagttcccctgcacactcttgcttgctccccgcccgctgcctaagcgtgcatgtcccagatggctccccgcttctcgctggccctgcaagacgtgctgtcctcttctctctgggatctgtcagtgacacactgc

SEQ ID NO: 145086 - DNA, 208 bp, Homo sapiens
acacaaagccacagactctggcaaattatccaggggcaccaaggctccaaatggcacattgctgaccagtgtaaacatttatcttttaagctatcgattctaccccaagcctggaagtctgactgccaagaacagtatggccaaaaacactaggtgaaaaagaaaacagaatccatttttgtttcatgttgagaatgtgctgttttgc

SEQ ID NO: 145087 - DNA, 193 bp, Homo sapiens
ttagatctggcagttagtactggtagcttccaatttctcctgaggacggtctagtcgttttctttttttaattctcaaagccagggcaaagtctgaaataaattctagccgcattttccccctgcaaattggtattaccagtcttcagcaagaaaatgagaggatataaggtacacactaagctaggaaaatg

SEQ ID NO: 145088 - DNA, 257 bp, Homo sapiens
ggttcctgagattgtgacatcctgagatcctcagtatctgtctccttagaaccccagtctctgttaccctgactccctttgattctaataatatcaggatacagggaaccccagtttctccagcccagctcagcttcctcataacgctacacatctggcttaagagcttgtactttcttgcccctaggataccaggctctgtgccctgattccctgacacccccatatttgtaccactgggcattgtccctggcccc

SEQ ID NO: 145089 - DNA, 334 bp, Homo sapiens
ttcctcttcatcctctggggcagatttaatttgggggcaagtgccaggaatcacttcagagttgagtaagccaactggggtgtcttatttggggtccaaatgaagtgcgaccctaaggcagaagagtgccttgtgtggtagaaaacccagtggagcccttggggacaggttaagagattagcccaggagccctggagcgaaagaatggcctgcacccttgcagggggtgcaggggaggccttgagcgagatctgagggctcttcatagagagagacacaatcaaccctaatcagggcataagtgaaaacacacggtcccataaagtgtcctggg

SEQ ID NO: 145090 - DNA, 421 bp, Homo sapiens
aggtcttactcagggttaatatctgggggctgaatcctgtctggatggttccccatcaggatggggggcaaaacaactgacacacatcctcgcaggcccgtatccttacccatgtgagtagggaggtgttgccagtctactgaatacccaacaggagaacagactcaagcagctaaatggaccaattagtgaccacccaggagcaaagacatctgccaccgacctgcatagccccctgccccactgctttgctcagcactaggaggggagagggggcactcctcttatgggatctggcttctgggaagaggagaaacatgcctcacacagtacaggaaggagaggtctttcggaagtgtttttttttgtttgtttgtttgtttggggatggcaattcatcttcatctttcaccaggcaaag

SEQ ID NO: 145091 - DNA, 425 bp, Homo sapiens
agaggatccccaattagctggggcacaggcattttataacgaccacagcacctacacaattctcatgcagagaaacaccattttacagaaaataacttcccagtgttgtcaagatttgacctgagctttccaatgaacagctcaaggcagactgcacaattaaaaagagatcatcaagtactatagttaccagtaaggccaagaatagaacacaggtctgctgacccttgcaccaatgcccaatcaggcatgttcttttggatgctgacacccttctcaagttccaagtcacttgcgaataacaaagaaatgagttaataattctggtagacagaagaaaatgtaagccaggcatggtagcgtgcacctgtaatcccagctattcaggggaggatcacttgagcccaggagtttgagaccagcag

SEQ ID NO: 145092 - DNA, 524 bp, Homo sapiens
tgcctatccccctaccccacgttcttacacactccacaggatgtcttgaagcttccacactgctgcaagcctagcaggtcaaaatgcactgactttatctctctcatttccaaagtaatacttgttcatggttttaagaaagaaaatacagatgaaaaagtggaaaaggaaaaattcactctgatttgatcacccaagacaagtactaccaacattctgaaacatattcttaaagtcttttctctttgtactaaagtaaaaacactttaaaaaatctataggctcataaaaagcagatcacaaagcttccaaaatatacatttggccccacagtggaaccaatttaaatctgttttaaaataagtgtgtagaagctgttaaagcttttctgctctagtcatggcagaactccttccacattctctgcacagagctctgagttttcagtgcagaaggaacataatggtacttgtatgtgcacctgtgtgtatttaggggtggggttaggtctgtgatgtgcctcc

SEQ ID NO: 145093 - DNA, 368 bp, Homo sapiens
atgtgcatgtcctttatgacagttggagaaaaatccccaaggtcccatagcagtccctctcagccaccatgagatcatccctcacaagctgttcttggggtcagattggcactccagatatgagggccctagggagagcttcctaagggaagctgggagcaaggtggaaccccaggagagcgtggatgggcttccactgcggggagtgtcccgccggtccgttacaggctttccccaggcgccagcctgcgctgtgcaggagacaaaagaaaatcgaggccctgactgagcagatggtgcggaggaagccgggcgggctgcggtgggcctctgaggacacgaggagggcagggggcatggagacagcg

SEQ ID NO: 145094 - DNA, 276 bp, Homo sapiens
ttcatgtcgagacctttcatgccgccccatcaaaatctaatatggggagggagttggagaggatggatgggattggtagatgcaaactattgagtaatgaggtcctactgtacagacagggatctatatgtgctcttgggttacaacatgatggaagacagtataaaaaaagaatcataatatgtttgaagtacaagagaggttagagaatttatcttcctacaacctcattttattgataaggtaactcagggcatgcaggtacaacaatgtgac

SEQ ID NO: 145095 - DNA, 722 bp, Homo sapiens
ggggggtgagggttggggagtgaaaaataagattctcttaaaactctttgaaatacaacacatataagcaaaatatgtaaatgtgtataatgattataaaatgtgatgtaagcaatataaaggaacataaaggagatgactaaagatggcctgctctataagcaagccattggaatggtgcaaaagtattaaattaagagagcaaacagaaatctaactgtggttctgtcattaattagctatctgaactggaacaagtcactggaacttcctggttctcagattttttcagttctaaagacataaggtagactagtagaaatgtaacatcatttccaggtctgaaattctaagtttacagctcatttaaagtgtcagaaaaggaaaacatctaccttgcaccttagaacaaagtaaactccagatggattaaagatgtaagtatgaaaaattaaaccctaaaaatactagaagaaaacgggggaatattttcataacatggaataaaaaagcttctttgaacagtacatcaaaagcagcatcaaaaaaagaaaattggcatttggaaaaatatgtcaggtaataacagcattaaacaagaacaaaatgggaaaaaaccaaactgtaacatgcatcttttaagagaatatatttgaggctacagtgagccaagataacgccattgtaccctagcctgggcaacaagagtgaaacttcgtctc

SEQ ID NO: 145096 - DNA, 478 bp, Homo sapiens
aagacagacactagggaaaagtacatacaacatacttaaagagacaaatgtattacctggaataacttgaggaaaacgcaatactacatttctattgtgcaaacagtttcaattcatcaagaaggaatctcaggcatgagaacagataagagccagatagataatgcagcccttctcctccatcccacaattctctcctcttcatgtttgatatggtcccaacatgaccttcagatgtgggttcagatgccagaccctggcagttttaaaacagacaaatgtcactcttgtacaaagagtagaagtgacaccatcttcacagagaaatcttttccaattaccagcagacaggccgactcccagctggtgaaagcgcgggccaggggtaggccaggaaaccctccacaccctgccaggtgcccacacaatggctcggcccaggctcctggaaagagtttatttgccattacttcttgat

SEQ ID NO: 145097 - DNA, 339 bp, Homo sapiens
tcatggggaggagggtgttccaggacaagagagctggagggcagctggctcctgcccgggagggcagccgggcccagtgacagccccaggccactgggagctgggccagagggagggagctagcggagccaaacttaacagagcagcatgacccaccattctgggaagtgctgcctggcaggctgtttcactgaggttggcactctgcagagggcaccacagggcagctgtgtctgggtggaggaagtaggcagggtggacaggtggcagtgcccaccttgcagggacctcccccctccagctgccccctacttcctcttctccatcttctctaagaag

SEQ ID NO: 145098 - DNA, 455 bp, Homo sapiens
aaccttcccctctgcccttagagtaaacccagacactctgcaaggccctgcgtagactggccccccagctgccttcccttctgggcaccatggtgctggctttcccttgcccagtgcaccagcctctcccatctggagagcttttgtgctagctcctcccctctctgtgatgttcctttcagcccctcacaagagtgactccttcctggccttcaggtttcagctcacagaacacttggtcatagcagcttttagtgaccgtggtagctccaggtgccctgctctgcgtcctccgtctgttcatttccttcacatcccacagcacaatccatgatatggcctcgttgatctactgcctgctgtgttactgcctgccttccccactctccaaggcccagctccatcctggtcaacattctaccctcagaatctatcaaaggtctttcagtaagggt

SEQ ID NO: 145099 - DNA, 358 bp, Homo sapiens
acacactaacacctaaaattgacaacagctgaattctcattggaactggctgtgctttagtgaaggggagtggaagaggcaaaaggaaagtaattccttaattatttcatatgtcggtgtctacttttaaaagataagaccagccccctcttcccagagatttggttatatttacacaaccaaattgaaagatgcttttaagtgatgctgtaggttaacaaaaatgtaatacatttttgttgtacttctccttttagatccttttgagttctatgtggagtttatttgttggttggctatagcccatgttgctccgtgaactgggcaatgaaaagtgaagagttctgggagaatgtga

SEQ ID NO: 145100 - DNA, 244 bp, Homo sapiens
agagtatagtcaaactgtggaggaaacttcattgttaaaaaataaacattgtgcatatcaaacattgaagagtgtaaagtgttgtcgatggtaatgtgaacttattctaagttgccgaaaatgtttcgtgctcaatgcattttagaaacaacatttccatcagagtgaaaagaaagcaaagggagccttcttaaactatactggctacaataaccctgccaagcaatattttctgggaagcctt

SEQ ID NO: 145101 - DNA, 395 bp, Homo sapiens
aagcactgaacctcctggccaggaagaggcatgagaactgagtgaataactaagtcaccctttccctctgacacgtgaataacccagggggctaacataacactgtgctccgtaatccttagatctctacgggacgacttctgaattctagctattacaaattcagcaactgaccaatcaaaaaggcagaattcggccaggcacagtggctcactcctgtaatcccagcactttttggggctgaggtgggtggatcatttgagatcaggagttcgagaccagcctggccaacatggtgaaaccccgtctctactaaaaatacaaaaaatagctgggtgtggtggcaggtgcctgtagtcccagctactcgggaggctgaagcaggagaatcgctt

SEQ ID NO: 145102 - DNA, 394 bp, Homo sapiens
attttcccgcctcagcctccagagtagctgggattacaggcatgcgccaccacgcccagctaattttgtatttttagtagagagggtgtttctccatgttggtcaagctggtcttgaactccagaccttagatgatccgcccacctcggcctcccaaggtgctgggattacaggcgtgagccactgtgcctggccagaaccgaactattctttaacccagctataagaatattttacagctcttgtgcactttatccgccatgtacaaatacagctgtgagacattttatatttcacaaatatagccataattcttaagaaaatgtctctataaaaccttatccatattttgtaactctgctttgagaacctaaatatgaaattactatgttta

SEQ ID NO: 145103 - DNA, 536 bp, Homo sapiens
agatatgaaggtggatcaggcaattaattcacattttcccagaccatgaagtttgtgatcgttgtcaactttaagaaaattagtaagtagtgactccaggcccctcaaatcctagcgagggtcattcctggtgggaatactgccaagtgaggggtgaccaaaacgctgcatggcttgtcccctggtccaacctggaggtgggcacatggaccccaactcaaccaattagctactctgcctatgcacacacactcactttcacacatactttgaatcttgaactaccaacactagaacagaaatgtgtcttaagtatcttctgcggctgtgatggtgtccaggccaccagtggcagtcgttcctgacacagcaaatgttgctgtgttccctgttttttgtttctcatctctgcaaagcttccttggttcctgctgctcctgcacgacaagcctccttgccctccatcagttcccatgggctccaacaactctaataaaccctgtgagcttcagttagccagaaccgatttttgcagt

SEQ ID NO: 145104 - DNA, 313 bp, Homo sapiens
gtacggcaaccacttccagtctcttcagagtgcctcttctggacattacctacattactaggtaatcagattgttttcagtttttgtcatcatccatagtgttaggataaatgttgtttttgttaaatatttgtgtgtatcttgcattgttttcttgggataaagttctagaagtggaatgccagcataaacttggaattttgatatcagtattaaaaacacattctacatattctacaggatctttattttgaatcatataataaaaacataatcaaactatccagagacacctgagtttgaatccctcctc

SEQ ID NO: 145105 - DNA, 823 bp, Homo sapiens
cttattttgtttttccatctgtgtgctcccaactccggattgcttcccccggtgtgtgttttctgaagctctgtaccgctttgcggctctgccagtggttcttttctagttttgaataacacgtttaaggccgtgattgaatagcggttagtattctgcgttgtgaagaacacgtttaaacacgccgtttctcgcgctctcaacgtccgaagtgaaatcgcatctgcccccttctgtgagaaggtgaaaattgagcctgtatatttctcttccctgctggtatttgctaccaataaattgctacttttaaaaaacattgtccgaggccagcggatcatgaggtcaggagatcgagaccatcctggctaacacggtgaaatgccgtatctgttaaaaatacaaaaaaattagccgggcgcggtggtgggcgcctgtagtccagcctgggcgacagagccagactcagtctcaaacaaacaaacaaaaaaaacaaaaaaacattgtatctgttcataattgtgtatttgcatcttactaggaaacatttgtatcattaaatagtgactttgctacttactgtgagggcttgagcaaatggcatctatcttttgcgtcagtttccttatctgtagggtaggggtaatgtagccactgcaaggattcagtgaaatgagagagaactcacaaagtgcccccagagggctttccttgtgtgcctgtcttgttacggcttctaggaatctcttgattcgtaattaaatgtgctcactgtctactgcactccagcctgggcaacaagaccctgtctcaaagcaaaagaaaa

SEQ ID NO: 145106 - DNA, 371 bp, Homo sapiens
gactcagtctcaaacaaacaaacaaaaaaaacaaaaaaacattgtatctgttcataattgtgtatttgcatcttactaggaaacatttgtatcattaaatagtgactttgctacttactgtgagggcttgagcaaatggcatctatcttttgcgtcagtttccttatctgtagggtaggggtaatgtagccactgcaaggattcagtgaaatgagagagaactcacaaagtgcccccagagggctttccttgtgtgcctgtcttgttacggcttctaggaatctcttgattcgtaattaaatgtgctcactgtctacttcattccatagaacccccaggctctgccatttctttgaggatccatggggctt

SEQ ID NO: 145107 - DNA, 265 bp, Homo sapiens
tgagttgacagtgtaatgcagtggaaaggcataggttcaggagttacacagatctagctttgaattctggtgctgccatttactaactatgctcttgaaaaagttaattaacttctccaagcctcagtttacttgttccctaaaatggggatgagatagtaatattgatctaagtaaggcttattttgagaatttgagctaatatataaagttaataaagtcctgcacataatatgtgattaactaatagaacatgacaaaatgt

SEQ ID NO: 145108 - DNA, 449 bp, Homo sapiens
attgtattaggcatatttgggaaaagcaaatagacgtatgtgagtggggcagaaagttcaaatgggaaagtgagagaaaacctggaagataggttaatgaaacccatgtcatagaagactttgtaaacctctatgctagtatttccgagttttctatttagactcacgacatcagaattagactcctgggccacgcttctgatcagaatcatagggcagtaccctgaatctgcattttaaccatcttcctaggagattccaatgcacactaaaatttgagaacgtttcccattcaaataaccatcagggcagtgtggcctagaggtatgaggaagaaaggattcgtccttttggacgtccctctgccagggaagtctcaaagcagcattctttagctctgtgcattcattatacatttaggtaaaatgactgtttttatcttccaggct

SEQ ID NO: 145109 - DNA, 239 bp, Homo sapiens
tccgggccacttgagggataaaatataccttaggtgattaactgttgtattttaatgtgaatatttccaccaacattaaacagtaactccatgagttttctcatacctgttacactctggagttgcaacaagctgacatgaagcaagttgcaaacataattatcgtatttggctcctattcacagcaagggttcttcaagctgtacgtggggcagtcttccctcacatgaggtttatag

SEQ ID NO: 145110 - DNA, 518 bp, Homo sapiens
aaatcagcgttaccggactgagatgtctgagcggggatgtaatctgctctcttgagagttggtaatcattggtttgaaatgtgatgaaaccactcaagccaatgaaggctgggtgggtggggagggcaggggctggatccaggacttaacaggccaccaggtggctgggcgcagtggctcgagcctgtaatcccagcactttgggaggccgaggcaggcagatcacttgaggccaggagtttgagaccagcctggccaacatagcaaaaccgtctctaccaaaaatacaaaaattagccaggcatggttgtgcacatctgtaatcccagctactcgggaggctgaggcaggaaaatcgtttgtacccaggaggcagaggttgcagtgagccaagatcgtgccactgcactgcaaactgggtcacagagtgagaccctgtctccaaaaaaaaaaatttgggcacgtacagggggctccagagcttcccagggttcttgagcacacggtcaggggcgacc

SEQ ID NO: 145111 - DNA, 151 bp, Homo sapiens
ctgtccccgctcctcaccccgctgtttctgcttttctggttccgccctcgtgccctggagattatcgacttttttcatcacttcactgtggatgtggctggggttggggacatctgttcctttgcccttatggatgtgaagcgccacggac

SEQ ID NO: 145112 - DNA, 313 bp, Homo sapiens
tgacaaactctaggctagaaccaggtctgatttaaggctcaaggctgttctactatatggaattctccctcctctgagattccttggtggaagaaaatattctcctgaggacccatgtgtaaagcaggtacactggctctactctctagttgaaggtggctggggactccaaccttgtgtctgcttagcgggacacatagggtagccccattggaacctattggaagggtggcccacctcctcccgcagccactcggtcccagtgagcgacctgctcaccaaggaggctccttggagcacagtctgaagatca

SEQ ID NO: 145113 - DNA, 384 bp, Homo sapiens
taaaaattcttcgttcaagtgttcaatttccttaaaattttaagcgttattcctaacagtttgcactcctatgagaatctaatgccgctgctgatcttacaggaggctccagtgatggggagcggctgtaaatacagatgaagctttgctgcctgcctgctcactgcctgcctgctcacctcctgctctgcggcccagttcctaacaggccacagacaggtaccagtctatggcccagatgatgcagacccctgtcttaaacaaaaacaaaaaaccaaagcacacttaatgtgagatctactctcttagcaaaatttttgtttttgttgtcgttgacacggagcctcattctgttgcccaggctggagtgcagtggcgcgatct

SEQ ID NO: 145114 - DNA, 131 bp, Homo sapiens
tacagttttagaaaaggatcttagaccgaatgtacatgaatcaagtttgaagttgcattagaaacagtctttttttttgagatggagtctcgcactgttgcccaggctggagtgcaatggcccgatctctg

SEQ ID NO: 145115 - DNA, 534 bp, Homo sapiens
aatggcagtcttatatttaactaaaacgtatgtagtgtacttactactctactagaaatctgaactccttttaatctgaaatttctcacctctctcttttctctctcactttaattctagaaaactatcccttttatccctttaagtatttattctccacttaaaaaaaattatctcccttcttagattcctatcttctggatgtcaatacctttatttctgtatttgatagctgtcaatttttcttttatatttgctatttccttgtccttttatccccgtgaaatattctctttaatcttccaattaacaattttgttcttcaaatagatcaattctgttattcatctttttgttgtttgcagattgggcttagtttctattgtggtttcaactttagcagttgtctgcatccttcctaataccctgtttatcaaaatagagccctcttgccattgctgacaagcattgctggaaaggctttaattggcacactggggttatttactttgcctacatcttccatcctctttt

SEQ ID NO: 145116 - DNA, 334 bp, Homo sapiens
cacaatgacccaacctcactcaccacagaccagctattatttctggggaaccagcattttctataagagcaataaagtcagataatgctaggacaaaattcctgagacaactgccacattcagatggagagctactgaaaggccaaagtgaagtccactagaagaacagacatctggaggatggggcatgccccatgctcctctccttcttccacctgactgaccccaaagcctccgctcctgcagtgccaggtctcagctccattaggcctgttatggattaggacacagatcagccccgtccccactccaaaagtgggaacagccccactag

SEQ ID NO: 145117 - DNA, 514 bp, Homo sapiens
gacttgctccatgcagggttgccacaaacctccagtctataaaagacacagtgtctgcaaagcactgtaacatgaggttcaccttatacctagtactgtgtctgagtccctgacggtactagacgtccactgatgttacgtagattgagactgttgtgcaaccatcaccatcatccattttcagacctcttcatcttgaaaactctgtatctatttaaccccatttcccctcaccccaatccctggcagccaccgttgtactttctgattttatgaatttgacttactctacatacctcatataaatggaatcatacagtatttgtcctttttgtgactggcttatttgcttagcgtggtatcttcagggttcttctatgttgtagtttgtgtgagactttgcttcctctttaaggctgaataatattccacggcacgtatttcccatatgttgttttctgtattcatctaatgggcgtttgggttgcttctaccttttgggccactgtgaata

SEQ ID NO: 145118 - DNA, 399 bp, Homo sapiens
accagcgagaagattgttaaaataattgcccttgagagacaaagaagtctatcttctggaggagaaagctctctccacagagtcaaatgtctccactgagacacttccctggtatgacttcagttacctggaggtgctgcctgtggatgctctaatcttggggtggctctttccaaactcctgcctgtgcactcatgcattcttgcagaaacccacagtggcagggattcctgtcctgtgccgcacgtgcctgtggaattcttgtctctgggattgtcaggctgtcacatttgataaatcctagatttgaaaaggaaaaaaagaaacaaaacatttacatcaaaccaatatgcaacggccagagctgagaagaaaaatggtccaccccactggccttct

SEQ ID NO: 145119 - DNA, 187 bp, Homo sapiens
cagcagggtaatgacatgagacaggccaggcactaatctggatgaaggacctatttacacatgtaaagatccctatttaacttagctggaagagcattaccatgagatgctgcagtaaaacaagttacccatgaccattctcattaaaacatatctggtatccatttctaaattagattagttattc

SEQ ID NO: 145120 - DNA, 231 bp, Homo sapiens
taatgatactatgcctacctcatcatcatgctgtgaagattaaatgagttatgccatggaagtgctgtacattacccattgataatgtctcagtggcctctcaatgaaatggagtgtgacagagtgccacactctgaaacggctcatccccggtgatggtgctgggactagaacccgggcaacctcgcagtgccatgccctactgcatcactacgtccacctcgagggccc

SEQ ID NO: 145121 - DNA, 317 bp, Homo sapiens
gggtcttgctatgtcaatcaggttgcagtgcagtgtggagatcacagctcactacagcctcaacctcctgggaccatgtgatcctcccatcctagcctccagagtagctgggactacaggcatgtggcaactcatttggctaattttttgtattttgtgtaacgccgggttttcccatgttgcccaggatgatctcaattcctgacctcaagcaattcatctccttctgcctcccaaagtgttgggattacaggcgtgagccaccgtgccttgcttgcctgtgtcttttatggaagcccaactaatgtaaagaaagg

SEQ ID NO: 145122 - DNA, 324 bp, Homo sapiens
tggatgcatggatccggtctgaggaaacagagaagacatcaacgttatgcagtgaacaccaaagaagctctgaggtctaaggagtcccgggtcttctgggcagcacacagggtcactgtgatctctcaaatgagacctacggatccagcgcacacccagaggcacagacgcagaatcacgctgcccaacaaaggcagctcgcccctgagttaactcagggcgagctgcaccattttttcatgaccttgtaatatactggtctctgtgctatagtggaatctttggttttgcatcatagtattgtggtgtgttgaattcaatacg

SEQ ID NO: 145123 - DNA, 361 bp, Homo sapiens
acatgctgtaagggcacagccccccttggggaaagcccagttcagcaatgggagaagggctgccacggagggcctgcggggacatggaggtgacatcggaattgcttctccacacgttatttgctgcgtgaccttaggccagaaactgaacctctctgagctctgttcctcatctataacatgacaggtcctccctcccacggctgttcctagggtcacgtgggatcctgtgggtggaccacacccctggagctcagcacaggaagctgctattagaaactgcagaggtgagagggcagtggttgggaaatcctcccagagcgggaccttgcagaatgcataggagctcggcagctaggaa

SEQ ID NO: 145124 - DNA, 409 bp, Homo sapiens
actctgacaggcgagactaggatacatgagtggaggtgggagttttctggggacaaagaagtagatggacatctcaccctgtccccatgaccgcacgtggcacctgcaacaatctcctgtcacctctgcgctggtggcatccagattagctgctgctttcaccagccacacctcccaggcatcattcatgtcaacatttattgagtgcctgttgtttacctggtgctgttagtgctgtgaacacagagctgcataaaaccttgcccctcagcataactcctggggaacacacaggctgttgcttgaaaagccaatttatgcccagaactgttgcatgggccgtcaagggaagagtgatggtttagatccagtctcgttcttacgatgtgcgtatgcgagaccctgcctg

SEQ ID NO: 145125 - DNA, 446 bp, Homo sapiens
tcgagccggtaccgcacgagttcggagtttgagaccagtctggccaacgtgtaaaatgctgtctctactaaaaatacaaaaattaggccgagcacagtggctcatgcttgtaatcccagcactttgggaggcctaggcaggaggatcacttgagcccaggagttcaagaccagcttgggcaatatggtgaaaccttgtctctacaaaaaatacaaaaattagccaggctgctgaggcacacctatagtcccagcacctcaggaggctgaggcaggaggattgcttgagcccaggaggttgaggctgcagtgagctgagactgtaccactgcactccagcttgggtgacagagcaagaccctatctcaaaaataaatagagtaaaataaaataaaataaagagaaactcctctcgacaattccccagcctcccaacttgattcgtgg

SEQ ID NO: 145126 - DNA, 940 bp, Homo sapiens
tctttttgagagtctagctctgtcgccaggctggagtacagtggcgagatctcggctcactgcaacgtccgtctcccgggttcaagtgattctcctgcctcaggctcctgagtagctggggttacaggcacatgctgccacacccagctaatttttgtatttttagtagagacggggtttcaccatgttggccaggctggtcttgaactcctgacctcgtgatctacccaccttgtcctcccaaagtgctggaattacaggcgtgagccactgcaaccggcctgaagttcaatatttgcatacttttgtctttggcttgagagtttgaggatttatggtcaaaatactaccgtggtgaaaaaatacttgggttgtgttgttcatttgaaatacagttagtctgtttgttcctatcctattccattttaggtttttcctatctttatttaaattttatttatttgtttattttcagcatatgaaacactaacatggctccacgagtcagaactatatgagaagatatgttcagaaaagtgcccctctcctcccctgttccctcttacgcagttcccacccatcccagaggttaacaggcaatttagtttttgtttattcttctcatgtttctttttgcataaatgagcaaatacacattttttatttccttttttacacaaaaggtggcaaaatatattcttttgcactctgttaatcttttcacttaatgtactctagaaatctctctccataccaattggtagcagtctttcttattttttgttgctgtttaatacctcattgtattcactaaagtgtacttcatatgctttcctgtgtatatataggcatttaaggcgtaccagtattttgcaataaaaaacaatgctgcagtgaataattagccatgtgcatatgtatttttgtattattggaggtg

SEQ ID NO: 145127 - DNA, 296 bp, Homo sapiens
ccccccaccaaatgcagtgcatcctacaaagcttttgtgagcatcccacgtttgagagccttcctaggtgctgcgacaaacaaggatgcagtccttgccctcaagggggttacactctgctggggacacaaaatcaacccaagagaaagcagcggttcagagcctactggaatgaagtcaggtggtatcaactgtgtgttggtaattcagtcaagagcccccagggaggattaaaataacttgtagaggagattggcacttgagcagggctcagaaggtcacaggggaagattctt

SEQ ID NO: 145128 - DNA, 538 bp, Homo sapiens
attctagcccaagtgacagagtgagactctctcttaaaaaaaataataataaaaatagtacattgtaagttcctagaggaactaacaagggttcaagcaaaaatatatgtggcaaaaaatcatcaaagaaatgtaaatgctatattagaaaatatttactaagtccaagagaaagcaataatagagggccaaaaaagataagagacacactaaaaatgataaagttggcactcctgaatccagctatatcaataataataataaaataaaagatggtcaaaatatttggacagtttcaccaaagaatacatattaatagcaaattggttcatttaaaaaaaactactaataggaatttagcatggtcgaaagctgctctcagtacagctccaagaacctattttatttccagggaatatgccctagacacagccctacaatcgaccctgtacttctctagttccttttctgaagacagcagagggtaaatagggagcaatagaaagtcatcagagacaatagcccgaacaaaagtgga

SEQ ID NO: 145129 - DNA, 767 bp, Homo sapiens
aacgcagctgccagagcctcctcccccaggagcttgctacaagtgccagaaatctggccactgggccaaggaatgcccacagcccgggattcctcctaagccatgtcccatctgtgtgggaccccactgaaaatcggactgttcaactcacccggcagccacttccagagcccctggaactctggcccaaggctctctgactgactccttcccagatcttctcggcttagcagctgaagactgacactgcccgattgcctcagaagcctacaggaccatcacagatgctctagataactctcacagtggagggaagaacactgtgagcttctctgaactaccaaagtgaagaaactgcctagagcacccacctattttgctctcgaggagaagactcaagttattccaacattattttttgaactaactgttaaacatagtgtataaaggaatgacttcaagttttaaattaatttttggataaaacacaacgtttcagaggaattctgcacttgtaatgagacttagtagataaagaagagaaacagatggtcaaaataaccacaagctgaatgagtggtctgtgcacctgaacccctggcatattgcgttttcttaactgttatgtgttgagtggatagatgatccaagacagggtctggccttcacagtttaggtcactatttttatttctctcattctggtctaaagcaggcatatttggctacaaacaactgctgagatgaagaagagaagcctggagcaaa

SEQ ID NO: 145130 - DNA, 363 bp, Homo sapiens
tgcagtggtgtgatcacggctcactgcaatctctacctcttgggctgaagtgattctctcacctcagcttcccgagtggctgggactacagcgaaatgccagcacaccccactaattttaaattttttttgtagagaggaggtctcactatgttgcccagactggtcttgaactcctggcctcaagcaatcctcccaccttggcttcccaaagtgctgggattatagtggggagccactgtgcttggcctagattttttaatgttaggtcatcacatatttctgccattcattttcaaaggttaaaaacaaaacaaaaacaaatcaagagcttctctgcttcccagctatggcactgaaaact

SEQ ID NO: 145131 - DNA, 732 bp, Homo sapiens
ttcctcctccataaaagttggtgtattcacgtgtcctgggtggtgctgtttaccaagactggtctccctcagttttaatcaccatcctaacactcattgtatggagtagctgggttagaggagaatgcctagggttcagatggtctttctgcatttgtcactatttcctcattttccaagctaggttgagtcatattctgcctggccgactccaaaatggctttaaaggagttagcagtggtctcttttcaactctagttttgctagaatgggagctccatttggtcaaagttttgtctttctggctctgtagtgtattctcagtatttagaagagtgccttgcacactgtgggtactctaactattgaaagagcagaaaaaaatacaggaatgcaatgaaaaggaatgatgaccactaaaaacttccgccccagcatattctggtttccttacatctcagttttctgctctttgctgtcatttttttctctactcgcagactttactgtagtttgtaactgcaaaggtttctcacatcttttagtattagatgctgatttctgtgtcatttccagggttgtggtcacagaaagaagcccacatcatgttagttctccatcttaccagataaagcttagcttaatgtacttctatgccaatttctttgaataactaaactttcaataatttaatcaatcactgattaatccaagatttgtctcagatggggc

SEQ ID NO: 145132 - DNA, 433 bp, Homo sapiens
cgatctagaggatccatctcaggcaggacgacacagggagtgtccgcagaacgggcgcaccgagaacgggaactgctcttcgagtcctacttcctcttcttccttcttggctgctcctcctcctctgctccgtctcgtcctctcctctttcttctcttttctgtgtccttcctccttccttctccaacagcaaggatccgaggggaaggagtccatcactggcctagacaccataccctgaaccgccccccgtggtctcccgctgctttctgccactgcccaagggctggacagcaccacccctcctaattcctaggaattaggcccttcttggctctgtgccctgagccatgttctcctcttggccttgggctctgatcagatgctcagttgtctcccttctctgcttccctcacttgccagggtcaccttg

SEQ ID NO: 145133 - DNA, 349 bp, Homo sapiens
atcactggaagtcctcccaggagggaagagaaagagacctatgacatcaaccttgagctttccttctttgttccttttatggccttcctcactttatgtgagttctgggatatgaaagtgctcaggggtagggaaagctgtaaatccccagggccttgcactataaacttcatttcctccctttattgcagttaactgcccatgaactctattaatattttgcaaattgagatccctaaaacacatgttactgttaattttaacctcatgctaactaggatgtggtcaaattttcacaacaaattccaaggatattttgatatgccttggaaaaatgcatttaaaggtg

SEQ ID NO: 145134 - DNA, 126 bp, Homo sapiens
catggatttgctggtgcagtacaactaggcttaatagggcatgccacactgcacctggtcaagctagtgattaataataataatataagtgaacgtaataaattcccatattccccaaaacaatga

SEQ ID NO: 145135 - DNA, 225 bp, Homo sapiens
cacagctccactgccataggccaggccacaacttggagtgggcctgggagctcagaagtttcggaggacagagaactaggagccaggagcctccaagagccacagcgcccacctcacggagggctggggcagacagctggccccacctgggcaccatgccatacagagacccacgagtgccagagcagccacaggactggggttttgggaacagcagtagaggct

SEQ ID NO: 145136 - DNA, 792 bp, Homo sapiens
gcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtctcgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagagccagttctcttcggctcctggggacgcgcagttttgcccgcgggtgaaccatgcgcatcatcaccaccacccgccgcagcaccaccaccaccatcatcagccccagcagcctggatcggccgcggcggcggcagcagcagcagcggcggcgacggccg

SEQ ID NO: 145137 - DNA, 184 bp, Homo sapiens
ctctaaccctattaaaacctaggcagatctgactctgcatgtttcctgggcctgctggctttaccagatctaataaagaaagtggttttatctttgctcttactaacactgtcactctctgtactaagggtggtaataagggtgagaagagagtgggatctggaaagctgagcaccagctgttc

SEQ ID NO: 145138 - DNA, 345 bp, Homo sapiens
caaccagaatggcagacagggccttgccggccagcataaggatcttaggccaggagttctccctcctacctgcaccttagaaccatacggggagtttcaagaaaaactgcgtatcaaggctccccgggggactgtgatatgcagccctcgtggagaagcgctagggcagactgcagagttggggcactgcagagttctaaggaaaccatgaagggatcagatgtgggcttcggagacatctgcaggtgctgtaacagagcagcgaggagccagccagagcccagaggtgcctcagcagacagaggtgggggacaagaagctggaggaagacactcatccacacgg

SEQ ID NO: 145139 - DNA, 315 bp, Homo sapiens
caggctgcttcgtccatgcagccttccggattacgccggatgaaccttggtacttcctgccagtaccacttcactcctctatcctcccatctaacgcttaataaaagcctgccggctgggcacagtggctcacgcctgcgatctcatctaattctatttggagcaccactcgcatacctctagcgatggggaactcagcacccctgcagacattacacttttgggtagtttgatgcctagagtgtccctcctttttgcttctactgagccaagatctgtaacgctaaccctaacccctacccctatccaacctcc

SEQ ID NO: 145140 - DNA, 719 bp, Homo sapiens
gggggtttttctcacaccgattatcagttcttcaactctggtgccaactgggtgtcctacagttcaactccattctgacattactcagacttaacacagatcccaaaggcccagggctaggtcccgcaagacggcccccacttcagacaccaggcgtaagctccgggttgcccccgttcttctgactatctgtagatggcagacttccccaacccaccccactgaggttcacatattttactagagcggctcatagcacagaactcaggaaaacagtttactaactattactagtttattgtgaaggatatgactcaggatcggccacatcgaagggatgcttaggcgggcggagggggagggcagggactccagcagcttcatgccctgcctggacgagccacccgcccggcaccttgatgtattcaccaccttggaagctccccaaacccatcctttcagggtttttatggaggattcattcgctaggcatgatggattacatcattggccataggtgattgaatgcgacctctagcccctctgccctccctggaggtggagtggtgggatgctggaggtggggtggtgggatgcttgaggtggggtggtgggatgctggaggtggggaggtgggatgctggaggtggggaggtgggatgctggaggtggggtggtgggatgctggaggtggggtggtgggatgctggaggtggggt

SEQ ID NO: 145141 - DNA, 250 bp, Homo sapiens
taaagtattccagaccggttaactattgtgtcgcgttttctgctgcagtacctgactccagtctcctgaaacagaactcctcccatctattttctctgggtgtcatttactcatcaccctgacttcgtattttcagtaacttttggcagtatttggagggcccattatgtctctgacaacacctgtggtcagaataaaatcctgcttttcatcattttgtacgtgcctattaactcagttatcggtaggg

SEQ ID NO: 145142 - DNA, 210 bp, Homo sapiens
tggagcctgatgggaaaaatcacaaggccagggctcactaccttggccagcagggaaaacagactggaggagtcaagccaaatgtggacacatctgggcaggagacctctctgctgaaacacacatttctgttttattctatctattcagaccccatcttcaactggctctgaaaaagagacctcaccagtgtggtctgatcagtgtgtt

SEQ ID NO: 145143 - DNA, 343 bp, Homo sapiens
gaatattctgttagtctgtggctaatataattttaataaagttaatttaaatctgatagaaaaatgaaattttaaacgataattttagagaatgatattatatccagtcttcttttttcttttaataaatgagggaactattgggggaaaggaataaatacattttctttcattttattaagacaaatttagtaagcagaagaaatttgcatgtttagttataagggtttcttttttccttacaagttggaaaaaataattctaatttaagggtaactctttgacaatgaacactgtgagcagcatctggtactcgttgctttgtttgaaaacgtgagttgag

SEQ ID NO: 145144 - DNA, 396 bp, Homo sapiens
cacagatttttctgccaaaaaatctgaattggatcaagactctaaatctaatacaaatttaaaggaaaagaagttgccagtggaatataataaacaacacaataaggatataagtcagcaaaatccacaaagcaaactccatagggcaaaatatcttaagcaaataaattggaatgtgtgatggttaattttatgtgtcaacttgactgagcaacaaaggtcccagatatttggtcagacattattctgggctggacatggtggctcatgcctgtaatcccagcactttgaaaggccgaggtaggcaggtcacttgaggccaggagttcaagaccagccgggccaacagccaaaccctgtctctactaaaaatacaaaaattatccaggtgtggtg

SEQ ID NO: 145145 - DNA, 566 bp, Homo sapiens
cattggatttctgttgcgtttcctccatgttggagggtgtcggaatagagtctgagaagcagaaggaggtctcacttgaggtcaggagttccagaccagcctggccaacatggtgaactgtctctattaaaacacaaaaattagctgggggtggtggtgcatgcctgcagtcccagttactcaggaggctgaggcaggagaatcacctgagcccaggaggcacaggctgcagtgagccaagatcacaccacaggactccagcaaaagaatcacatgaggtaattcacatgtgagcatatacaaatgaggtagtattatcataactaatagtataagaggatggtaaatagggaaaggagagatatgacacttaaaaaaacctataccaaatatgcaattttgcctagagttggccctagtcttcaacttatagaaaattaaaattcttgcatacatatatatacatgtgcacaaatttatacatacaaaagtagatgtacacacgtatctgtacatatacactcaatattattcatatgtgcatgcatgaatgaacatacacataa

SEQ ID NO: 145146 - DNA, 637 bp, Homo sapiens
tatttcactctattttgggacaagaaaaaggggctctttggggccacttcctgccttcccctcaagtaggatctccagcctgcagagggtgcctagtccttctttgcccaagaaccagtccaagaagcctttcctctgtgcctgggaaatgcaaccttttcttgggagcatggtagggtgttggtgctgaagaaccaagcagcgacccgtcttgtagctgccatgttttgtcgaggggttctgggggtcctgctgctttagagccacatacttccacttcctgattcactactgtgagctggtcagatgcctagaagaggaacaagcgttcaaagtgaaagtgggcacattaccggaatagtgctggggagagtgctggattcttttccaccccaggcggactggtgagaagccaggcttggacctgtcctctgctcctagcttgcacactcagccctaaactcagagcagcacgcataccacccctcacacacaccccaccatctgctgtctaaggcccctgggcttcctgcaggatccagaccaatgtggctgggcttgggcttttatctgtcctgatcctggatttgtcctgaccaatgtaagtgtcgcccaataaaaccttctatgaccccca

SEQ ID NO: 145147 - DNA, 329 bp, Homo sapiens
ataacacttctctcttctgcatcatgtgctatttctataccgcatgttttttccctttaaggagcaagtaagtgggtaatcttatgtaactggtaagtccaaagtggcactggcttcgagcatagtgtccagtagaaatatatgggccgcatcatccagaggcctgaagcaatgtcatcagggctttggctctctcctcccatcactggcttagtttctttgtatttggacagactccctggcaatcaaagtactggcacgctctgactcaaatccctgagctttcagaagcccaggaagtttgttttttttaaagagtctatacctag

SEQ ID NO: 145148 - DNA, 474 bp, Homo sapiens
aagccctaagactctcccaggctcccagccagggaggcactgagccaagactgggcaaggaatgggccaggcccaccagctccccaaccatccggccaggacacagggcagcccctgcctgactgctgtccccaggagcctgcaccaggagccaggaaccatctgagctccaggcctgcatgacaaggctacatgagaaccagtattgattcatttcattcattcactccacaaacacaggtgctcctcgaccctccgtgaggccacgtcctgataaacccgtggtaggttagaaataccgacagctgaaatgctctaatacacttaacccacggaacatcacagctgagccttcttgccttatacacactcagcacacttccattagcctacagctgggcgaagtcatcccccaataaaaagaagaaaaaacaccaaattaacacaacacactaacaaaaacaaaaggggggg

SEQ ID NO: 145149 - DNA, 271 bp, Homo sapiens
aaaagaaggaacaataattgtgccaaaaagagccgcggccacgtatagcctattcgctgcacaaactgtgccctatgtgtgcccaaggacaaacccattaagaaattcgtctctcgaaacatagtggagaccgcagcagtcagggacatttctgaagcgagcgtcttcgatgtctatgtgcttcccgagctgtatgtaaagctacgttactgtgtgagttgtgcaattcacagcaaagtagtcaggaatcgatctcatgaagcccgcaagg

SEQ ID NO: 145150 - DNA, 218 bp, Homo sapiens
accaacattagggtcttaagttttcttgcttttcttgatgttcatgctgggatgttccatcactccagttttcctccaggctcctaaagaacccaatccttttctgtagctttgtaaattattactaccagaaagttcccttttgtgctggtccaacttcaaaattattgaagtcccacttcaaatgttatctcttacttcaaagtcttcccaactca

SEQ ID NO: 145151 - DNA, 425 bp, Homo sapiens
ctcagggatccccaaggctggcctgtggccagttggcagcacaggttagtgattatgtccagagagcttagatgcaaactctgtgatacaaattctagcatttcctggcatcaaaacatcaggcaagttattcattcaccctgtacttctgtttcctcatctgtaaaatggggaccacccttacctcatgggagcactgagagaattaaatgagataatacatgaaacgtgcttagcacaggttgtgacgtatcataagagtttaaaattactggttcaggtccctaaactcatccaatccacaagttttacgctcatgaaaactgaggcccagagaggtggtaagacctcctgggaggcagtgacctgctgccactggagtccttgaatattcacagatcatgacgggccctaagaaggtcctt

SEQ ID NO: 145152 - DNA, 376 bp, Homo sapiens
agagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaata

SEQ ID NO: 145153 - DNA, 249 bp, Homo sapiens
ttttttttttttcacaagagttcatcggtggcccagacgggagggcaggggtaccatctcagctcacttcaacctcggcctcctcgtttcaagtgattctggtccctcagcctcccagagtgctgaaattacatatgtgagccaccgtgcctggctaagaagggatcgtttaaatttttaaaaataccttaatttatttttatagagacaggatctcgctgtgttgcccaggctggtctcaaactcctg

SEQ ID NO: 145154 - DNA, 435 bp, Homo sapiens
tttgggggcctgcacctgtcctcagggtgcagggccaatgcctccagcctcaggactcccctctcatagcccagactctgaccagctccctgccttgagccagagctggactgagaataaggctttgtttcctgagcatctgagaactggggctctgcaaggcagccagggctggagagaatgagggcgcacaccccagacagcttgtgggtgcaggaatagcctcaggcagacaggagtggagccaagggtagatttaaaacaaaacacaaaattactgatgcctgcaaacaaagtggcttctctcagagaacaatttggaaatggttaagatcatcttggaatagtccacataagataattcttctgaagacctttaggggtgcagctgaatttgtgtgatagaagtaactacacacttggattattttccca

SEQ ID NO: 145155 - DNA, 861 bp, Homo sapiens
  misc_feature (82)..(82): n is a, c, g, or t
  misc_feature (85)..(85): n is a, c, g, or t
gtcgggctacactggtggtctatccgtcaatccgaatccatcgatccatccatccatccatgcatccgtccgtccatccatncanccatccatccatccattatgtgtcccatttatccattcatacatccatccactcatccatctatccacccatacatctctccgtccatcatccatccatccacccatccatctattcatctggccatccacccatccatccttctatctatgcatccatacatgcatctgtccatctatccattcatccatccacccatccgtccacccgtcagtccatctggtcccacttccccctgccgggctgctgcagtcagtgtagagctgggggtggaaagagggatgagcagaggagcttcatgggctgtccctggaaggggaaaaggtggaagctcgtttcttgctgtgggcatgcctggtgtgtctgggaaaggtgaggagttcattattttgagaactgaacgattcatagatggggccgtgggagagaaggatagacaggtagtcaggggctatacctgcagggcctcatggggtgcagtgaggagcctggtttccatcagttgcagtggggacccctgagagggtttggagcaggaagggccatggccatgttgcttttgacacagacgcctttggctgcattgacagaagaggcagggagagaatgagtatggacatggggaagccagtgtggaggtgggggagaccaaatcggagatggaagggaggccaaaggaaagatgggggtggtcaggcccggggtagggtctaggagggaggtgacaatctgggagtcctggagagagagaggaagggacagctggggagagactg

SEQ ID NO: 145156 - DNA, 712 bp, Homo sapiens
cggacgcgtgggctcaccctttcctgagaatacagcctcctcttgctgacactccctctgtgacacagccttttccttggaccttgttggggaccactttcctcctcgccactcccttccagtcacactggcttgatttctgtcctttaattttttttttaatttttattttttgagacagtcttgctctgtcacccaggctggagtgtggtggcgtgatctcggctcactgcaaactctgcctcctgggttcaggtgattctcctgcctcagcctcctgagtagctgggattacgggtgtgcatcaccatgcctggctaatttttgtatctttagtggagatggggttttggcatgttggccaggctggtctcgaactcctggcctcgggtgacccgcctgcctcagcctcccaaagcgctgggattgcaggcgtaagccaccacgccaggctgatttctgtcctttaaacagcacaagcttgttcctacctcagggcctttgcacctgctgctttctctgcctaggatgtcctggaaccaggctgctggcatcaaattcaggctctgccacccattagctctgtcaccttgggcaagtaagatagcatgtctgagcctcagttctctcccctgtgaaatggagaaaagggaacctccttgttcaataggcgaggcatgtcaagcacctgccagagcctagtgatgcagag

SEQ ID NO: 145157 - DNA, 383 bp, Homo sapiens
atgaattttttggtttcccagtgcatacagaaatcatgtttacactatactgcagcaaacctattaagtgtgccatagcattatgtcttttaaaaagtacgtatcttaatgttaaaatacagcattgctaaaaattgctaactatcgtttgagtcttccgctgcttgcaatcgttttgctggtggagggtcctgcctcgatgctgatggctactgactgatggcggggggggtgctgctgaaggatgtggcaatctcttaaaacaggacaaccatgaagtttgctgctttgactgactcagggaaaatttttctgaagcatcccatgctgtttgatagcacgttgcccatgttagaacttcttttaaaattggagtcaatcct

SEQ ID NO: 145158 - DNA, 532 bp, Homo sapiens
ttaagacaaccaggaaaactcaaacgtttactcagaatcaattatcttactaagaagctgtaattgcagtttttacatatgtaccaagcactaaccatatgctcagtccccagcagatgtatgcatcaacgaggcctcaccatcatggtttctaaactatattgctgtcattatttcacattaaaatcattcttatctaatttccaaagatccatattgtgcctatatgtaattggtggattaataggtatttacaattgttgtagggcttcttagttcagctaaaagccaggttcttgtcacatggccatgagaaattaggctcgcagacactttgaaaggtaagaagaatggaatttattgggtgaaaaggaaaaaaagggaaatgggggctcttgcttgctagctggtttcctgcctcacagattgaatcccaggttccaccccagaacagaagaagccaggctggaatcccagactcctctcccatgcaaagggcgcagacttccatggctcatcctattctcccagt

SEQ ID NO: 145159 - DNA, 422 bp, Homo sapiens
tgctcacaaaagctagagataaaaacatcctttaagataggcaggattgtatgaccttcactcaggcctgggtcaagcttgttgggatgagaagatctactttgtgttttttcctcaagcacctcatggctttctgcagcccctcattattctaaacaacacatacatctttccatcatctgtgcaagctgtcaaattgcagagggagcaatttgagtatcagccattgatttggctttgttgcctcacagttccgctctggctttgttctcacgtcagggcaaataatggagagttgacttacacagcaatgagtcccttttacaggcgactttttaaaaagcacaaatgagggtttcatgaagggcaaccactggaaagatttaggaatagttaggacttcccaaagatgcactggataa

SEQ ID NO: 145160 - DNA, 122 bp, Homo sapiens
aaaaggtgccagtcactgctctcatcatattgccctgtgttttaactctggctttcacattctacatgaacacatgggagatgaggtcagaattttaaaacttggaataaaagctgttttgg

SEQ ID NO: 145161 - DNA, 480 bp, Homo sapiens
ataccgacctctgcacagagcatgcctccaccttcaactccacttgtcaaatcctactcatcctcaaaattccaggcaaaatgccactttcttcactaagccttccctggttccttgaattagacaccattgcttcttattttataaaggtccactctatttgggtccttggtcacatcttgcatctagcagtacacttagtttctcacttggtcaggcccccaaaagaatgtacattttttgaggacaggaaccctgtcttattcatcttactttgaactgtatgtaccatgacatcacaagtagccagggccatatgtttaggatgaatgaatgcagcaacttatttctcacaaagtctatacaacctgacttccccaaccaaaaacaacagccatggagcagcagtgcagtgatagagaattcatgggagggagcattcactatgggctgaaatgcccatggtatgtttgatggagg

SEQ ID NO: 145162 - DNA, 653 bp, Homo sapiens
tgtattgattagccaaggcagagggctgttaatcttgcacctgatactctgctataggctctggaagaatataatctagtataaggcacaaataagagacctcaaggtatctgagaactaactttgtgtacatatttgacaaaattatgttattgataattatacatacaggaagaatatatcatgttaatgaactaacattctggaaccatacacattttaatgttgaaagatgataaaaattaagttgaaccttttcacttgggatagaaaaattctcaaggatgtggtgccattttatctgtgactagtagataggattgggtatgtagcaaagggatagtgcttgaagcaggataatatcataaaaagatgcagaataagtatgatttatttggagaaaattacatgacaggggagtgttactgtgagcaagagatccagattagaaagattgtttcattgccatcacaggacatttagacttgattcagtaaccagtggaataatttcacattaatggttgattggaaatttatttggtaggaaagtaggtaacagtttatcgaatgagaaaaaaatagaaaaaaaacatgagtaacttacttttctccccaaattgaaactgaaatggcatgtgtgcattaagaaga

SEQ ID NO: 145163 - DNA, 420 bp, Homo sapiens
ggaattctatgctcacactttgctcagcacacataggcgttctgttgacagttggctctcaacacctcaagtacgtgtcagagggacgcgagccgatcagtttacccaagctccttacttattctcatttaccctctagaattttatttcctgcctcagaaagaagaatcccatctgccagaaggaaatatttgtagccaacatgacaaaagtggaatccctattttgtaacagctgtgaatcaaaacactagtgactgaaattaactacatcgtgcttcggaacagatgtgtgcacagaaaccaactcaagctctggtgttcctgggcaccatgtgtaaatcatccacagacaacacggtgggccatgttctcaccttgttgctatgcacgctcatttttaatgttctcctgaaccatt

SEQ ID NO: 145164 - DNA, 344 bp, Homo sapiens
acagagcactgtcagatcagtgtcacacggaggggcattatgggtgcacctgcctcttccctccccacccctgcctctgcctcagcacaggcctcatctccccacctgggtctcccagcgctcagtgctctccctgccaagccctcaaatgcagatgggaaaatggcaccctcggtgtctccaccatttgtgccgagttcttgcactggagcgcaggtgacatcccaaggtgacacaggggaagacccagggtataaagagccccaggataaacagataaacacgagcaccttccccaggcatctttgttagggggaatatgagagagagcagaatgtaaaatg

SEQ ID NO: 145165 - DNA, 175 bp, Homo sapiens
tgtttaacctgatcacaatcggaaagctacctttgaattcccacgaggtggggtggaaataaccttcctccccttagacactgcagaggttctgaaagttacattaccgatgttaatacccagccttcactaattctacacattcatcagtgctaactgacgaggagggtgagga

SEQ ID NO: 145166 - DNA, 504 bp, Homo sapiens
  misc_feature (457)..(457): n is a, c, g, or t
ggggtagtggtaggaggtcctgttggagagcattggtatccagtaaggatttaaaagtatttatttaacaaagaatagcagaaagtggacggttgattcacacttggtgcaatctcggctcactgcaacctccacctcccaggttcaagcgattctcctgcctcaacctcctgagtagctgggtttacaggcaccagcgaccacgcccgactaatttttgtatttttagtagaaacggggtttcaccatgttggtcaggctggtctcgaactcctgacctcgtgatccgccagcctcggcctcccaaagtcctggaattacaggcgtgagccaccgcgcccagtctgtttttggcttttttgagacaggttctcattctgtcacccaggctagagtgtagaggtgtgatcatggctcactgcagcctcagcctcctgggctcttgtgatcctcctgncttagcctcccaaagtgttgggattacgggcatgagccactggaccc

SEQ ID NO: 145167 - DNA, 364 bp, Homo sapiens
gcatcagcctcccaaagtgcctgtaataggcatgagccaccatgtccagcctctaatacggtttttaagtattctcggatgctcaaaactgatcgcaaaaccggatttcaaaattactatatagtttttgttactgtatttataaaacttagcacattgtggcttttaggttgctgttatggtgaggtcagcttcctgtcttggattttgagtagcttttgccctcctctagaacatggtgtgttcagttagatgctctcccttgatcctttgctcttcagcatgtcctaaacgtctctgttagacagaaccatcagttccacagtttggccccccttgagctccgtgttctctaccaccccac

SEQ ID NO: 145168 - DNA, 210 bp, Homo sapiens
agggtgtcacagttcaggtggccttatgtgggcacttctgtgtccaagggagctgcacttgtggcttgctggtgcagtgagatgggcgccagctgtttccctgcaagcacttaaccttgatgtatctgcactcaggaagaatgctcaggagctcctccaaaacaggtgcaaaatagaaacagggatgatgctgcagcagggctcaaggtc

SEQ ID NO: 145169 - DNA, 263 bp, Homo sapiens
cttctgggctgtagtccagcaaaactgcagtcttgacgtaaatgccccactgccttcacctgagcagggttctgaatccgctttcttaggtttgtaataataatgcggaaagcagctgagctcctctctgtgaatgtggcagcttcgctacctggctacctttgcaattcacatctgaaccattgatttaaacattttatttaaaaatctgaatgcaagagctgctgtttctaattttccatgattgagagtgctctggtttg

SEQ ID NO: 145170 - DNA, 721 bp, Homo sapiens
atgaaaagataaaaaatgagctgaagcagcagcagtgttgaaggcagcctctcagctcttgctcttcttacaccttttccctgaacataaagacacccccttttttctttaggcgatctatacctactctttacttctatcccaacacggtggtgaggacagtgaatcagaaccacattctggactaattggggttctatttcatattgccactcattgctctggccccagggacaccagcaatggccataaaccatggttctacctcaaccatgcagtacccaataagtagtgggtttgatgaaactgggcagagggaggggggaaatattttagtaatttgccttattttattttatttacatatttaattgctataatgttgttgtctattaaaatttcatttgctctggtagattcactgaaaatatatttaacaattgcttaattacctgttgtaatggcatattccgtgtgtgtgtgtgtgtgtgtgtgtgtgtgtgtgtgtgtatgtgtttaaaaccctgtgttataacctgacaggcaacataagcaatcattactttcaggagttcatataaaaacatgaaacaaaagagattttgtgttaaaaacagttgtctacacagaacacacactaaagtcatcctctgctctgttcacccttccagtttttctccgatgaccacagtctacaaggcttgattagaaatggctgcaa

SEQ ID NO: 145171 - DNA, 436 bp, Homo sapiens
tcagacatgttaggtaaaggttcatgtaaaaattgtaaagcctacacagatacaaaggattgttgttaccatccttcataagaaatgtcttattgtcctgaggttaagaaaaaattacttgtagttttttaaattataaattgaaacatatcattgtaggaaaatatgaatcatatataatgtatatgggagaatgtaaaaagcacccatagttgcatcactagataaccattacaaatattttgttgcattgttgtatttatttccttttttcagttctgtgtgtatgtgcacatgtatgcaagtatatgctgtgttacaagatggagatagtgctacacagtcaagttgtatgctgtttccccctgcccccacaacttcatattgtaaacatttccttgagtataatacaaattctgacacctgttgttaatgg

SEQ ID NO: 145172 - DNA, 385 bp, Homo sapiens
gcaaatgatttattaagctaaacaaataagaaggagtatcttagtaaataaggacagttggcatgtatgtaggtgtggtcttgggactttgccacccagaccagggatttgggctgtggggaaggatgatgaccatctgctccaagtgactcctactggctgatacacagagctcagttggcatcagtctcagaagagactgccagcctcccaatcagaaaataagcaaaacaatggcattgctgtcaagcacagaaatgaagtttaagatttaagtaataagtggcgactcagaaagggtcagaaaccttagagtgtaatccagacagatataagttggcttgattgtgaaatggaccatcctgacagttaatggaggatactt

SEQ ID NO: 145173 - DNA, 407 bp, Homo sapiens
gtcgaggatccccggcgcgctgagcagatacacccaatcaactcaaacacactttcttgctgagcctgctcagaatcgttcaagacagcactccaggaaacctctgtcaacaaatctaagtatttgccacacgtgttagccagatttgaagtacagacagcggaatgacacttatcccaacgcctcccttcctctcccatcctgacacatgagaaagctgaaaccaagagaaatgaagttgcctgcttagtttcaatagcaagtgtagtagtagaaataaaccaaagcccggtttctgggaccttccttttttaggtcctgaacttctataattcattcagacatgacccttcattgacatgttattaaattaaagacatactgcaggggaaggacgatgagtccct

SEQ ID NO: 145174 - DNA, 173 bp, Homo sapiens
tacaaaatgtctggtggccctattgtcacaaaacctgtataaaagtaaattcacaaatggctttttagaactgatgacaaaaagttactcgttatcacttttctacttaatttcctaaaagggcaatttgaaatcacactaggattctcacaattttggttgacactcaagta

SEQ ID NO: 145175 - DNA, 863 bp, Homo sapiens
tgagtagtgaggactggaggcgagtgtccccacacctgcctaatttttgtatttttttgtggaaatggggtttcaccatgttgcctaagctggtctcaaactcctgggctcaagcaatttgattgccttggcctaccaaagtgctaggataacggacttgagccactgtgcctagtcctgtcactttctgaaaaatcctatgaagcattaatagaagtaaaatcacacttaattatgcctgtttttaaatctgcatattgtttgattaatcacatcttttggccaagttgaaggcataatttatatattgtctataagaatcaataaactagtttctaaatatgttttaaataaataatttaaaaattaatttctcaaatatcctcaactataaagttagacctatttactgtttcttgtaggagcctattgctgtcaaaaatatctgaagttctattcagagaaaaatagaaatgcacaatgactgggacttaagctgaggaaagtcagcaacactgttcccatcattctaccataaatgtggcaaaatcttattgtttgtgacagatctatagaattagattttcttatatctaaagaaatatatataaatacataaacgtaggtatgtatagcatgaacagaatacagtgctatttgaccattgtcacaagacttatttataaaacctcctcaagctcttgccaatatcttagttaagattgcatctaaggtgggaggaggatgaagattgaagaactgtcaggtaatgcttgattacctgggtgacaaaattatgtttacaccaaacccccatgacacacagtttacccatgtaacaaacctacacatgtcccccttga

SEQ ID NO: 145176 - DNA, 163 bp, Homo sapiens
ctgggtatctgtctgtctgtgtttattctttcctttagtagtttggctggctggctcactgtctctcaggctgttttcctctctctctttctgtcacaatgtcaccattttaaagtgaacaattcagtggaattaagtacattcacactgtgcatgcaagcac

SEQ ID NO: 145177 - DNA, 472 bp, Homo sapiens
gcttagagccccaaactcctggggttggtcccatgtaagcacgacactaacatggttcttgggcccaaactgcagcaaagtaaacagatgtgggcttaacagcctccaggaatggaggaggcaaggggagaagggataagcagttgtcaaaggcaaggatgagagacagaagagagacaagggacccttgctacccactgatttaaagggccaggtcccaaaccctaagcacccatcatgagtcatgatcataatctcacactatccttagaaatggacagtagcacctgaaccaccattgatgaaagcccagaaaagatttgacttctcattgttatttgagtttgggactgaaagtttagatctatattatcatttgccagagataatattttaatttgttactatgtcctgctgataccttagctctacccaacctcgcttcccaccccctactcatgagaatcaaaga

SEQ ID NO: 145178 - DNA, 408 bp, Homo sapiens
gttaatggatgcctagtacaatgtaataaaaaaggatgcaaatacagattttatagatatggtaggttgagggccttggcttttaccatcttcatgaatcagaaagccatcagacaaactgtttatggcatcgacggatgaggaaaagcagtgatgtggaatagcaaggggaataagtgaaaagggtgactatcaattgcttcatagcatcatgatcctagcaaatactgagacatatggttacacattgctcacttccattgtacatggttataatacatgcacaatgtatgaatatacattggtagagactcagaaccagctttcaggaaagttccatgaagaattcagaaagaggggtgttctgttactacaaaatacaagttatgtggtgataacaaaggtttc

SEQ ID NO: 145179 - DNA, 388 bp, Homo sapiens
caatattccatctcaaaaaaaaaaaaagaaatggtgttccacagaaaaaaataaagcagttagctcagcttacaactcaaaaaactacaaatgcttttcttttctccaaaataaccaacacactagccagtatgcagtaaaaagtgctttctccagcactttgggaggctgaggcacatgcatcgcttgagctcagaagtttgagagcagcctgtgcaacacagtgagaccttgtcactacaaaaaaatacaaaaatcagccaggcatgatggcgcatccacttgggaggtcccagccacttgggaggctgaagtgggagaacagcttgagcctgggagccagacgccactgcactctagccttggcaacacagccagaatctgtctc

SEQ ID NO: 145180 - DNA, 264 bp, Homo sapiens
aattagttggaggaatagagagaaatgtgtatactctgtcttgtccagaaccagaaatctagttcacctatttctgttttcttgaatgatctgggttggctttttaagtctttgaggctccgtgttgcactcacctaattttagctcaataagatcatgttactgagtctactactctgtacatcaagggctgtagtggctcaattttttttttcaaagatcaaattttcaaagtccatatatttttatcaaatatgcccttag

SEQ ID NO: 145181 - DNA, 358 bp, Homo sapiens
ctgctgtaccccttccgagtcagagcgttaggagttgtttcatggtctgctttattctctgtgggtgaatttggatgcgctggtagccccggctttgtattttaatccagttttgggcagcaaaacctcttcaatgaatcaggtgtcatttgagagccatgtgtggatgtgtgatgatgctgggatagataaaaatagctactgtgtatatttctttttaaagggaactggagggaaacacatcagcatgttagtaagtggtctgttgtccaggtggtgaaatttcagatgattttcatttctcgtgcctgtgtctcaggtcctctggaaggcagacaccagggtggcattggaggtg

SEQ ID NO: 145182 - DNA, 425 bp, Homo sapiens
atgccccaaaggattataaacagaatgagtaactggaagttcaaatgccatccagcactgaaattgtccatctggaaaacagcagctttgatttttcagtcatcagtatgttgagatggatatttacaaaatccatgattattccctcaggagggaagctgcttataaaacaacttctgaggattttctggtcagagtccttctggaatcacgaatattttatgttttcaagggcgcctctgtcagatacctcaaggagagagccttttaaagtccttcgacaatgctcctattacttccctgcgggcggctccgactgttcagctctacataattttgctcaggtacctgtttacatgtttagagccatccgatatgaggctaaacagctgtgatgactgcaggctctttgtggcaacctgctg

SEQ ID NO: 145183 - DNA, 444 bp, Homo sapiens
tataaaaaatatatgctatctgccagggatgctgtgagaattcaatatgataatattttaaagttccctatgcaatgtagagcacacagtaagaactcaataaagcaaccatacataagatctggccaagtcaacttctctacagctttgacctggatatgagtatctttagatacaggactttcagagctgaatgcaatgttaaagattttaccatcaaatcccctcacttagaaaaagggaaacgttgaggttgaatttctgggtccctgaactcttttcactttctgtccagagaggaggtcataaccctggctgtcctttctggatttgggggcacacttgaggggtagggtcgggggagatagatcccaggttggagttcagtgttgcctaagtcattggtgatatctctcatctccttgggcgagaggaatctgggag

SEQ ID NO: 145184 - DNA, 103 bp, Homo sapiens
cagtgcgtttactgtcatgggttgcgatggggaagagcaggtgctggggggcagcaactcgcctcggaggactcaaagaagtgtcttaccagagagcattaag

SEQ ID NO: 145185 - DNA, 352 bp, Homo sapiens
tgtgctcattgtaccccatgcctggggcgtgatgctgctgccagcaggtggatgaatgagtgagtgggtgagtgaaagataagaacccagaagttcaaagccaaggccagggcttcattgctgaccagctgcctgactttaggtatgtgagcttcacttccctgtgcctctcacccctcgtcgaacaggaataatagcagccccgactcaccatgtggttgcaaggatgagctaagatcatgtctgtaacaaacagcgtgtaaataaacaactctcagaactctcagagccccctccgtatcatagcctggtctcagacgtggttaattcaaccagaaaaagctggaacagg

SEQ ID NO: 145186 - DNA, 314 bp, Homo sapiens
catgcatgcctgtgtctctctgcgtctgtgtgccttgggagtttgtttgcatatctgtgtgtgtgtgtgcgtgtggcagtggtgtttctgacttatcttagaaccacgtgaggacaccatgcttccccgcccagtcgcccccacaccccagcagcactacgggcctccctgcaccctgcagctgcatgcaggaaggcagcagtggcttcaggcagctcctgtcaccccctccatggtcctcgtacccgctgccctagaacgcctcttctggctgtttctcgccagctttctctgcacgatcagacgtggtggct

SEQ ID NO: 145187 - DNA, 664 bp, Homo sapiens
tgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaa

SEQ ID NO: 145188 - DNA, 200 bp, Homo sapiens
atattattgtgttttgtctttagggcatctgatgcccctgaggaccagcctgcgggatagtctgtttttgcagggtttcttggccagaatcagaagagtgggattcaggacaaggccagttcacgtaacatagctcagagccatacaacacaacttgctccaaggatgttgggcattgtgcttcattaggaaacaaaata

SEQ ID NO: 145189 - DNA, 368 bp, Homo sapiens
aaacacagcagattctttttcaatttagacaaagtcatagataaacaatagaacattggatgttagtgtatatcgttttgtaacttgagctcctttgtgatgagacaaattcattttgtacagagaaagaagctagcagttttcaaggatctattaaattgtcaggcacaggacatatgtcatctcatttttaattctggaaacaactcattgagacataggaattatccacaatttacaaattactacctggaggtgtagagagatttaataacttgttcaaagtcatacagttgaggaggggcagcacaggaattcagacccagaactgcactccagcctgggcacggcacagagcgagactctgt

SEQ ID NO: 145190 - DNA, 285 bp, Homo sapiens
cttccctcacgcgagccgagaggccagcctggccaggacccatgtcaccagagcctttgttcaccaagtccagacatccaatttaggatgacatcatggaatccagcctggaatccttgttatgccccattttctttctttcttcctttccaagggttttgtttcttcttgaggctgcagaaacagaggctcacacacatccccaatttgctaagaatatttctaaacccttctcatcacaggccatcccctgcgtctgggcacttcataaataattatttactc

SEQ ID NO: 145191 - DNA, 211 bp, Homo sapiens
gagattgaacgaagagcgggttgaaaatacagtgttgaggtatggtggctcacacctgtaatctcgcacttcaggaatccaagcaggaggatcgcttcaggccaggagttcaagaccagcctgggcagcatagagacctcctttctactaaaaatttgggggaaaaaaaaaattagctgggcctcggggcccgcacctgtagtcccaccta

SEQ ID NO: 145192 - DNA, 305 bp, Homo sapiens
ggaactggggatttggcaccatctaatctagtcatttttacaaccccaagagaattgcatgtcatttccgctcttcagaggaggagctaaggtctgagagaccctgcagtcaccccagtacaagtcaggtgtacccgcctggccatactcagtgccctgggagctgggcccagcccataaaacctgtgctttgcagaaggcaccagagacaccagggtggtggcaggttactgtttctagaagagcaaaaccaatgcaagtgaataagccaccaccttgttagccagtgggagtttctctgggtg

SEQ ID NO: 145193 - DNA, 362 bp, Homo sapiens
caatcagggtttgttttcgtagcgtcactcctcagggaaaccgtagtagccaacaagcttggagctgctggagtttccaaagatctctggatcctgtagtcctcctcccgcgccagccaccgaagaacgctgcggacccagctcgctcctggtagcaagacccgaactgtaaggaacaaaaccctcgtgaaagaggagcaaacctttcacttcgctgcgttttaagacgaaagttagggtgggtttcgcttccaagttgaaggggcatgattttcccagaacttttttttaagaaggaaatattttatcagcataaaacatcagagtcgtggcagcagcccaaaggaaatcctttttctttc

SEQ ID NO: 145194 - DNA, 369 bp, Homo sapiens
caaggagttttaattgtcatatgtattggcaggtccgtacaacgtggttttagttataatgcagtcacatggtccccaaaggtcatgtttattgaggccccagttgaaaaatgaatagggagtgatagagccatacatcaaatatccttgttttcgttgttacttaggttattgactaagtacataatgcaagttgacattcatgataattctctgaaatacatagtgaactaaacatttaacacgcatttttctatttttgattatgaagatatgcccagtaatatgaaagccttggatgaaaaaataaattctgtggaaccttgtttataaatttacagaaatggtttaaggcaataagttgaagtc

SEQ ID NO: 145195 - DNA, 313 bp, Homo sapiens
tgtccagattgttacgcggctcgatctgactacgcggctcgattactacgcggctcgatctgactacgcggctgtgggtggtgcagaattggcggggtggtccgaactggctctccagcagggtcgcctcactccacagcaggctctgtggggacagatgcagctgcccagtgcccggtgggaatgtggccgggggctggagcgcctagcttaacgcatgagaaccaagacaagacgatgcttgaacatcgccctccccagttctgtgtgtaaccacttgtttctggtccctggcactacccaacagaccctg

SEQ ID NO: 145196 - DNA, 522 bp, Homo sapiens
ttgaccaaaataatcatattgtatttttcctattcagagggccttgaacaataaactgaatgagtgtgggggcagaccctgtactttcctagaatgttgtgcgcaagatggtgagcattgaatactggcatgttaatagagtagtgaaagaatagagtagaagcctatctatgttctctggcgaccttcctataagcaggccactttctgaataaaagaggagcaagtgacagaaaaatctaatgcatgcataagacagaaccataagacaaataactaccaacaacagcaaaaacaaaccaatttcaaggagccagagcaattttgcataaaggatggagctgcaagcaggaggataagcatcatagatagaaaaatattttgagctaaccaagacatttgaaggatcccaagatccatagctaaaaaagaatcaatgggcaatcagggcccaagaattgtactaaaaatctataaaaatggaaagagctcacctatcaaactgacatttaaaaaaaataa

SEQ ID NO: 145197 - DNA, 754 bp, Homo sapiens
gttgctccactcggccaccctcgacgacgcgagcgatttagattggtgtcagtatctaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttca

SEQ ID NO: 145198 - DNA, 792 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccataggtaatgttacgtagacgtcattcctcttgtgacttacttccattttgcatttcatatgaacgtctggataacagcctatttgaatttgttttattgtagatttgttactggagcactagtgaagtcagtaacctaactgcaatttgtttagtaatggtttaagtgatgtgtaagtttaaaattaag

SEQ ID NO: 145199 - DNA, 3494 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaaaaaaaaaacctcggccgaattctggcct

SEQ ID NO: 145200 - DNA, 1642 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttca

SEQ ID NO: 145201 - DNA, 3075 bp, Homo sapiens
ggcgtgctgcggtcgatctgagatcccaacgatggtctcagctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145202 - DNA, 3371 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145203 - DNA, 3388 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145204 - DNA, 3412 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatggcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145205 - DNA, 1179 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatttatttcaagtgcccaacattaaaccaatttccgaagttcatggcccagatttgttcaccacttgagatggtttgtaagatgtaaaaccttgtgacctatgggaccgtggctttcttggaacttcaacagttcaatgacttaaggtcccaaaaagtgaatcccacagttattatcaaatgggccagaaattcaaattggttaacctttgaacccctggattcatacttg

SEQ ID NO: 145206 - DNA, 3771 bp, Homo sapiens
ataaaagatttccaagattaaaatattttgtcattgaattaagacagcataaatccaaaagttaccattaaaatagaggtaactgctgtttccatttgttctgtagtgaaagaagagttaagaactactgtattttaagtcagtgggtgaaaactttggaagataatttgaaataacctgttactaacaaaaacagtaaaaataaaaaacttgaagatattaaagactgatgagcataaaaagaaataatgaaataggtacagatgctgaaactcaatactgatgaaatttgagtgaagaaatacacagttttttgtggtatatatgtatgtaccatggaatatatataaaaaggaacaaaataatggcattcacagcaacctggatggagttggagaccattactctaagtgaagtaacccaggaatggaaaaccagaccttgtatgttctcacttataagcgggagctaagcaaaggcataagaatgatacagtggactttggggatgggaggggtgagagggggttgagggataaaagactacacattgggtgccgtgtacactgctcgggtgatgggtgcaccaaaatctcagcaatcaccactgaagaacttacctgtgtaaccaaacaccacttgtttcccaaaaacctattgaagtaaaaataaattgaggggaagaaaaacaataaaattacaattagttaaaaaaaaatacgcatgctaaaaagaggtttatattcttatttttctcctaaattgcaggtatatactttaaaaatcttaaaaaaaaaaaagatacaagatctggctatgttgcccagtgcagtggctattaacaggcacagttatagcacactacagcctggaactcccgactcaagtgatcctccctcctccgcctcccagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145207 - DNA, 2578 bp, Homo sapiens
gttgctccactcggccaccctcgacgacgcgagcgatttagattggtgtcagtatctaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145208 - DNA, 541 bp, Homo sapiens
actcgtgcaagaagatcaccgtctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145209 - DNA, 198 bp, Homo sapiens
gctgcagctgaaggcttggagccaaagtatcggattcaggaacaagaaagcagtggagaggaggatagtgacctctcacctgaagaacgaggtagtttatttcctttactgctttcatcatggtgctagtaatttttgctaagataaatccattatttggaagatgagcaaatggttttcattttggggacacacagg

SEQ ID NO: 145210 - DNA, 451 bp, Homo sapiens
gctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgaggtgagcgctgggagggacggcctgggagcccctccttcccgccgggcccgttacctacccagaccccaggggcgggcgggcggcgtggatgcggctcgggtgccgctcgagtctcttctcctgcccggctagccgcgggtgggagcgatctttaagaaggctgggcgatgacgtttatcatgcttccttttttttttttaagcatttgggcatatataatatttttaaacatcatcttt

SEQ ID NO: 145211 - DNA, 3466 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145212 - DNA, 3351 bp, Homo sapiens
aaggctaggtacgaggctggtttgaatcggccgagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145213 - DNA, 1152 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattatgcacgctctacgggtcctctatgt

SEQ ID NO: 145214 - DNA, 3610 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccataggtatatactttaaaaatcttaaaaaaaaaaaagatacaagatctggctatgttgcccagtgcagtggctattaacaggcacagttatagcacactacagcctggaactcccgactcaagtgatcctccctcctccgcctcccagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145215 - DNA, 3449 bp, Homo sapiens
  misc_feature (94)..(95): n is a, c, g, or t
  misc_feature (104)..(104): n is a, c, g, or t
  misc_feature (106)..(106): n is a, c, g, or t
  misc_feature (112)..(112): n is a, c, g, or t
gaaacattgaaaacatgaaggaaatcagaaatctttaaccaaaaatagggaattaaattatgactcaacaacttgtaacgattttaaaattacnnaaatcattntngcagantgtttacttgtatgttctcacttataagcgggagctaagcaaaggcataagaatgatacagtggactttggggatgggaggggtgagagggggttgagggataaaagactacacattgggtgccgtgtacactgctcgggtgatgggtgcaccaaaatctcagcaatcaccactgaagaacttacctgtgtaaccaaacaccacttgtttcccaaaaacctattgaagtaaaaataaattgaggggaagaaaaacaataaaattacaattagttaaaaaaaaatacgcatgctaaaaagaggtttatattcttatttttctcctaaattgcaggtatatactttaaaaatcttaaaaaaaaaaaagatacaagatctggctatgttgcccagtgcagtggctattaacaggcacagttatagcacactacagcctggaactcccgactcaagtgatcctccctcctccgcctcccagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 145216 - DNA, 750 bp, Homo sapiens
ctcctccaactttctactaggcagctcttcttgactcctttgccgtaccaaagagaatacacagtacaatggttcaaattaagactagtttagttttctttcacatcgtagtccagaattcctgggctttccagggagaccaagtgggtccatgaagttgcccagagatttagttttttttttttttgtcttgtgacttcaccatttaaagtattacactttttccacatagagaaagatgtcttgaatgcactgtttccagcacgttcaaagtgggagaggaagctgaaggcaatccgcttcctcttaagaaagtgactcagtaggccgggcgtggtggctcatgcctgtaatcccagcactttgggaggctgaggcgggtggatcacctgaggtcaggagttcgagaccagcctggccaacagctgagttaggcaacagctaagttaggcaatgtggtattacctgggtgactgagtagtcagttaaaacctgggatgttctattttgaaaatgaaaaatagaaggccctaggcgttatcaacccaatgatagaataataagaaattaagtaaatctattaaaatgacccaaggaaaatgacagggatgaagtttgtctgattggcttgtaaggccaaggttctttgcaccttctcacctgctctccctggcatggccagaaactcaggactatgctgtgcaagagaagtacacttcagtcttatttgagccattatattgtgtattg

SEQ ID NO: 145217 - DNA, 453 bp, Homo sapiens
gttcaagcaattctcatgcctcagcttcaggagaagctgggtttacaggtgtgcgccaccacacctggctatttttttgtgtgtttttagtagagacgggatttcgccatgttggccagcctggtcttgaactcctggctgcaagtgatctttccgcctcagccttccaagtgctgatattacaggagtgagccaccatgcctggcctgaaaaagaaaaacatgcttttaaacagcttcatgagatttcatcatgccagagctgatgtaaaccccacccccacccccactgaggcctttgagttgtgttgcgttcatccccattgtaaattctgctgggatggacatcctattacaccaagctttgtagctgtatttgttaccttcagctaatgcttcctagcagttgaattactaggcaaaaggtatggactctcttgaaggctcttcgtcc

SEQ ID NO: 145218 - DNA, 430 bp, Homo sapiens
tcttcaagtctatctgcagtaggtctaccaggtcaaatgcatctccatttgtaattagatagtgccaaatcaccctccaaaaagattgtgccattttacattcccactgacagttacaagtgtgctggcctacccaggcgctcacctgcattggataacaccaaaatttttagttttttccagtctgtgagtgaattaaaaagattttttttcttttttgagactccatctgtaagtaaataaataaacaaataaataaataaaaataaatacaatttaaaaattagccaggtgtgatcatgcgcctgtagtcccagctattcaggaggctgaagtgagaggattacttgagcccaggaggttgaggctacagtgagctatgatggcaccattgtactccagcctgggcaacaaagtgagaccctgtatc

SEQ ID NO: 145219 - DNA, 339 bp, Homo sapiens
ggctcaggatgggccttcccagaagcaggcccagagggaggctgctccagatcccctgtcccctggggctgtgggtgtccctgaatgtcagggccatgggagggcccctgggcttcaggggttggggaaagtgaacactctgctctttgtccaccttcgggaggacaccttcaaatgctgaccctgggcccctaactgacctgagacttcagagcttcttgggaggagctggggtcccccagcggagcctgggatggagcagggatggctgccccagggagggggcggtggggccttccatcctgctctgccctcctcgtcctctggccccagctcagt

SEQ ID NO: 145220 - DNA, 382 bp, Homo sapiens
tgtctcagtttcgggacgtggggacgccacgtgccattcccatgggccagtgagggcctggggcctctgttctgctgtggcctgagctccccagagtcctgaggaggagcgccagttgcccctcgctcacagaccacacacccagcccccctgggcttcaggggttggggaaagtgaacactctgctctttgtccaccttcgggaggacaccttcaaatgctgaccctgggcccctaactgacctgagacttcagagcttcttgggaggagctggggtcccccagcggagcctgggatggagcagggatggctgccccagggagggggcggtggggccttccatcctgctctgccctcctcgtcctctggccccagctcagt

SEQ ID NO: 145221 - DNA, 358 bp, Homo sapiens
tcgagacccgcctggccaacatggtgaaaccctgcctctactaaaaatacaaaaattagctggacgtgcttgcttgaacctaggaggtggaggttgcagtgagctgagattgtgccactgcacttcaggatgggtgactgagtgagactctgtctcaaataaataaataaataccttcaatgcctttccttatactttgaataaatttcaaacttcctttctcatgctaaaatgcgctgagcaatctacacctacccacctctcaagttcctcctctttgttcaagctttccccatgcccactggactccagccccaaccgttagctactggagtaggaacaactacatagtcttgcc

SEQ ID NO: 145222 - DNA, 330 bp, Homo sapiens
aggctcacatgacgaaggcggattggggagaggaacgaagagacaatagggctagtgggtcctaagaacctctcagccaagagcacaaaacacagctgtgctagatgggtgtaatggcatgcacccagtcccagctactcaggaggctgaggtggggagggccaatatgctgccagcctgggcaacacagcgaaattccatctctaaaaaggaagccacaaaggccacagttgtgcttcttactgttcacacaattggtcaaaaatcttccagcgcatcctctcattcagcgtagcatttaagagcaagagctctggaatcctagattca

SEQ ID NO: 145223 - DNA, 196 bp, Homo sapiens
gtgacccaggctaaaaacaatccttcccttgtgaacaaaatgagggtttcatttctaagtcagctccaacatccaatatgcagcttcctctgttgtatctgttcaaaatgtgaaacagcataagagatctctgactaaacgagtgtgcaacacgggtgcgtgggcatgcctgggagcagccgcctcggcacaccct

SEQ ID NO: 145224 - DNA, 419 bp, Homo sapiens
tgctttccctgcctgtaatgtttccgacaatatcttcatcagttgcctcacggaatgccttattcaccattacagttttccatactgctttgcttccgacaaaggaaaccacttcacagcaagggaatgaagcaatgggctcataagcatggaattgagtagtctcaccccatatccctccaatcagaagcagctcacctaatagaaatgtgtaatgactcactggaaaattcagttatggcatcaaatgagagacaacaccctgaaagcatttctgatttacaggatgaagtaagaatatgccttgaatcacggaccactggcaaccctgtaacagaatacatggatttggtaatcaaggaatagaagtgagagtgactcctggctgggtgcagtggctcacgcctgtaatcccagca

SEQ ID NO: 145225 - DNA, 272 bp, Homo sapiens
tctgaggtgctaacttatgaataaattgcatagactttggaaaaaggccattgttctggttttgcacctgtattcttggttgagagggatgacataaacaaggtgtttcatggtagttcaaaaaatcagatataccaaccacccactgattgactctataatttagcatgggtttgtttttgtcctttgaagtagatagacagagaatttctggacagatttgaaatggatctgatagtctatatatcaagcaaatagacacacctgtcaca

SEQ ID NO: 145226 - DNA, 197 bp, Homo sapiens
agaacatgacagcgtctgggctgtacagatgaaaaagcagtcttggggtcgttgaggttcagataaagggaagagttggaggagggaggggctgtcagaattctcttctccctttcctcaggagagagaggacgtggggcctgaggcctgggttggccttcatttccaatcttgggaaggagaagaaacacctaaat

SEQ ID NO: 145227 - DNA, 401 bp, Homo sapiens
taaacaatgtatgaacattcaatggactataattattcagccttaaaaaggaagagcgttctgacacattctacaatgtgaataaaccttgaagacgttatgttaggtgaaataagctagtcacaaaaggacagacactgtatgattccacttatataagttacctatagtagtcaaattcatcgagacagtaagtagaatggtggtttccaggggaggatggatgaggaattattgtttcatggatacagagtttcagtttgggaatacgaagaaaattttggagacggatggtattcatggttgcacaacagtgtgaatatacttaatgccactgacctctacacttaaaaattgttaaaatggaaatttttttgttatgtatctttactacagtaaaa

SEQ ID NO: 145228 - DNA, 343 bp, Homo sapiens
ctacctgccatgtacacactaagcctatgctcaagcccggacacccagattccacagggaggcacctctgcagcctgcacaaagtctcatgtgtagaaaacgcttttggtaaatgaaagcaagctgcatcttgttacacaaacgaggcttccttgacctgtgtccacggctcagacttaacgtgacaagaatgtccttccccagcccctcagctaggttaaggtttgatttgacagaagagacccgcccatcacatgacgagcactaggagcccattcaagtccaccaatccacagcctcccataggtgggtcacttgagtgggggcacagctcatggccaag

SEQ ID NO: 145229 - DNA, 320 bp, Homo sapiens
ctcagggaggacgggaatgaggacacaggaggtcctctctgctgtgctgcaggccagtgctagggtgggaccagcaaatcacagtggagcatttgcccagttgtccagggtccttggagcctataaagagtggggaggagtcagaattcactctgatggttaagacctgtgctccaatgttcagcactgtggaactctgcccagcagctggttttgtgggagtttgtgaatcactccaatagggaagactccgaggcttctcctagacggcgacctgacctcctagctctggtctgcagggtctgctgaccctgcccaca

SEQ ID NO: 145230 - DNA, 734 bp, Homo sapiens
ggggcaggcaccttggggtgaggaggtatcacaaacctgtcacccaggcgggtcaatatctgtggcccagaccggtctgagggggctgggtcacagaggaggaacataaagacgtgagggaagaggagacggaggccccaggggagcgaagagacgtgacacgctctggtttagggggctgggccttgcctggggaagcagggggacctgccaggcccttgggagggagggtgggagtaccactttggctcgagtatccactggagggcgaaagtgtccgttctggggaccgtggggggcgccgggaaccacccggagacaagccaggtacccagctgttggctgggttgggtggacagggtgctgcccccgccccttctgagccaccagtggtgggtggccgaggcagctggggctgctgcttacgctcaggcttagggggcaaccctaatggcccatcaggcactgctaagccccgctgatggagggagtgggtccggcggggagggggtggaggccgcttcagcttacgcagggacacactccggccagacaactgcccactgctccgaatgctgagtgtgtctgaggcctcagcagtgctgcccccactgggagagcccctcccactgcctccctggggagggggtaccacgctattgctagccgtagagctctccggctggccctcagagccacccttagaggagagggtggaaccgtcagacacaatg

SEQ ID NO: 145231 - DNA, 305 bp, Homo sapiens
gagaaacgagatgggggtgaagctggagatatttcggatgataatctacctcactttccctgtggctatgttctgggtttccaatcaggccgagtggtttgaggatgatgtcatacagcgcaagagggagctgtggccacctgagaagcttcaagagttagaggaattcaaagagaggttacggaagcggaagcggcgggaggagaagctccttcgcgacgcccagcagaactcctgaggcctccaagtgggagtcctagcccctcccctgatgaaatatacatatactcagttccttgttattc

SEQ ID NO: 145232 - DNA, 329 bp, Homo sapiens
gagaaacgagatgggggtgaagctggagatatttcggatgataatctacctcactttccctgtggctatgttctgggtttccaatcaggccgagtggtttgaggatgatgtcatacagcgcaagagggagctgtggccacctgagaaggtaagtgatctctcctccctgccagagggatggaggagctggattcttgtatccgggatgggtttatagatgaaaattttagcccaggcgcagtggcctcatgcttgtaatcccagggcatgggaggctgaggtggttagatcactctaggtcaggagttcaaaccagcctgccaacatgg

SEQ ID NO: 145233 - DNA, 464 bp, Homo sapiens
tctcaacctcccagtttccatccaccccacaacccacagcagtccacttccactcctgctagagtctctacctgcttccttgctgctaatttcaagggaattaagttaaattccctgtctgtcctcatctggcttgatctctctacatcacttaatgctgtcaacctgttcttcctgaaattctcttccctctcttccctcttgtatctgtaatcactggactcctctcctcatttctttcctatctctctgtccagtcctgtttggtcccttgcatgtaagtggggagaaaacagaagcctattaatagagaagggccagtgggaacaggagagaggaggtcttgttgaaggaggataaagacagcacaggtggaggcagtggcttcaaaaagcaaaataccatgctaacctccctgcgagactgaagcaagaaggtaagaaaggcagaatgtgacaaagacc

SEQ ID NO: 145234 - DNA, 432 bp, Homo sapiens
taaacagcagtattgatatgggggatgggttacctgtgaacaaagacttgggttaattaatttgacagtatcattaattactgctgaaatcattggttttggtcagaggtcaggctcttttagcaattgagggcaggtcccatgagagttggagacactaagtaatgcaagagtgtcactgctcaaccatctcaggctgtaggacgaaggcctttcctttctgcctgggccattcagctctctggattaaaccagtttctgctttacttcagtgtctaaggtagggctgggacacctccccctatgccagtgagttgtgttgagtgaatggggaacatttccagtttggatccatacagtgaaccagtgttaaatgtttaagcgctaatatctctcaggactttgcttaattcatatataaaggaggtaggg

SEQ ID NO: 145235 - DNA, 138 bp, Homo sapiens
tcatatacacacacatacatggacccatgtgcacacactatacacacatggacccatgcacacacactcggacacacacctgcgtgtctccctcatatacacacacatacatggacccatgtgtacacactatacaca

SEQ ID NO: 145236 - DNA, 830 bp, Homo sapiens
gtgatgtggggatataattatggctggtgcacgtgctggggtcaggacacagaatgaggaagtcctgggttcttggatcccggagcccagagcagaagcagagaccaggcaagccaggaagatgaagttgcgctctggaattccttggcccttaaatgtacaagtgcggcaggagcagtagtggcagcctcttttgcttgtctcctccagttcctgctatggagggtcccaaggaatcctctgttcactggggcgagttgatgaacttggctcaatggcttagatatgaaagcatttctggcacatgtgtgtagtcaggggaaatcacgatctgctggagctttgctggaacgttcagaggacggtttcatttcatgaaaaactccatcgtggttgggcccggtgactcatgcctgtaatcccagtgctttggaaggccaaggtgggaggatcacttgagatcgggagttcaagactagcctgggcaacatagcaagacctcatctctacaaaaaaacttttaaaaaattaaccgtgcatggtggcacctgcctggacgctgaggtggaaggatctcttgagcccaggagtctgaggctgcagtgagctatgattgcaccactgcactgcatccccggcaacaaagtgagaccttacctcaaataaataaataaataaataaaatttaaaactccatcctccaagaaagaagtcaggtcggggaagcctgattcctagcagaatcccacagggaaggagaaagacaagcaaagggtttcttactaagcagcgctgcaattggctacagggaacattgcgtttttcaggcc

SEQ ID NO: 145237 - DNA, 805 bp, Homo sapiens
gttagtgctattacatcttttctcaaatggagcatgcacatacactgtggatattctttttatgtgtaatgtttactaatgtagctgagatttgggggaaagaacatgatagttgggtcaaatggacctgcattcgggcctctgtccatatgttactgtgtaagctccagaaagaaatgtcacctctctgggccattttcctctgaacagtgagtatagcactatcaccttcttataccctatggtgttttggtgatgatacttgcaaacagagtacccattacaggtggataggcaataaatatttatttgatctgaatgccgtagacatgagcttggattttttttgtatgtggaatttctactgagggaggagtcacctctgagccagatttcactgacttagattctcttaatcatgatttctggcgctttaaggtggcttctactcaaacctcttcctttccctgaagctcccaaggcattttcttcatggctgtgttccctcccatctcagtacttcttcctaatcctgaggccttctggtcactctagtcacttcttcctaactccatctcaataaaaaaaaacaaaccaaacaaaaaacagtaaacgggccgggtgtggtggttcatgcctataatcccagcactttggaagtctgaggcgggtggaccacttgaggtcaggagtttgagaccagcctggccaacatgccaaaaccctgtcttggtgttttttcaaataacaaaaattggctgggcgtggcggcgtgcacctgtaatcccagatactcaggaggctg

SEQ ID NO: 145238 - DNA, 400 bp, Homo sapiens
agcttaaatccgaggttgagcctgtcctactctgcagctagaagtgctgctgggttcaattacactccccagtgccatttgaatggcccttccatgaagggtagactcctggacagtgcagtaagttatctagaggtttgtgtttgaaatagtctctggttaaaaagatgcttctccttttttgacacccctcaccaccccgaagaattatcctttctgtcattttctagaatatcagggccctcacaccacatggttaaaatcattagtaatgctctgagttatccccgtggagacactaacagctgcagcaaactggaactgcacctgttttcaagtgctttctgcttcacccgcctcccacatgtgtcggcgctgcaggtggaagagcagataaagc

SEQ ID NO: 145239 - DNA, 158 bp, Homo sapiens
tcccagcccccagccctcctcattcatttgtgttacatgcctggcccctggaagagtggacaaaggtgcttgtcaggacatgtcactcctccacagtcacctagccctgagtaggtccctgctcagcaaatgccccaagatattcaggagccgacacc

SEQ ID NO: 145240 - DNA, 198 bp, Homo sapiens
cttcctacttggtttactagctgttggaaaggggtattgaaatctccagctataaatatggatttgtctatcagttattttgagcatgtttctagatgtgcaggttgtataatgagagcctataattgaggcatatattttgcctgatttatgtagttgctacttacgattcagttgctgtagccaaagaagaggtga

SEQ ID NO: 145241 - DNA, 336 bp, Homo sapiens
cttacacagcacattaacgaatgccacgttactcttacaatggagggctaatgagaacaggaagtgggatggcatcaacaagagcaaaaagagccaatacacagtgaggctaaaaaagtgacaacagttgtggctggcacactggctgccttcagccttcctaatgatatgctttctcaatggtctaatgcttatttaaaaccttggctttttttttttttatttttttttggaaaaggggttttttttttttgccccggtttgggggcagggggggtttttttaggtcaagggaaacttttcctcccagaggaaagggaatttttttccttaacc

SEQ ID NO: 145242 - DNA, 309 bp, Homo sapiens
aattatgtcaaggaagcttccttgaccttataatttggactaggttaaattaggattttctaattaatcactgtttttctccataaaacaaagatggaaagtgctaagagataacaattaaaacagctaatatttattgagtgttgactacaggcaagccactgtagcattttatacacattatcacatttaattttcataagaacctaagataggtaccattataacccctatgttatagaagagaaagctgagacacaaagcagtaaagcaatttgccgaaaggcacatggccaataaaaaacagca

SEQ ID NO: 145243 - DNA, 437 bp, Homo sapiens
atctctgaatggcattttggtcaatatgccaggaatcttttgatcccagtagtttacttttggcctctggatctccactttcctgtctgtagcaaaggaagcatcattcttgatagaccagttctgcaacattctgggagtcatgccagagatatgcctagagcctacccctccatctcttccaaaaagtttctaaatacctaatctaatctactgtatttaatccctttctgcttaaaatacctacagtaggcagggcgaggtggctcatgcctgtaatcccagcactttgggaggccaaggtaggtggatcacctgaggtcaggagttccagaccagcctgaccaaaatggagaaaccctgtctctgctaaaaaaatacaaaattagctgggtgtggtgacacatgcctgcaattccagctactcaggaggctga

SEQ ID NO: 145244 - DNA, 559 bp, Homo sapiens
atcaaaatagaacaactggggacctaagccaatatgggaacccagatctgactcctgaatttaagccctgccttgcctcatggacctacttcattgcatccttcctggccaccattcctcaaccaaaccttcttcttaaggaagggggaaaaatgagctaacagctgctaggagatttggaatgaatgtgaagttctccaggttaaaatggagaccaagggaaattcatatgattccactttcctcatctctctggatccctcatcgagccagtaatgtattcccccttcttgctaacacactttttaaaatgttaatagactgtaaattacttttctttttatacttcttaaaataagcgtttcctcttgtagatggcaagacgacgctggagttacgggcttggttttattactgtcgagatgagatggactggagagagctcatacagcttttataggaactattttatttataagaattttcctaatgtcagatggatgtgacatgcctggtttctttctgcccgctattgagagaagagaggtatttagcatgg

SEQ ID NO: 145245 - DNA, 651 bp, Homo sapiens
aggaaggggtgaagagaaaagaagaacaaagaaagaacagtggaaggaagaaagtcattcaaatggagaggcagagtggcagagtagaaaaagccaggttctctactcagactggagagaggatcatacctctgtgtgctgtgtgacctggtgcaagttaagatgtcataagagacctcagatctcacatacggaaacaagagacgacccgtagttcacagaaaacaaagatgcgtatgaagaacctatcacctagtgggtatccataaatggtggttgttgctggtatcctgtgcccgcaacattccacacaaacacacatagagaaaagtaatagctaatgtgcatctgtgcatcaagcacatccaacttgctagaaatggggttaaatctcacattatcttatggcaataattttcagtcaagattctgagtgacagtcaacaaaaaccaactttggataacttaagcaaaacaaacaagcaaaatttgttcaaagaatattggttacgtatggaacactctctggagagccaggcttgcgtgctctgaagctcaattccaagcccaagattaggtcccagaactagtttagtgaggggatccagagctggtgctgtgcatagctagctcagctttgatgctagatgc

SEQ ID NO: 145246 - DNA, 563 bp, Homo sapiens
aggaaggggtgaagagaaaagaagaacaaagaaagaacagtggaaggaagaaagtcattcaaatggagaggcagagtggcagagtagaaaaagccaggttctctactcagactggagagaggatcatacctctgtgtgctgtgtgacctggtgcaagttaagatgtcataagagacctcagatctcacatacggaaacaagagacgacccgtagttcacagaaaacaaagatgcgtatgaagaacctatcacctagtgggtatccataaatggtggttgttgctggtatcctgtgcccgcaacattccacacaaacacacatagagaaaagtaatagctaatgtgcatctgtgcatcaagcacatccaacttgctagaaatggggttaaatctcacattatcttatggcaataattttcagtcaagattctgagtgacagtcaacaaaaaccaactttggataacttaagcaaaacaaacaagcaaaatttgttcaaagaatattggttacgtatggaacactctctggagctggggcctctctgggtgcaggctgtatacta

SEQ ID NO: 145247 - DNA, 173 bp, Homo sapiens
acacctccagctcctcaaatgacccttcttcgattgttgcaactaccctagttcagaaccttaatatctcccagaaggattataagatcagacccccttccttgtcatggcctttcctttattgtccccagttctgattgatcttttttttttttttctgagatggagtctgc

SEQ ID NO: 145248 - DNA, 330 bp, Homo sapiens
tgcccgctgtcagccaagtgtaggtggactgtgatccgccttgctggaattaagacagtgggaaagccatacttggaaggaaataattacataataattacaacctgaagggttgtactgcgttctaggtgtccaagtttaacttggtccaagggaatcagaggaggcttccttcaagaagtaaggcttttgctgagacctgaagatgttagaaagtgaccatcctagggaccatggagggatgttgagttccgatatagtgaacatcacttttggaaggtgaggacttggcccttttgtgggactgaattgacactagtgtggctggag

SEQ ID NO: 145249 - DNA, 450 bp, Homo sapiens
gcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcggtgacat

SEQ ID NO: 145250 - DNA, 233 bp, Homo sapiens
ctactgagcagaaaggaaaatcaggggaatagggagctgggagtcagatgccaggtggcagcctgaaaacccattgttaggaagttcactctgagcggcgagtaggaacttttatcttggcaactttaatggagaaagaacagggaggcaggtagcaggaaaaacatgggcccctaagtcaggagacacagtcccaggcctggccctgggacacataagctgcagcaaaacta

SEQ ID NO: 145251 - DNA, 293 bp, Homo sapiens
ttcttgcagacagctctgtctactctcccatctgatctgtgcctcccctctccagctcctccttcttttcctaaactgcctgcccatttcactcgcccgtgcagcatgccaggcattaactctgtctgtaggatcaaaaagatgaactggaggatgtcccagcctcaggcagacaaacaagatcattgcagagaatttctgttgccatgggctgggcatcatcctagagccgagaagggggctctcaggggtgccaccctgccttgatccttcagctctgcaaggaacccacg

SEQ ID NO: 145252 - DNA, 835 bp, Homo sapiens
ccacagctgccactttgaggacacctgggctggactccagctgtgccctcaagctctgttggccccggtttcctggtgctgcccacctcccacctcccactgttgtagtgggggtagaatgaggcaatcctgtgaaatgagctggaagtagacaccatgtatcttttcattagagaagcaaacccccaaaggagaagcattgtcaggcttctctctttgccatggcctttgcctatacccttgagcagtgatctgagtcggctgagatgcagatgttaagcctgggcagaaaagcgctgctctctgcatggtccgggagagacccctctccagccggtggcatgctcgttacgcaacactgcctcatgtccccaggttcatcctgacggggtggtggggcttgatggagactggattcctgcctcccaacccccacaatcttctctcccatgtaaaaaacaaaaccatttcattctggttaaacctcctcctcgttggaaatttagaaagtcaaggaaagctgaaaagaagaaagtgaaaattatctgtcattttcagtcagataaaagttaatatgtattgagcccttcagctgtgtctgccagtgttctaaatcctcaaatagatcatctaatctttcaacaaccatatgaagtaaggactgattatcctttttttataaatgaggaaattgagtcacaggggggttggtagctagtctaggatcacacagtttgttggagggggtagtgtatgcacgtgcccactttttcataattagggttatactttacacatttctgaatcttgtcttttcttctgttaacattgtatc

SEQ ID NO: 145253 - DNA, 282 bp, Homo sapiens
tcaaacctaaggcctttgtggcatgggctcacaagggaatatcctgatccatgggttgcaaagattcatgggagaagcatggtttcccaggcggagtggcacaatctctcaccacttcccttggctaaagctggaggttcatttggctccacaccactcacaggtgggctgttgcccgaccctgctttgcttcattctctgtgggtggagtaaattgcctagtcagttccaatgtgagaaccggggtatttcggttgaaggtgttgaattcattcacccttc

SEQ ID NO: 145254 - DNA, 393 bp, Homo sapiens
ctcgtctgccgtgtttgctgtgtggatgtgcgttaggacagtgagctcgtcttctgtgtttgctgtgtggatgcgtgttaggacagtgagcccgtctgccgtgtttcctgtgtggatgtgtgcgttaggacagtgagctcgtctgctgtgtttgctgtgtggatgcgtgttaggacagtgagcccgtctgccgtgcttgccggagaagtgtgagggcctgctgctgccagcccctgttccaggaagctccaggtcccctcgccacccaggaactaagggttaacacccagcgcatggaggcttcccagaccctctgctctgacctttggggcctggaccccagtgcagtgaaggccagaaagcggcaggggcgcatggtgcccgggggcagcc

SEQ ID NO: 145255 - DNA, 301 bp, Homo sapiens
ctacctggctttgaatcctgactccacaagttctcagctgtgtgactttgagtttattacttaacctctctgtgctccagtttctgtagctgtaaaaggatgttttcaaaaaacagtattaggccaggtgtggtggctcatgtctgtaatcccagcactttgggacggaggacaaggcaggagggctgcttgagtccaggagttcgagaccagcctgagcaacataccaaaacctagtctttacaaaaaataaaaaattagctgggcaagttggtgtgtgtgtgcctctggtcccagctac

SEQ ID NO: 145256 - DNA, 420 bp, Homo sapiens
tatgacggttgacagtgaaggactctgttcctcagcgaggaccccaaattagaaacctgggtgctgtgcttacacttcatgtgtgggtgatgaaggggaaaccatgggattgctaaggctcaggttccaccgttgcaaaatggggctaatacctgcggcgttggatgctgggaggattttgaggtcttatccatgtaaagtgataacagcacctgacacacaattgctctacgaggacagcagcgactattgtcatttaaagaaataaatcatcatatcctctcacttacccttcattcagtaagttggcaagacctgtagattttacttactttaataccattgactctgccctggctttctaatccttctggtttggcacttcttacacaattcccgccataattggatggatcacac

SEQ ID NO: 145257 - DNA, 329 bp, Homo sapiens
tctccaccagattagagacttcctgagggcaggggggtgatattcaggttatctccctgtgagtcctactataccatgtatgcacctttttgctgtttggattatgaggaaggaataggggtgcctgggggcagctgctgattatcaacttgtgtaagcatttcagcacagtaatgaccagcatagcactgtttccatctgcagcccctaacacgtgatctgctgcatagtaggtgctcaataaagatttgttgatggaggccaggcctggtggctcacgcctgtaatcccagcactttgggaggctgaggcaggtggatcatttgagg

SEQ ID NO: 145258 - DNA, 422 bp, Homo sapiens
ctcagtgtggttcctggcccagcagcagccacatttgttagaaatacacattcttgaatcccactcagatctactgaaactgaaaacctgggagcagggcccagcaatcaagagtttttaacaaaccctcctggtcattttgatgcacacgcaagtttgagaacctgtgccctttaggaggatttccttttcctcactaaaagccccctgaaagatgcctcagggtatgcctctgtgccctactgcccactgctgctttcctgtttcctaggaatcccctttatgaagtacccatcctccagaaagatttcttacctaccttgaaaggatcttggcttctccacaaggttactccatcctctgagcagttatttccgattctacttttgaatggtttcttttcagatcttcctcagtgcttt

SEQ ID NO: 145259 - DNA, 188 bp, Homo sapiens
acttcttctcccacgccaggacaggaggacaattagcaccaacaccatcatcctattaataactaactgtactgttctgtactgttctaaggactttttttgtttgttttttgaaacagggtctcattctgtcgcccagactggagtgcagtggggtaatcacagctcactgcagccttgatctccca

SEQ ID NO: 145260 - DNA, 256 bp, Homo sapiens
tagactgaatgtaggaagacagagggggatgagacaagccacaagttcagccgggagatggagggttcaaagaaagtttgcccaggctgccgcagctcacagacttctctctgcccagaactggaagaaacactaaataagttactgggaatctagaggcttgggtgtgaatcccaccagctgatctaggggaatctcattttcccaatcagtaaaatgagtgtgttagactagatgagtcttatgggtctggctt

SEQ ID NO: 145261 - DNA, 173 bp, Homo sapiens
atagacgacacacttatgtttaaccctaaaaataatatgaagcacattctattatgaagaaagtagatccttaaaaatataaaatatgttagcttataaataccacaatatagctgataatttgccccatgaaatatggcaaagtacaactgaaatcattttaatgacccttg

SEQ ID NO: 145262 - DNA, 438 bp, Homo sapiens
gaacgaaggccacactttaacaccatgagctcttgtgagagctccctcactatcatgagaacagcacgggggaaaccacccccatgatccagtcaccttccaccaggtcccttcctggtggggacacgtggggattacaattttagatgatatttgggtggggacacagagccaaaccatatcaccagacaatcatgatgtttgtgaatgaagacagttttacttctttctctccactttagataccttttatggtcatgtgtctcttaattgtgaggatgcattcagagaaatgcattgttaggcaatgtcatcattgtgctaacatcatagagtatactgcaccaaatactgtaggcaattgtaacacaatggtaaatattttagtatctaaacgtaagtagaaaaggtatagtagaaatataatcttatgggacc

SEQ ID NO: 145263 - DNA, 263 bp, Homo sapiens
ttctcttagctgtgcaagagttttaccttcatttaagatgagattaacattacctttctttgctactttttcaaagaactgttaatagtatactgcatagacatgaataaaccatctcttttctcattttcatcaactttttcctaaagcatgacccttctctcagaatatatatagaaaaaaatacagatcctattgcagctgaactgaatttgaagttccccatataaactgaccaagaggtactgtgagaaaaacagcag

SEQ ID NO: 145264 - DNA, 296 bp, Homo sapiens
tacaccggctactacttcggggctccgccggcaccggcgactgtctggtgagtgggccgggccaggcgttggttcccagcccagctcaccctgagggactgggagctttccatgcagttgattgcctgccttcatgtggtttctgagctcacctggctgtgttcctcctccgcctttcattatgatggctgtccggtattcatcctcactgtttttgttattgttgttaaatgaacgccttgttcttgaacccacactgcacatcttgactggcaggggtgattagtttagaaaaa

SEQ ID NO: 145265 - DNA, 405 bp, Homo sapiens
  misc_feature (24)..(24): n is a, c, g, or t
cggtacccgggttactgcactgancggaaactgcactgacaatcaaaccctcaggaaatgctgtaggatcccccttcaaaatgcacgcagaatttgaccacttctcacaatgttaccactatggccccagtggagccaccctcttccctgggtaacgctcagtctcctaaccccgttcctgctgctctaccgcctcctacaggccttcccaacatagccgccagcaggggcctgtaaaaatggaaggcaggccaggtcaccaccctgcccagatccctcacacactcccatccccctctgagtaaaggcaaatccttcccaaggcctaggaagcccaagatgacccgctcacaaccatcactgccactctgacctctttgcccacactggtctccctgctcctcc

SEQ ID NO: 145266 - DNA, 196 bp, Homo sapiens
tctaagaattcacagtaatttctcttgaagcctcttgcctagagatgaatgcctgttgtttggagtagtcctaatgtgttagtgtattgaagcatgccttatagcaacagtatcctgaccctgaaaagctgtgttgtggattgacattatttgtataaatgagctatgttaaataaagaataagggatttacaatc

SEQ ID NO: 145267 - DNA, 338 bp, Homo sapiens
aaaaaaaaaaaataaagcatgtcttaaagcataggtgggtgatccacaatttcaggaatcctaaagcaggaaatcaaaattacattagttgaaggctattttcaaccatattgagttgaattagtagtctatactatgactgaatgacagttgtaacggtgcgtcttcctcttaatgggtccatgagatcttgaattcaggaattttatgacgctttggaaaaaatgacttaaaaaaacagacaatattaaagtcctttatccatcagagaattcaggtcagagaagaaagtaatagctaatagattatatgagatcaacctagaaagaactatgttc

SEQ ID NO: 145268 - DNA, 124 bp, Homo sapiens
aagaagagtttcgaggcagaataatatatatatttagagaaataatggctgaaaatttttcaagtttgatagaaactataagcccacaggtccaagaagcttaataaaaacgcaagcaaaatac

SEQ ID NO: 145269 - DNA, 542 bp, Homo sapiens
actatttataacacagagtgccaggaggagctgcagctagaaagcatacaaatgtttttagggttcagaagaattccggagttctctgcatatttccaccacacaagaggaggattccgattctggcctgacctttattcccttccttattccttgtcttttagccaaaatcacatatccaagagcctggccggtgccagggtgggcctcctcccctcacttagtcaagaaactcagatgctgccacagtcacaccgctgaggcaggacaagctctgggcactggacaaggcacagggatgtggcagtgaacacaggaatcccactcatgctgtggtggcctcctgtggggtcacaggatcactgaaaggaccccctgagggggtggaggaggccctggacccaggcctggcacatggcacatgcatgatcaaagtattaagtagctgttgttactacaaggccatgaaaatagtgcaagtcaggagtatatcagtaaagaacagaggcccatgtttaattcaaaataatgtccaaaaacta

SEQ ID NO: 145270 - DNA, 693 bp, Homo sapiens
cggacggcgtgggtcgacccacgcgtccgggtttttctgcatgcacaacttggggagtttgtacagacattctctgctttgtttcacaacatccttaggagacaagctaaagtgcctgttagcgctatattcattttaaagatagacaactgaagtatagaaaggttaaagagcttgcataattactccaacagccgactgaaacatctcacaaacagcaaaaaaggtttgttaataagatatcatcttcttgcgttctagtcactgggaaatattctttattttgataccagttttgttcagacttcttagattttcagagcactgatacgaagaagataatcacagaaactgtatcagatctaaagcctctttaaatctttccgactatggtaaagtatattttaaaagcagcagtctctcacactggtgctaccagatatggccccataagcatctggctctctgtagttatagaaaaagtcagcagctcgttttgtttgttttttaagcaggagagaaagcttttgccattgtcagattaagtgttgggccttgttgctatttgcaaaataaacagctttatttccttcccactcacccttataacccagggaatacttggcggcaaagagaaagtctctaggagtagctcaacttggtcttgccctttttcttaacattcagaccccc

SEQ ID NO: 145271 - DNA, 237 bp, Homo sapiens
gctttaaatcattccccttcgacagtttagttttaactatactgtatgtacccaagccaaggatgggaggagaagcctcagtaactagaattgttattaaaaccatatatccaactccactggcttttctggaaacctctacctaaaggacgtttaagtcgtctattaaaatatttcagacttgccctgaaggaggcaccaagaagtgccacaactttgcaggctagtgaccacaca

SEQ ID NO: 145272 - DNA, 158 bp, Homo sapiens
ctggggtggggatgagttctgggagggcagcttccttccagggtaccctcagagcccacagggcagagtggcaatccagtctaggtcagaatgttcagtgtcttggtccttgctgtcctccttcctgcgcaaaaggaaacaggatccctgtgtgggcc

SEQ ID NO: 145273 - DNA, 233 bp, Homo sapiens
tcactaagctcaaataacccacaaaagcaggatatgcaaatcatgggtgcaacctggcagcgtggagtgtcatagaaacacattttcttggggacgcagggaatgggtccacgggccatgctcacagctgccactgtcagtggcaaaggaaggtacgtgtgtcacccttattccacccagacattacgaacactccccaagaaggacctttctcaagggagtcagcattcggg

SEQ ID NO: 145274 - DNA, 475 bp, Homo sapiens
gttacttttccttaaaaacagttattattttttctaagtatttcaggccttgcattggagacgagggttaggagaggcggtgtggctgcctcttgtgtggaatggggaggaaggagagaaagcctgcggtgggttgcggggatgcttttcctcgcgacactagcttctccctcccccgcccttgcgcttggttggatccagatgggtgggaagggatggaagttgacgctaaaaatcaccgaagggcaggtaagccggggcggggtgtgacggtgcgggcctcgccacccggcaggtgtgcacccggtcgcttccgcaggtgagcgcagcctttctgctccgtcgggcctggtgtggcagcggcagcgatttaatggtccttaaagcttccgatctcaaaatggaaagactgaagtgtcaagatgacttttcaggtggccctggtgtcgggcaatcaaggttcctcttcgcccct

SEQ ID NO: 145275 - DNA, 820 bp, Homo sapiens
ttatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtccaaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtac

SEQ ID NO: 145276 - DNA, 373 bp, Homo sapiens
aacagctgtgcaggacataaataaagcttttctgacttttatgcacatagtcttaaccataaatgttacatcaattttttttgtattactcatgggagacaagttattcttctaaggatttgtccttttgtttttttaaacctaaggcacatggaactagactgggcattaaagttttgaaagtccttagaattgggcaatttcttgtaatattggggtaactgcaaaaagagggggagtgggtattgagcctggtggttaggctcagagccaagagagaagtttcccagaaactgttggatctattttctaccctcctggaaattccatctcttttcattaaacttgtccatgatatgagctgttgttctcc

SEQ ID NO: 145277 - DNA, 344 bp, Homo sapiens
cattcaggggaccaagaggaggcctgctgtggtcaggacacggaaacaaggtggactgggcaagagacgagatcagagaggtggggagacagatgagtgaatcagagaggaagaaaatgatattccaagcctaggccctgtgtgctttacacatgtatctcacttaatcttcacgaccatcccttactgctgctgtcatgtaaaaggtaccattggtgagtactgggactgaagagtagcccatcacacacacacacacacacacacacacacacccccacatgaaccctactaaagtttgaaaggaattccttcagggcttagactttgtaatagctctctgg

SEQ ID NO: 145278 - DNA, 1000 bp, Homo sapiens
aggcaaagattttttagctatgacatcaaaagcataatccataaaagaaaaaaaattgatgaattggactttatcaaaattaagagcttctgctttttgaaacacactgttaatggaatgaaaagtcaagccacaggctggaaaaaacatttgcatatcacatatctgataaaggatttatatctaaatatataaataactcccaaactcaataaaacagctcaataagaaaaatggggaaaatattttaatggacacttcatcaagagagagatatggatggtaaataagcacatgaaaacatgctcaggaaaatgcaaattaaaatcacaatgagatgctactacatatctttagaatatttaacattaaaaagatttacagtatcaagtattggttaggatattgaagaattggaattcttatatgttgctggaatgaccactttggaaaacagtttcttaaagagttcaacaaaaaatataactcagtaattctgttcctagtggaatgaaaacaggtgttcatacaaagacttgaacaggaatgtccagagcagctttattgtaatagccccaaactagaaacaacccaaatatctatcaacaggggaacagatacacagatttttgacatattcatataatgaaatacttctcagcattaaaaggaataaactacttatacatactaaaacataaatgaatctcaaaataactacagagtgaaatataccagacagaaagggagtatatagtatatgattccatatatagatatacgattctagaaaatgcaaatcaatttataatgacagaaagaagttgtggttgcctgggtaggcagggattggattgggagcttacaaggaacacaaagaaactttggggtgatagacatttttactatcttgattgtggtgatagtttcaacttattgtatacttcaaatatagtttatgtaaattatacctcaataaagctattgttaaaaatctgct

SEQ ID NO: 145279 - DNA, 211 bp, Homo sapiens
gtttccccacagagaatggctgattgcctcacctccttaacgtctttgcttaaatgtcacctttttaatgaagtcttatccttcctttctttaaaattgtattgtcagttcccatccctcatgcttatccttgcctgctctattttctttttcataggacttaacacttttataatatatttatttgttacatttattgcctattggttct

SEQ ID NO: 145280 - DNA, 580 bp, Homo sapiens
cgtctcccttgctatgtggctttgggtagttttcctacttttttaaagcctcagtttcctcttctgtaaaatgaggccaataatattattcccccacaattgcagtatgtggaactgcagcacaacgcttggtgcataatagtgaggtaggaagtgggactcgactccagaggcggggctcgggcaccggaccacattgaggactagctaaaacagaaccagggcagaagcagctttccaatcagacacgcttaccagtgtgacatgtcggtttaccattgattgccatggtaacacctgggagttactgtccctttcccattgattgccatggtaacacctgggagttactgtccctttccatggcaatgacccaatgacccaaaagttactaccctttccctagagatttctgcataaactgccccttagtctacatgttattaaaagtgggtataaatgtgactacaaaactgccctgagctgccactctctgcctgtgggatagccctgctctgctggggctgtcacggagctggaacactgccacttcaataaagctgttttcttccatctcagc

SEQ ID NO: 145281 - DNA, 822 bp, Homo sapiens
ctgcctacatgctaagatttaagtaatttcactgttaatcggtgctgtttctaataaaaatgaaagattacattcacaatagtaatttttcaactttggaaatggctttgctacagaagatggaaattacagaacagtgtggaattttgtcacagtccatttatttcaatactctgagcactcctggctaacaatctaacctcaagggttttcagaatttgcagcagaagtcggtgttggcagtgcaggtgccttccttaggacattgtcggagacacatgcaaatgtctctgctggcagccaggctccagagaccctgacctggtgcaggcaggtgccgctgcagcgggtcagttcagagatgcatgcaaatgtctctgctggcagccaggctccagagaccctgacctgatgccggcaggtgctgccggcagcaggtcagttggtttaacacccagttgtgcattaacgggtgggctgtaaatttacatggtcgatcagagagacctctgtccacttgctgttgtcagcagctactctgtttaccacttgtcaccagttttctccaaccaacataatgtcccttttctaatggcaaagaataagcagattaaacccagacatgtaggctgattacttagagaaaccagcctccatcatcatacatcaagatcgtatctatccgcttatcagtacatctgtgtgtatcccgttatgtagggaatcttgaacactcacacactccacactcacacaccacacttacacacacacactcatgttctctcacagactcacattttcttacacactcacacagtc

SEQ ID NO: 145282 - DNA, 284 bp, Homo sapiens
gtggtgatcagggcgtagcttgtgaaggggttgggggtgtgttgagcacactggatcgtattgaattgtgtttcctaagtgaccgtgctagctcaggctgcagtgacaaagcaccacagactggggtcttattcctgggggctggcatttgccatgaaggtgtgggcagggctggttcctcccgagccctctctcctgggcctgcaggtgccgtctttccgtcttttccctgtgccttcccggggccatcctgcgtgtgtctgtgtcctcggctctcctggaga

SEQ ID NO: 145283 - DNA, 519 bp, Homo sapiens
atggggtttcgccatgttgcccaggctggtttcgaactcctgagctcaggcagtccgcctgcctcagcctcccaaagtgctgggattacaggcgtgagccaccacgcccggctgttactgtttttcaactgtcctgatttagaacagtttcttacctgttctttcttttgtgatgttgatatttttgaggaatacagaccagtgattttagagtgttaccctcagtgtgcgcctggtgtttcctcatattagatacagattagatgtctcaggcaggaatgatgctgttttgaattttgatgaagtctaattattaaaagtttcttttatggattgtgcatttgttaccaaatttcagaactcttcctagtgccctggttctttggagtggagaatggcatttggaaacctatgtctgaatgttaggtgtgcttggtagtgttagtgtgtgggcgctcctcggctttcagtggacagagccagagaatatgtgcatgtcctgagcctcctgttcgtcct

SEQ ID NO: 145284 - DNA, 217 bp, Homo sapiens
gagcctgggaggtcgaagctgcagtgagtggtgaaagtttgaaaatcactgtcagagcccaaagccctggtcttgttattgtatagtcagcgtcagagacaactgtgaagttttcttcactctggatgcctaggtgttaatctgggattgaggacttctgcctctaaaaacaatgattccagctttggatataagatccagttgtttatgaccccta

SEQ ID NO: 145285 - DNA, 374 bp, Homo sapiens
ctccagcaaccctactccaattgtgaccatcaaaactgttcacagacactgcctggcgtcccctagtgggggagtaaaatcgcccatggcggagaagccctgctccagagggaatgttcatacccccactcatccaggacaaggaggggcttctggtgttactgggaagggacacaacctggccttggggttggctggaggtggctgcatctctgcagtggcactatttttgggtctgtctgccgagctcctctggatgtgagccctggcccttcctttccagttgcttaagacccatgagtggggtgggtgcgagggacgtcagctccatggactcagcacctggaactgcgccagggggagtatgtgtccaa

SEQ ID NO: 145286 - DNA, 949 bp, Homo sapiens
tgtgtgtgtgtatgtgcgtgtgtgcgtgcgcacgcgcatgtttagcaattcttagggttaagacaattcatttgataggcctgggttgatgaactcaacggaagttgatgtgaataaaaatgaaaatgagggcttggcgcggtggtccacgcctgtaatcccagcactttgggaggccgaggttgggagttcaagaccagcctgccaacatggtgaaaccctgtctctactaaaaaaaatacaaaaattagctgggcctcgtgggaggcacctgtaatcccagctacttgggaggctgaagcagaattgcttgggcctggaaagcggaggttgcaatgagctgagattgcaccattacactccagcttgggtgacagagcaagactgtgtctcaaaaaacaaaaaaaaaaagaaagtgagattgagttcaaagggaagtcattgcaaggaggcagtgccagtactaaacttaatacctccgtcctgtgtagacacatccactttgttgaatggaaagctggcctcttactacccttcaactactttattttttctgatgacttgtaataaataccgtctacctggaagtcagtgtgttacaattagaatgtgaggattagaagaaactaatataggtaggactaggaaaaaataataggttagagtgataaagtaaaaattttaagaatacatgcaatagtataaaaatcaaaagatataaaaagattatgtatcaaatataaagctcttatcctctagccatctgattcccttccttgagagtaactagaatagtttcttatgtcttatttatcttttaggagtagcctatgcatttacaagtgtatacatacttttttgtctttccttgaataaaccaataaaatacttatatccttttgaaaatatacaaaaggtagcagcatacaatacacaccatttaccattt

SEQ ID NO: 145287 - DNA, 406 bp, Homo sapiens
ctgtactcacctattttggaaccactgtttcagaaagcaaaacagcagataaagagagacaaatgtacttgttattaaagacactttgagttgagttttctgttacttgcagcctaatacatccaactgatagggtggagttaagaataccttcaaagcataattgtaagggcctgaggagataaaatagatagaaatgcactgtaaaatgttaagtagcatataaaacgaatatgtttttattattgagtgcttaattctctgtcttccacatcttcataagtgtcatttttttcaagatctttaaaacaaaacaatttccaaatataattaatattacctcaacataagtggagaatgataagatagcaaatagaaaattgatcctgggttttctgtgataact

SEQ ID NO: 145288 - DNA, 506 bp, Homo sapiens
gctaaagccctcatcatccctctcctgttctgcaatggacaacggagtaaggccagcagaagaggtgaaagcaccgatgagcagaatggaagcaagaaagagcaaagaccaaacgggcagagagggggcaggaggaggacaaaggctgggcagatgtgctcaacaccagcgcctcccccaggccctctgcagggacagctggatgacttgaactctgggctctctagctggcgcagtcccaccctcttaatgccaatccctttttgtctccatgaaacactatgagatgattggccagcatggggttgacccgtgccatggacaaggatgctgatttgggacagtgtcactattttccaaaatgccatagcaaagtgtgtcccaggaagaggctgcacaggtataccagcccaggggtaactaacaccacttatgtagagctggctgcaagggctggccggcaggaatcacatctacacggagagaaaaattagttgatcttcgga

SEQ ID NO: 145289 - DNA, 245 bp, Homo sapiens
ttgctgtgtatccttggaaggtgctagggcctgtaaaaggctggtgaagcagtgctcatgttttctctacttggttaaaataaagaaggagtacgcccacgtgtgctggtacgcccatctggatgtgaccttttgttcagttgagctggtaattgcaagtccggatcttgacctcagcctactcattcctaacccaagtccagttcctctccatctgtggggtggtccatgtgatcctggcatag

SEQ ID NO: 145290 - DNA, 410 bp, Homo sapiens
aactattatatattagggttttgaacttctatgctaacataggtacataatattctttttttctgtgaaaaagttctcagaaatgtgcagaagaatacttttacccatttgcttttactttatatgtcagacaaaaatctaaataaaaagagtctcacagtgttgcccaggccggatccagtgaagtgatgtgatcatagctcactgcagcctcaaattcctgggctcaaatgatcttcctgctttacccttccaagtaggtagggctacaggcacacaccaccatgtccaactaatttatgtatttttttttttttggtagagatggggtctccctatgttaccaagactggtcttgaactcctggcctcaagtaatcctcttgctttggctttccaaagtgttggcat

SEQ ID NO: 145291 - DNA, 517 bp, Homo sapiens
cttagtagaacttctttcctatacacatgggcaaacaatgctgttccacagctcctgtgtctccatgtcctcattttaaatactagtggacatcacctgtagtcctctgtcctacttgcagttctcaaggccaaaaatctcactgggcctggtctaatcagctgtggagggcaggttgttcttgttcttagccctaaataggtgacagtagcctttagtgaaggtggccagtggggttgtgaggcacgcccggcggggcctgctacagtaggagccatagaggcaaatctgatacattagcgtctcttgtgtctggccaaggcgttcctcattgtaaaatgcgatgctttctatagcatgtactcttgttcatacattaaaaacaacactgttggccaacgattgtttttttcagtggtaggggtggattttccttcgttcattccgtctttcgtctgttctccttacagccttgagcacagagttgttacttgactgtactgttttgggggtgtag

SEQ ID NO: 145292 - DNA, 342 bp, Homo sapiens
cacattccagaagagggactcagaggtcgttggaagtgtatgccaggaaccactgagcaaggcccttgtctctctttgtgggccttcttcagacacttccccctcatacacgggatctgggatcattaaacatctcattgtcctttggattcaccagcttttgaaagtgctgctcctgctggaaaagccctcgcttccactcttcacctagaaaacttctattcattcattaaggcctgacgtcacgttttctgggaagtcttccttgcttatcccctgacaaatttgattttttgtcaaatttgtattatttatatctttgtgttattaaatttccatcac

SEQ ID NO: 145293 - DNA, 498 bp, Homo sapiens
gttgcttcttatagataagcagagagagtggtttcttgagatagaatctactccttgtgaagatgctgtgaacactgttgaaatggcaacaaaggatttgaatattccataaacttagttgataaagcagaggcagggtttgagaaaactggattgactccaattttgaaaggtccactgtgggtaaaatattatcaaccagcatcacacgccatcaagaactctttcatgaaaacaagtcaatcaatatagcaaatgtcattgttgtcttattttaaggaattgccacagccaccccaaccttcagcagccaccatccagatcagtcagcagccattaacaaggagcaaagaccctccaactagcaaagaatatgacttgctaaaggcctagatgattgatagctttttttttttttgagaccgagttttgctcttccagcctgggcaacaagagtgaaacaccatctaaaaataaaaataaatgaataaaaaaaaa

SEQ ID NO: 145294 - DNA, 398 bp, Homo sapiens
aaaagcaaaccctgaccaaaacactccctcccatatgcaagtatgtttaaatatttgtatgagaatggagaaagattgcagagactgggaggatggattagaggcgggagggagaaagggaaaagaagaagaacactatagcaaaatggaaactaagattataatgtgcttgtgtaccagatggaacttctaataagctcccagcctattagagtacagcgctgaaaactagacttcaataattaaagtccttgctctgccacttaccagctggggattttatcagcctcagtttatcatacataaaatgcagataataatggtatctatattatgcatttgatctgaggattaatggagtgaatatataaagaacagtgcttaatacatagtaaata

SEQ ID NO: 145295 - DNA, 190 bp, Homo sapiens
gttggggtcaggatatcttagacttattaaatccctctttattttcactaatgatcaccctttgagaatcaagtactggtgagcttaaaagcattatcaaatgaacccttttaatgagaactaagcagcctgttcatctgaacattaaatgattcaaaagtacagatatatagattacaaaaaatccttc

SEQ ID NO: 145296 - DNA, 494 bp, Homo sapiens
tcactgagcacctgccctgtgcagagcactgtgttccctgtttaggagaattagaaagatggcaagattttgttcctctccttaagccttacagtctagtgaagataatctgccttgagtagggaagaaaatatgttcctcttttaggtattttaagcagttgtttttcctctcacttcagttctgaagattttaagattaaaaaccataaatggtttttgttgattaaaaggacaggaaggaaactccatcataacttacaggttatgatgatattgcattatgataactctgtgaccagtgataccatcttgagtttagagctgacccagagaagttaaactggcctaaggtcacccagctggtaaactgaaagagaaggcatctgaatctaggtaccgctgattaaaacccatgcttcttctgtaatactgtaatcccccttaaaggacttttgcagttattgacattttctcccagaaaaaaaaacttac

SEQ ID NO: 145297 - DNA, 505 bp, Homo sapiens
ggaattccacccctacccagcagtactgaagcatcccccaaccctttctccttgggtagtgtcagaggaggcttagtggagcgtcagggctttaactgtcacccagttgtaacaaagccctcctatcatgatgttagtaggacggactatttgggaagcaagaactcccaccctgcccaatagatacaaggacccctctgcctattctgggtgtcaacggaggccatgtggcaggggctggatttccaccttcacctggcagtggcaaggtggagtgtctccttcctctgctggagtggtatccagaaagccagctaaaacgatacttaaaatccagggtctcataattcagaaatgtccaagtgttcattaagaatcattgtttgctgggcacggtggctcacgcctgtagtcccagcactttgggaggctgagccgggtagataacctgaggtcaaaagttcgagaccagcctgaccaatatggtgaaacctcatctttacta

SEQ ID NO: 145298 - DNA, 248 bp, Homo sapiens
ataatttatccacaggctcactgatacattgacatgctctctaaaatagagtcttatttataataatattctacaatatcaaagtaacattttgcctcttttcatttggcacccatatctttctctgtactttttaaaatctttttgttcatgcattgccattgtcatttaaaaatgtgatggattttttattaatgtccttgcctgtaggttaagacgcggtaccagagctcgcaattcgataatca

SEQ ID NO: 145299 - DNA, 488 bp, Homo sapiens
agctacctattccaagtcttcaggtgctccctataaagagaggacactcgattcttcctgaattttttattttgccttcgctttctcacactaagttatgcttatgcttcatggtcatatcaagctcagtttgggagatggggagataatatttcttctgtgagaaagtgttttgaaatgtcacaacaatttttagaaacagagatgggttttgctttggtctttaagtcttcctagtcttttgatcccactgttttgtccattagtcagcttctattatttcattaccaatattcatcttctccagaagcatttttcaatcagtaaatacatttgaaaagcataagaacctctttttaaaaatgacttatccagtggctcacgcctgtaatcgcagcactttggaggctgagccgggtggatcatgaggtcaggagatcgagaccatcctggttaacacggtgaaaccccgtctctactaaaaatac

SEQ ID NO: 145300 - DNA, 152 bp, Homo sapiens
aacgggaatgtttagcaaggcctgttcatttagatccctcaaggtgcccctctgccttcagagatgaagatgtttgtttgctccaggtggtgtgaggacaccttcctcatgaacatctcatgacctgcgtcaggggagaaggaaggggaagg

SEQ ID NO: 145301 - DNA, 165 bp, Homo sapiens
ctctttctctttctttatctctctctctttccctccttcccttccttccttgtctcttctttctttccctctctccctcccactctttctttctttccctccctcctttccttccttcctctttccttctcttctcttttctcttcctcccttccttttccttcg

SEQ ID NO: 145302 - DNA, 757 bp, Homo sapiens
ctctcctcgcattgcccaagatgctgaaaggaaagaaggccaaggggaagaaggtggctcctgtcgtgaagaagcaggaggccaaggaagtggtgaatcccctgtttgagaaaaggcctaagaattttggcattggacaggacatccagcccaaaagagacctcacctgctttgtgaaatggccctgctatatcaggttgcaaaggcagggagccatcctctacaagtggctgaaagtgcctcctgcgattaaccagttcacccaggccctggaccgccaaacagctactcagctgcttaagctggcccacaagtacagaccagaaacaaagcaagagaagaagcagaggccgttggcccaggctgagaagagagctgccggcaaaggggacgtccccactaagagaccacctgtccttcgagcaggagttaacaccatcaccactttggtggagaataagaaagctcagctggtggtgattgcacatgacgtggatcccattgagctggtcgtcttcttgcctgccctgtgtcataaaatgggggtcccttactgcattatcaaggagaaggcaagactgggacgtctagtccacaggaagacctgcaccactgtcgccttcacacaggttaactcagaagacaagggcgctttggctaagctggtggaagctatcaggaccgattacaatgacagatacaatgacatccactgtcactggggcggcaatgtcctgggtcccaagtctgtggctca

SEQ ID NO: 145303 - DNA, 319 bp, Homo sapiens
ttccatattaatttttactaggcaacaataaactctaaaggtataaagttacctgtgtaacaacagcttcctcctcaaaggtttctataagggggccaattaataccaactctagaacttatttgggttaacaacattgaaactgcactgaaaccacccactcatttctctgaatccgaagactaatccaaaggtgaccacacgcaaccactgctgactcaagcaagtgtcttagaaaggaaagacactatatccccatatatattcttatgaggtatttatttctcactttaagtggggaagattaacacactgaaac

SEQ ID NO: 145304 - DNA, 249 bp, Homo sapiens
cacgtgatggcacaaccacacagcgggggcacacgtgatggcacagccacacagcgggggcacatgtgtgatggcacagccacaaagtgggggcacgtatgatggcacaaccacacagcggggtcacacgtgtgatggtacagcacacggtgggggcacacgcatgacagtacagtcacacgtcagggcacacacgtgacagtacagccacacagcaagcacacacaaacgtgatggtacagccacatg

SEQ ID NO: 145305 - DNA, 432 bp, Homo sapiens
agctgggactgggaatgactgggtcacaggtgagggttattctggagcactcacagggaatactcacaaggaatgctcacgggctgcaatggctcagtaatcttgggcttgggtttaggagaagttggctcttaggaggcccaatctagagaatgaagcttccaagcaggaaaggcagggcagcacacaggtgactatcagttcaaactagagccctgcccatgggcagggtacagggactcacggaacaggagagctagagtaggggagaagaacacttgggggtcagacccaataagtgaaacgatgggcttgggctgcccaccatcactataggctaagagaaggccaccacgaagagacatcccagtgccaagggctcccccagacacaggtttatagcagcaaggctagtgcagcccccactatgaa

SEQ ID NO: 145306 - DNA, 332 bp, Homo sapiens
ctcgaactcctagtctcaagtgatctgcccacctcggcttcccaaagtgctgggattgtaggcataacattataggcatgagccaccacgccctttctttctcttttgtgacagggtctcactctgttgcccaggctggtctcaaattactgggactcaagggagcctcctgcctgagtctcccaagtagctaggattataggcatgcacccccacacccagctccttgatctttatgtatctatgaagccctccttgtaaactgaaggggcagccgtgttaagaacccctggaggaaatataaagaagtctgggctctggagtcagacact

SEQ ID NO: 145307 - DNA, 1470 bp, Homo sapiens
aatctaaactgcaaaaagcggtggtaagtttttgccatcacaatcctgtcttattttgatgtagtcagattgactggttggagtgttatttaggatcataaaggtaagtgggaaatgggtatgggaaactaagaagtcttggaaattagtgttgaataactttgaagcccttttatttgctggaatccattgggaggtttactttgctgcaataaactaatcaaaaaagtgatcggtggagcttgtgattggttgttgcaaattctttaaattattctaagtgcttggctacctagatgatagcagaagctagatcagatgaacctttttacctgagtattttaggacactagaccaacatttttaaaaaggactgtgaaatgtaaaacttaattttgccgtgtaaggacttttgaaaagacaactactatcttcccttaccattttattttaaaagtgactcccaatatttaggaaggacttaaactcagagtaatagagtaatttaacttgaataactttaagttaatgaaaaaattactacactggtattttctcatttactctgcatcactgaaaaatttatcgagttaattagtccatagactggcatttgggaagtgctataatacagttgttgaaagaactagtgtacttacaaagctgatattgactagtagattaataagccacatgtacactgttactgagatttaagacgtttttattgtgttaaattgtaagtgccatgtattaaaggggacactaagaactatagtgtctataaggaatgataaaaggctttgatagtctagagagtgagatgtggttgaagaaattggtgagtcttatttttgagaaggtaagtttaaagatagggagttttcttcagattgagtgaccttcatatatgagaaagaatagtatttgttctgtgttgttctgggtagaaaaattataagaaatgggagcttctggttttacgttgaatattctctaatgagaattctttcctttccttttccttcctccctttcccctcccttttctctcccttcccctttcaaataaggaataaaactataaagaacaaaaagcaacaaaaaaaatataaaaataagaacataaaaaaagaagaaaaaaaaaaaaaaaaaaaaaaaaaaaaaaaaaaaaaaaaaaaaaaaaaaaaaaaaaaaaaaaaaaaaaagaaagaaaagaaaaaaaaaaaaagaaaaaagaaaaaataagaggaggaagagaaggggaagaagagaagaaagagcgaaaggacggagggaaagacaaatgaagagggaaagaggaagggagagagaagaaggagacgaaaaagcgcaagaggagaaggggaggcagaagagaaggagacagcagcggcggggggaaacagggggaagaggaaagggagcagagaagggacaggagagcgaagagcaaagggtagggagacca

SEQ ID NO: 145308 - DNA, 226 bp, Homo sapiens
tggaagaatgattcattcatttcaaatttggcaacttaaacagcagcaaattataattttcccatcataacccaaagtcagtatattggcttctcagcctttgagggcccttttgtaccttcttttgctttgacaacagcaccctctgctgggttttgtaatccatcacctctaatgggatcgacccaaatcgcaaacggaggcctccctgcaacgttgcacacag

SEQ ID NO: 145309 - DNA, 447 bp, Homo sapiens
agccggccccgcccacgtagattttgctgtcccctttacctgcagtcccctcgtctcttgcttacccatcttccacacacttagccttcaacatcttaatctgtcctgtgtccttttccaggccatatgtgtgtgcccccagtgagagttcatcttaccgctcaattgttagtctttgcaagttcctctatcagagcacttatctcagtgtgccttatggaataattttgtcataactacctcctacctccccctaccactgcctgataaattatgagcttatcaaggcagggatcagcctttatttctctctctactgtcagcacagtgacatctgcatgggagttttgtaatgatggctttcttcttgaactcgggttagtagaaaggaaggaaaaatcactatatggaaacaaatgagatggatgtttctgagtattacaaatc

SEQ ID NO: 145310 - DNA, 997 bp, Homo sapiens
  misc_feature (969)..(969): n is a, c, g, or t
aaaggaggagatattttgaatagatgcaacatcttgcttctctttttattctgacaaatttttctgccctttattgacaattaactacagagttactaaaattttatttttgctttgatagctatgctttttttttaaacctttgttttaaaaatagatcatcttttttttttcttgtccttaaagaactctgtgatatttataatggttttgatcttatgagccaggtaactatttggtaatcattccttatgaagaaatttaattttcatttcacagagttttcattagcaacttccttaaatatatcttcatgagtgtaatgaatgtggttcagtaccttctgagctatctggatattagtagagtggcctggcatgttgataaatggagtgacctgtcagagtaaacctcctcaatttcttgtaaacatgaattattgttatttaattgcaacttcatttcaaaagaaaggaaagatgccacgtacatctaacaaataaaaataagtcactagaacgaagagtacaggaaagatgaggaaaagagaaaatttcttgtgtgattatcatgtctaaagatccattcccttagcacctaatctatttccaagcaattcacaattcttgagagaattaataaactttttggctctcagggtaccttagagagtatttttcaaactttttttttactttaactcagtaaatacagatggccttccatatccattggttctgtattcatgtattcaaccaaccgcagatttaaaatatttggaaaaaaaattgcatctgtactgaacatgtactgacttttttcttgtcgtgatcccctaaacaatacagaataacaattatttgcacagtgtttatattgtattaggtattagaagtaatctaggatttaaagtataggagaggatgtgtataggttatatgcaaatactataccattttatatcaaggncatgagtatgagtatctgtggatttggg

SEQ ID NO: 145311 - DNA, 343 bp, Homo sapiens
cgcctcggcctcccaaagtgctgggattacaggcatgagccaccgcacctggccaggtacacttctttatatgacctgtcctagtccccttggacattcaggtttggagccctgacacttggctacataggggaagagataaagctgcaaatgtgctgaggggaggtatttcttcatcctggtacctgataaggactttgccgagcttttgagccagcacttgtggaaggagtaggatttcaacatgataaggaagaggggctttcaggtgaaggtcagaagatgtgaggcagctggaaggtcaggcagggacagtggaattgttgaaacctcccatggaatt

SEQ ID NO: 145312 - DNA, 331 bp, Homo sapiens
ctccaccacatcaggctgcccacaggcacagctctttcctgcctggggggcttgaagaagttacttaacttccctatgcatcagtttcctcatagtaaaaaagacaattactgtacctatctagtaaggttactgagaggatgaaataaattaacttaaaggaagctctgtatgggtttaccatgattattagttgtatatccaacttcctcagcctggaaggaagggtcttctcccttttctctgccttgcgaactcccattccttcttaaaaatatatcccgagtgtcacctcctccagggagccttcccagctctctctccccactcc

SEQ ID NO: 145313 - DNA, 276 bp, Homo sapiens
gtttgggtcaaaaaaccactttattcacagcaagattggagttactcatgattccagtgacataatatcccgtgccctacatgggctcaatttttctgagatgctgctcacagcccaggatgctgggttctctgaaagactgtcttgaaattatcaatgagtgtgatgcttagggaacacccccaacatatttcattatttagaaagaaagaatttcctgagtagttaggctccctaacatcttcaataaaatgaccacattctgttctttcttgt

SEQ ID NO: 145314 - DNA, 839 bp, Homo sapiens
ctactgcacccgcccccacgcatgtctttaaggtagcatttgaccgtggttctcattttgcgtgtttatatattatctctctctatctaaaaatagtgaacagtgaagtgaagtagaactaactctgtgccaggcagcattctaagtgccgataaaccttacaacaatgtcgtgagttagatatcaccatcctcattttacagttgaagaaactgaggcacagagacataaataatgtacccacatcacgtagtaagtacaaaagccagaactcagacccaggcagcctggccccagagtctgttaaccctatactcctctggttctcagaaatgaagatacatgtcgattaagtttatccacttaaaattgctgcttggtgttgcactgaatgccacaatctacccattcctctaattacagcattacaattctgtaatacgtattcttgtgtaggtttctttgtgcaaatgtgaggaaatttttccaggttatatatctaaaagtagaatgactaggccgaaggatagcctgtagtcagcatgactaggttttgccaagttgctctccagtgtcccagtttgtagtcccaccagcagtgtaggaaaattcccactttcccagtgccagctcttggtattgttgactttaaaaatttttgaaagataaagcagtatttcgttgtttggacttgcatttctattttacaaaaataccatgaggtttaaatggcaacagtaaacttgcaagatgagttattaataggatgatcatataactggtcacccaaaccagaacatttgtgggagaaagggtgttccagtcccacagagtacagg

SEQ ID NO: 145315 - DNA, 659 bp, Homo sapiens
gtttgatatgaatttgttaattgtttatactcaggtaataagtgttacctcagtcatagcatttaatattttatctgactgtccctaaggctgaaaaccaacgaatatactaacacgaagataatactagattatatttgtgtaatattttagagttttcaaacactttaattttatttatttatttttttgagacagagactcgctctgtagcccgggctggagtgcagtggcgccatctcggctcactgcaacctccgcttccctggttcaagcgattctcgtatctcagcctcccaagtagctgggactacaggcgccggcccgccaccatgtcctgctaattttttttttttttcttgagacacagtcttgctctgtcgccaaggctggtgtgcagtggcgtgatcttggctgactgcaacctctgcctcccaggttgaagtgattcttgtgcttcagcctccccagtagctgggattacatgggattacaggtgcacaccacaaaggccggctagtttttctgtttttgagatggagtcttgctctgtcacccaggctggagtgcagtggcatgatcatggctcactgcaacctccacctcatgggttcaagcgattctcctgcctcagcctccagagtaactgggattacagg

SEQ ID NO: 145316 - DNA, 217 bp, Homo sapiens
gatagtcaactacaaattacttaaaaaaaaaatccagaactatgcatacgtcggcaattgtcccaaaaataagaatagaaaacataaggaagggaagaaggcttacgaaaccaattagcaagtgaaaggaatgatgtgatttggatagatctttaaggataatggcagggaatcatcttgtctagaagtttcctgtcattttttttctctgacgaag

SEQ ID NO: 145317 - DNA, 398 bp, Homo sapiens
gaggcagcaatgagctagcagtgagctatgactgcaccactgcactttagtctgggcaagagagcaagatcctgcctctaaaacaaaattttaaaatgagaaataaaactggcattttgacatatcagctgtgaggtgcatcacaagaaatcctgacagtgttttttcttgtgagtgacatacttttaaaataaaatcacggccaggcagagtggctcacacctgtaattccaacactctgggaggctgagtcaagtggatcacttgaggtcaggagctcgagacctgggcagcacaacaacaccctgtctctactaagacttccaaaattagccaggcatggtggcgcacgcctgtagtcccagctattcaggtggctaaggaagaagaatcacttg

SEQ ID NO: 145318 - DNA, 309 bp, Homo sapiens
caccactgcactccagcccacgtgacaagatgatgagaccctgtctcccctccaccaaaaaaaaaaagaaagaaagagaaaaagaaagaaagaatgaaagaagaaagaaaaaagaaagaagaaagaaaggaagaaagaaagaaagaaaaagaaagaaagaaagaaggaaagaaagaaaaaggatgttcagtgtaccaggagcttctctcaggtacccagagaatgcatcaccggctcctccatgaactctgtctgcactatgtccatctgctggagagctcctcacccaatacctggcccagaagctgc

SEQ ID NO: 145319 - DNA, 350 bp, Homo sapiens
aagtactcctcacatgcagaaagagattaatgattagaagacaacacacggaaatgtgacaattattaagtccgtgaaccgattataatgttagtcaagtatgactcatgggattgtatctggctttgggtttgggtgttagcaataatcatttggaatagctcctttagcaaaccagtcacctcattttgctctttctttacctcaaaggagaggaacaatgaaagaggagccttgcctggagtgcatgagcacactcaagccaatgtgtgatcaatggagaggtgggggtgtagggcactaactgaggctctggacaaagggaaaaagtccttcgtgtcagaaatctg

SEQ ID NO: 145320 - DNA, 553 bp, Homo sapiens
tgccacggaaatcttccgggcagctagagttagtccggggccctctccttaagatgcgtcagtggacctaggacgggggaaagtaaaggcttattataaggtttcgattctgcttcgttcatgtactttgtatgtgaaaccttttttcatattcttagtcttccttctttgaaatggctatatggctttctgtcaggattctggaatagtgggctcaaagtgtgtggtggcatcgataaacaccggtgtttatcgatgccacttcctgagatcattttgaatgttctaattaaaaagtgcaaagtataattttttgtcataaattatacatgctatgctattatatatgctaagccaaacctagcaacaaggctgagtgaagatgtggctcctgggtcatatgctaggctttctttcggcaaatggacttgctctccctcagttatgttacatacctactcagatcaggtctcagcaaatgtacaaattactatgtcatcagccatctggatcacttgggaatagtcacattggtgaacgctgtaagtcatat

SEQ ID NO: 145321 - DNA, 370 bp, Homo sapiens
tacgagagagaggaagagccagaataagaatcagtggctcatgtgcttaagactcacatgggaagcttatttaaaatatacacttctgggccaggcacggtggatcacacctgcaatcccagcactttgggaggctgaggcaggcggatcgcttgagcccaggagttcaagaccagcctgggcaacgtgacgaaaccccatttctaccaaaaaaaaaaaacagaaaaattagccaggcatggtggtatccgcctgtagtcccagttatttaggagactgaggtgggaggatggcttgagtccagaaggtaaaggttgcagtgagctgagactgcacgactacactccagcccaggcaacagagtcagact

SEQ ID NO: 145322 - DNA, 838 bp, Homo sapiens
acaattacaaatatattttttatttcagattgtatatattcctaccagatggagataattacagctttaaaaatttttattttttcattttatttcagacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggatggaaatatggaaaaaaaaatgcgtcgtacgaacatgtacagacttttttctgtccttattccttacacaatatagtacaataactattgcatgacatttacatcggatattatgagtgatctagagtgatatgaagtatatgggaggatgtgcaaaggtgatgtgcaaatactatgtcattttatatcagggacttgagtatccttgttaccctcaggagatcctgaaaccagtcccccatggatactgagggctgacgtatagtcctatcctcacggaactttcattctaatgggggaagactgactataaacaaaatatatgtaataggtggggtaagtaccgggagaagtaacaaacggggcaaagtgagttatacagctccattcttagaaaccttggagtacttttcttagtttatactcgtggtggtttcctttgtctcctttattacatgggactctgacatgtgccc

SEQ ID NO: 145323 - DNA, 252 bp, Homo sapiens
agaagagtcaaagcggaccacacttgatgaggaagcaatgaagggaatcaaagagacgaaggtatcccggtttccagactatggttaggtagagaatatatagcagagctggatgaagattcttggcatattagagttatttttagactttcagatagaagttccacaaacaggctgggtgcagtggctcatgcctgtaatcccagcactctgggaggccaaggcagacggattacctgaggccaggagttc

SEQ ID NO: 145324 - DNA, 263 bp, Homo sapiens
atgaacatactgccaattcttgttacaactacaggtaagttatccatagttactcaatttctcttcttctatattgtccgcaaatagtagaaataatcctcaatgggatataagggattaaacatggcatgaatttgtgtgcgtctatgtgcctttgacgaagaatcaaattttaaaatatttgaagagatttattctgagccaaaaatgagtgaccaatggtccgtggcacagccctcaggagatcctgagactctgtgcct

SEQ ID NO: 145325 - DNA, 321 bp, Homo sapiens
ctgatgcccatccatccatgccagccttccacgagtcccgtgtacctgcgggtgctcagtgtgcacatatttatgtgtacgtcctgccccctctgtgggtgtgcatgcgtgcctgggcacgctctgctgtgtgtagcacaggcttgaagcaagcagcacctctgtgtgtgggcatacgtgcagaggaggatgtgctgctgccggctggagcctctccagcattaagaggctactgagaatgcgtgtatgttgcaggtgtatgtgtgtgtgtatggaaatggttgcaatgcagagctcagaaggagaagggccattaaagaa

SEQ ID NO: 145326 - DNA, 313 bp, Homo sapiens
aaaaatcttcaaatgcaattcagttttatgttgaagaaattttcctttcagttgaactgaataaggtgacaatctgtcccgtttgccaattatttgtgattttaagtttcgcctcaccttcagtcttatttatggcttttcagctattcattgttgccaaaataaatacaaagaaaaattttatcctaacttaatcaattttattactaacaatacttgaaaaataattagaaagttcattttaatgcaaaggctaagaagaagcattatctatttgttctttcctatacttcaaatattttctctccatatc

SEQ ID NO: 145327 - DNA, 209 bp, Homo sapiens
cacaggtaagtcgtcgtagatggtagtgttggtagcaacatgacaggtaaatcacatccaaatacagaataaatatctcttctgaaaaggacaaattactaacctctctaggatgaaaagggtcactggagtccatcccttatgaggtagatggctcaactggaggagtgtaccatatagggacacttagcagtgagaccaccagctca

SEQ ID NO: 145328 - DNA, 149 bp, Homo sapiens
cttatgcttacactagtatgcaagaagtgagtaggtgcttttaaaatcagaattctttggtcagttattggtgtgtggtggtgtttttactgactttttcagagaggtgtagcaggtacagttctaatcgtgcatatttcgaaactaag

SEQ ID NO: 145329 - DNA, 764 bp, Homo sapiens
ctttgcttttcttgagggagtataaaatagtctcccttctcccccaactaaaaatctgaatgacactggcactttctagtcttcttatgccaagtcaacttcccttatgattgttcactttgcactttctctctaggaccttcacttgaacttctctcctcggccaaagagctgcctccactggaccatttgcttccctccaggattttctagttttgggcagtgaacaatagaaggcactttgcctccccaaaatcccgtctaactggaagcctcttgtcatcatctattttcaagtttttttagttttttttttttaagctttaattttagtgagtcagtgcagggaagccactgaaaacgcatataaacaaaaatgaattttcatactgaccatagtcataaattgtacaaaagtattcatcatctccactttgacaaagggttgctattttcaaatgaccttttcttatggggattctcaaaatataagatgttacagtggtcaggaatgtggtaatctctttactaccagtgattctatttcttaacagaattttgcttcccagtgcagatggtttgatatagtaacattcaaagcagccagcccttaggaaatgccaaggccaatatttgaatgcagatacaagttttaacaaaggaaaatgtagtatatccttgtagctgtttgcctgtgaatattcccctggagggctaatacactattcttgaatctaatccaagtcaagccaactctaaaaatc

SEQ ID NO: 145330 - DNA, 568 bp, Homo sapiens
catgcacatttcagggcataagaatatactggactcaggggttaggagcatacacatatgtcacaatagtaaagcaaaaatgatgtgacacagattagttttaccaagacaggaaagttacttatcattctagatagatttaaccaattttctttctgtttacttgctcccccaaattaagttagcttatacatcctatttctctactactgaaactagataatggtgactacaatattgttagagcaaaacataacgatttcagctactatttatgacccagtattataaatgagagtgagagattaaaatgacttgatcaaggttaaaacagtgaagcccagatttaagttctagttgccatgaatcagtagtctgtgtgtctttctatttactgtcttataagcaaatggatctttctaaagacctcaacgaaaaaaaatcagaggggaaagaccaagagaaattaaagtaggactacaggatccaaacagaaagatgggtcagtattatgaatgtaatagttttgattaggaattagttatgttacataacttaaacatttaaa

SEQ ID NO: 145331 - DNA, 1246 bp, Homo sapiens
ttttccttggaggatttttatgaattatgatttcctttatttctgtccataattttgtgcttttgctataccaggattttagtcgagattcaatgttatcacctgccttgaagtcttgtctcttgacaaatttgcataattctgtgttgtattaattatctagtgctgcataacgaatcactcccaaaccttgtggcttacaaccacagtcatcactgatgatcttttacagtttctgtgggtcaggattccaggggtggcgccaccaggcacttctgccttggggtttctctcggagttggagttggacatcagctggggctggagtcacctgcaggctggcctggggtcgggcagggggatctgcttccaaggctctgcttcagaggcggctccctcccacggtaggcgcatggtttcctgtctccaaagtgggcctctgcacaaggctgcttggatgacctcatgatatggtggctgctgaccagggtagaggctggaaccccttggatggcccaacctgggaggtactagccatgcctctgccattgggcccggccacacaggttcctgccctcttctccgctgcccttgtgcctcccgtgtcctcgctgcgtcctaaccaaatgctggactggcagagactgaaaacgccccacggggcccctgtggcttgctcactcgggctctccggagagtgggtgccaaccccctgcgccctgagcatcttggctctgcttggcttgcagctggatcccctttttggactttggggctgcacacgcaccttgttctggagcgaatgggctcgtgagagccgcaggccctgaggcatggcctaactcaggcagagtagttggcgaaggccccagagggacccaggctatcgtcctgcagctgccggaaaaccatcaaggatgctgacatcaggagcacagtgtgatgcacgaccgggattgctcgttcaaggtatctttcatgagatcgtttctagtttcccagggcccatggccgggtgagctggggttgtccttacctgggtgactcctgttgctctcacggggccggtgctggggatgaagcgcagggaccaagcatgttggggtgcggcccaaacgcgttgtgaccccagggtgccgttccgtccgccttggggctgcccccccacctgggtgcccacggtcttcggttaacccgggctgtttctggcggcgggccgccggcgcccacggggtgcgaggctggc

SEQ ID NO: 145332 - DNA, 262 bp, Homo sapiens
ttggagggacataaacattcagtacgtaacatactataaattcttcatgtaggttcaaggttcaaatgtatattacccatttggtctgggaattcttaagataaaagattaatatagaagtggtatcaagcagtgatggtatccctgcaatgtctgtcagaagcaataaaaaatcttctctggaggaacattccctcaattcaggcagttgaagattgctacaaacagagtcctactaaatataagttcacaatccaattac

SEQ ID NO: 145333 - DNA, 168 bp, Homo sapiens
taaagcatgaaatcccccttgacttaacacagtaaaggcttctcattcacaagcagtttgcaagagattaggtggccctcctccttcgtgtgccacattgtctggacgtgtggtctctgggatgtctgcagcagggtaacagtgggctgcaaccactcaagatgtttc

SEQ ID NO: 145334 - DNA, 817 bp, Homo sapiens
taaaacataaccacatactaacttggtgtcatcacagttagtttcaactctggttcctgaaaacatagttctgcctttctttccaatcgatatttgaggccagtgtgtttcaaagaggctcaccattcccacaaatgtttgacatgccagaacccattcatccaaccctgggattgtggtcaaatgaaagctggaaataggcctgcttttcctaggccaattcagtcttcaacttgcaagctcagtgccatccaattctcaaacccaatcctgaccaaggccccatccagaggtctgtatctgatgtgcctgcgatgaaggcaggagggagcctagagcagtcacatctcccctaccctcactgcatttgaatggatatacctgggctcccacttataagtgagaacatgaggtatttggttttctgcttctgcatcaatttgcttaggataatggcctccagctatatccatgtcattgcaaaagacatgatttcattcttttgtatggctgcatagtattccatggtatatatgtaccacagtttctccatgtggtagaagtgaccagtgttctcaagcctgtatgcctgtctggctgggccctgattatttctccaggggttaggctttacctcttatgttcccaggcacaagctggggtcctcccaaactgggcagaccatgtgctcgatttcaggacccgtattacctagagattttgttcttaggtaataagcccaagtttgcttctcttctttgaagatggtcatttagagtgctggctacttcacttggggcaagcccaacagccagct

SEQ ID NO: 145335 - DNA, 133 bp, Homo sapiens
aggggagaatgagacgcccagatgggcagtggtgggcaggcagatgtgagcaaagaagtagttcagggacgtctggcagtgtgccgcacacaagggcaatggtacaaggtgcaaatgaaatctgcctggaagg

SEQ ID NO: 145336 - DNA, 603 bp, Homo sapiens
  misc_feature (15)..(15): n is a, c, g, or t
accggttcgcatgtnccctatagatcttcccactatagctacatagacgggtgtgctcttttagctgtcttaggtagctcgttagatttcttggtgtcttaacagatctctcctttataaagggtaccttttcccttttgaaattagttgattacatgtttgaaagtttgaggagttgaatatggtttgaaagtaaatagaacggactggtgtaatttccagtaatgaaacaagctgatttttaacaaataatatatttgattttaaacttactgtatacaaatttttacttgtgtaaaatataatagagatcagattatttgctatgtagaaaaggtttttacaaaagtataaacagacagttcttgcatactttaaaatgtcatttcttgcttagaacaaatacacttaaattctctatatacattattctgtatatacaaaatcaggtattattgatagtttccagcagtgcctgagttttagcagtatgagttctcatttttgtggtatgtagtgatggtgtcttttcttagattactcaagagattaactctagaacaagttaaacctttctctcttcacttgggaaaaaaataaatt

SEQ ID NO: 145337 - DNA, 400 bp, Homo sapiens
tcaagtggttttcctgcctcaacctcccaagtagctggattacaggtgcatgccaccatgtccagctaatttttgtatttttttagtagaggcagggtttcaccatgttggccaggctggtctcgaactcctgacctcatgatctgcccaccttggcctcccaaagtgctgagattacaggtgtgagccaccgcgcccagcgcaaaatactaatttttttgtgttcttcataatactctgaattataataagcttataagacagttttgagtggggtggaaatcgtcctattcctcttcaataatagaattcacactttaatgttagtattgaaatattaaagtatatttttgataaaatgtgcttgatagagtaaaacctatcagtggaatggttttgg

SEQ ID NO: 145338 - DNA, 411 bp, Homo sapiens
tagcttctgtagttaattagggaagggggaagcaggtgattgaaaaaggaccgagaagttagacatcatgaggaataggagttggagagggaatgaacaagtccatgatagacttgtcaggcagccttgagggaatttagataaccagcattggtactcacaagtcatcagagttgtatgattttttttttcctctactacagcccagcagctggtaatggttaatcaaaatttaaaggtgtcattagtggcaaaaaaagggtggggggaagattcagttcaatcactcacattaaataaaagagggcccattaactaaaaatattttactttaactattttatttgatttttttattggacttttccttgtggtaagtttgggaaaatagtgggttttggatgagagttc

SEQ ID NO: 145339 - DNA, 401 bp, Homo sapiens
agacattgtggactccaaggagaagactaaattgcacatattttactttctcacagaatttaaggtaatttacttctgaaggatttgaagataatttcctcaaactgaattaaccaataacaaagattttaaaactccaacaagctacccccagaaaaatcaataatttgtacaacaggtaagtaccaaatggaaatacaaatctgatctaggtattttaatgtaataaaatgttacattaagttaaaataatgtgggaaacacaagtttatttaaaagaaaggaaaaattagaaactatatgacatatgaactagaagtgaagcacagtgggaatgttatttggctagttcccctcaaccctttaaacaaacaaacaaaaaaagacaacagtaaaatatg

SEQ ID NO: 145340 - DNA, 452 bp, Homo sapiens
ttgatctacgtgggtgcatgaactccgccaaacattgacgctcaagaacctttgctataattacagaatccaaggtttggtctctggtttaagggattttaagcaaaagcaaactggcacaagagagagttcaggggcaggagcacacttctttagacctgtaaaataatacacctttagctggtcttgaagctacacttgctgaatgggcttggggacagaccagagttagaggacagcagagggactcccctctgctccgagcccatgctgtctcaaccctgtgctaatgccccttgtccctgaagtcccatttaatgggcctccagcccacctcccaccttccaaaatgctctaactcatctgtgcaaagccagtctctttgaagccagatttaaggacatcaaatttaaggacatctctaagtctctgctaacagaacgtgtaggctg

SEQ ID NO: 145341 - DNA, 341 bp, Homo sapiens
aataggagtgacttctatgcaatgtaaattactttcatttctatcatcctgtcaactttgagctgtttggttggggaaaagcaggtagttgtggagggaggaaaagataaacattatatatgttttaaaacgcatcctcctagtagttgctaatctagatgattaaaagcatgcattatttaaactgcatttgtctttccaggtgcatgcctgcttctcaaataggttataaaccgtgttagagatgaggaaatcaaggcagatggaggccaaggaatcagtttttatactacaggggagggcatgacgtttaaggccacactgcccactgagtctcgtcc

SEQ ID NO: 145342 - DNA, 230 bp, Homo sapiens
aggccaaacatggaaaggatttcctggttctcaacaccccctggatgctggaaatcatgtgcctgatttctgacaactcccagtggaatcttgtttagcggaccttcccccaccagcaccccaattctttgaccataggctccttgacttggtatccttcagcacctagactgacgcctggctcaaagcagaggctcagtaaatcttccctgcatttgcatatgaatgaa

SEQ ID NO: 145343 - DNA, 311 bp, Homo sapiens
cgtgtttgacaacagaagatatagaataaatatttaattttgcactaatgaacagtgctagttaaaagacatggaatacataataaataaaattcagcaaaatataatggtcccaaatcagggaaaatcagagaagaacttgacaaactggtcacctgcttgagttgagacacataaagttcacttttgtttatatttttcaccttcatgatttttatcccttttctcctctttcatatattcgtatgtacacaagtgtatacacatggtacatctttacatttcaaaacaaaccccaaacactgtgtgca

SEQ ID NO: 145344 - DNA, 180 bp, Homo sapiens
atctacgttaggatggggttgtttgagtggtggtttatttctgactgcttcattttatacttgtattttaaatatacaagtttttgtaaacattcctaaaacaaaacagatctgtttttattttgaagaagatcggacagattctgatataatgtttggagaactaaattatacacagaa

SEQ ID NO: 145345 - DNA, 103 bp, Homo sapiens
tatctctacaaaataaccttagccaggcatggtagcttgcacctgtagtcccagctacttgggagacccgaggtagatcacttgaacccaggaggttgaggct

SEQ ID NO: 145346 - DNA, 202 bp, Homo sapiens
cagagtagttctacctccatggctcagtgtctaagcaagagccaaagaaagaaaatcccagaaacaccacgtaagagttgggagggaagccagattctagacaactagtttcaaaggcaagccaggcctacatgcctgtgggttttaagtgttcactctggtaagaatccatgaagcaacattagattcttgaaaccacagt

SEQ ID NO: 145347 - DNA, 135 bp, Homo sapiens
ctctgatggccccgccccaccccaggagctgagcgtagactaggggagacagcactcagccctcacccaggacacgcccagtgcctgggaggaccctggtgggtcctgcggtgcaagcagtactgaggggccttg

SEQ ID NO: 145348 - DNA, 226 bp, Homo sapiens
aaaagcagtgtggggagagtaacggttagagatgaaagggtgaaggatggcgacagggaaggccaggaggccagtgagctgcccacggcattctgcatgcagttgtggtagagaatgtgggcatctggagtcctggagggtccttcagcccacttcctcagcctcccgagtagctgggctgtcgggctagtcggggggctagtcggggctgtcgggctagtcgggg

SEQ ID NO: 145349 - DNA, 572 bp, Homo sapiens
aaaagcagtgtggggagagtaacggttagagatgaaagggtgaaggatggcgacagggaaggccaggaggccagtgagctgcccacggcattctgcatgcagttgtggtagagaatgtgggcatctggagtcctggagggtccttcagcccacttcaaggcaagtctcctcactcacctgggaagcagagggcaccaggctgtccaagggaagaggaatactgacaaggcccgaggtgccacctacccccaccccatctgtgcacacacacctcagagcaacatggctctccccagctgccgtgaagggtcctcaatcttccttggcacgatcaagttatttacatgcactgattattgagggttagcatttatttctagttagaataaaatcccagggatgggacaggcccgtgggagaacatgcaggagtctactgccaaaacacaggtttcccactgtggatccccactccccagtctgcctgagaccctagggccagctctcaggtggtctgcagcacgccagctcactgacagctgcaccagcctagcggcaaccccgttggccgta

SEQ ID NO: 145350 - DNA, 366 bp, Homo sapiens
ggggtagatcacgaggtcaggagttcaagacccgcctggccaaaatggtgaaaccccatctctactaataatacaaaaattagccagacatggtggtgggcgcctgtaatcccagctactcggggggctgaggcagagaatagcttgaacccgggaggcagaggttgcagtgagccgagattgtgccactgtgctctagcctggtcaacagagtgagactctctctcaaaaataaataaataaacaaataaaagtttgttgatccaataggaataaaaataacctgtcatactaatctcatgtttgtatgtaacaaaagtatgaaatacaagcataaaatgttttgtgaactttaaagcataatgc

SEQ ID NO: 145351 - DNA, 498 bp, Homo sapiens
tgtctgctcccttactatctaaccttgtggctttgctactctagccaagctctttcctccaattctcagtggggaagctaaggcccagagcatggacaactttctcaaaattcccctaagagccaaaggtagtattgagactttgaaccctaaccctaggtaatctttgtcccttgaccctctctatacctaatcattctcttgtccctctggttggttctccccaaaacacttatagggaaatgagatgtggtgacaatcaggggcctagaaaagtcaaaggcagccaaagaactcagaagcttatgtgcatgtcctgtaggcaactcactgtcctggtctaagtgccacagcttcccttcccaaaggagtttcataagaggccctcaagggtgactgggcagatatgaggcccttccctggaagctaaaatggtaggagaggtgaccagggctgggattaagggcccagcagatatcagggtttggaggccagggt

SEQ ID NO: 145352 - DNA, 300 bp, Homo sapiens
actcagcacccaaacactccgcacccacacagcacccaaccactcagcacccaaacacacagcacccaaacactcagcactcactcagcgccaaaacactcagcacccaaacacacagcacgcaaacactcagcgcccactcagtgcccactcagcacccaaacacacagcacccactcagcacccactcagcgccgaaacactcagcacccaaacactcagcacccaaacacacagcacccactcagcgccgaaacactcagcacccaaacacacagcacccactcagtgccaaaacac

SEQ ID NO: 145353 - DNA, 219 bp, Homo sapiens
acggcctcctaaagtgctgggaaccctcgtgtgctgcagctggaggcggacacagggacaggccctctggagaggctctgggcttcctctgtctagaaaggccactgctgtgtgtgcagcagaccaagaccagcagtgctgcccccagacgctcaccctacagaaacgttcactgcccagtggtcatcaagttagaaccagaaaccagcaagaagcctg

SEQ ID NO: 145354 - DNA, 375 bp, Homo sapiens
ccgagtatcgatagccagtccagcttcattcactcattcatttcttttctttcatttcaggagaacatttagcagtgttttgttttatttattttattcaaagggaaatcctcatgtgacactagcggtgaaaataacttgtatttgtaagttaatgtctgctgtacatctgagtacacaattgtctttcacagaagatggagcaaagtattacggaaagttcattggcttctgagtctgagagaaatgggttcaaatcctgaatacgttccttatctgtgtgatcttaagactcatcatttaatattctgagtcagtttcctcctctataaaacaagaatcagacggggcacagtggctcacgcctgtaatctc

SEQ ID NO: 145355 - DNA, 348 bp, Homo sapiens
tttttaaatagagacagggtctcactatgttgcccaggctggtctcaaactcctggcctcaagcaatcctcttgcttcagccttcatacctgtaatcccagcagtttagggggctgaggcaaaaggattgcttgaaggaaggagtttgagaccaccctggacaagtgtagtgagacctcgtctctacaaaaataataataataataataataacaacaactagccaggtgtggtaatgaggacctgtagtcctgtctactcaggaggcaagatctttgagcccaggagtttgaagctgcagtgagccaggagcttgctattgtactccggactgggagtctacctctt

SEQ ID NO: 145356 - DNA, 319 bp, Homo sapiens
tgcaagatatttttctaaacatttagaaattgaaatgtggtccggcacagtggctcatacctgtaatcccagcagtttagggggctgaggcaaaaggattgcttgaaggaaggagtttgagaccaccctggacaagtgtagtgagacctcgtctctacaaaaataataataataataataataacaacaactagccaggtgtggtaatgaggacctgtagtcctgtctactcaggaggcaagatctttgagcccaggagtttgaagctgcagtgagccaggagcttgctattgtactccggactgggagtctacctctt

SEQ ID NO: 145357 - DNA, 288 bp, Homo sapiens
actatattaagttattcatagcaatgggaagaaaacagtttgaaaacctggaatgagctatgacttagctaggttagtataacgaatatggtcttcggtctgataaacctagtttcagtatagattctgcaacttagattggaaaatcaacatttctgagtctaggtttcttcatttgaaaataaagctaacaatgtctacttttgtagggctgtgacacctgtagaatacgctcattcattaaatgttaattttcctttcttatttatgaagtaatatgaatttaaa

SEQ ID NO: 145358 - DNA, 335 bp, Homo sapiens
caaaatgtccaaagctcaacttaactgtaaaacatgttcttccattcgtgttccattctttgttaatagcactatgtcatcatccttgtcaatcaaaatagtagtgtaagatatctttctggtgacaaagtccttcctgttgatttttccttcaaattatatcctgaatatatgttcccttcctcatcataaagccttacttcaagttctcaacatttatccctggactattatatcatctgtccacattaaacacaaggactatctttctaaaatattgataggcttatgtaattcttttgtttaaactccttcatagacactattcatcacct

SEQ ID NO: 145359 - DNA, 890 bp, Homo sapiens
cctatctctatgaaaaaaaggagaaacaaattttttttaaaggaattaggaataagtattatgaagagtatcaattaaatattaggaattaaattgcagtattttgtccagctgtgttactttggtctcatttcctgccaaagcagataaatgatattttattttattttattttattttattttattttattttttgggaaatggagtctcactgtgtcgcccaggctggtgtgcagtggtgcaatcttggcttattgcaacctccacctcctgggttgaagagattctcctgcctcagcctcctgagtagctgggattacaggcactgccactatgcccagctaattttttgtacttttaatagagatggggtttcacatgttggccaggctggtattgaactcctgacctcaagtcagcccacctcggcctcccaaagtgttgggattacaggcatgactcaccgcggccagccatatgtatgttttcgtgtggtagactgtcactctacacttttagagacatatttttagagatagaagaaaaaaatatagactacaaaaatgtatggaaggaagaagatgtgtgtgtgtgtgtgtgtggtgtgtgtgtgtgtgttattctggtcctggcttaggtaaaaccattttttgtggagaataggctgataatttgccaccactttggggaagaataaagcactggctttattattttgaggacgctaactattctccccatggctgcgtgtcacaccagctccttgaaatacataacagtcctagacttcttaatttcgcccgggatttataatatttcggtcacaaactggggtatactcgggaacacaccttggtgtgaagggaaaccgaccaagcctaaaaaatc

SEQ ID NO: 145360 - DNA, 589 bp, Homo sapiens
tttctggtgcaggaggactgttaatattttagaccgggctcctcaaacatgtatgcttatttagtgaggagaaaatgtgcatttgaatcctgcaaaccctcgagaagtttgcattaattaaatagtgattaccagaatattctcttctaaaatatattttatttatcaaatgaatacccttctgagcccctctttatccttcctgtgatggctaaactaatttcatcaaattttgatttctgtgtggtgatgttgtgaacagtgcctgaaataataaaattaccctgagcagattgcatataaaactgtttgcaatgggagaagcagtctttggggctgtggtttcctttggctgcagtgtaatatattcctttgtttcttttgtgaagtatttattgtgggtctcctgtagtctgagtttcttgtggaagtgggcttgtgttttgcttttgtagactgacactgagaatagcatccaaacatctttttcccaccaaggcatcaaactccatcattaggaattccttcatagaatcaaagaatcagaaagagctgaaacatagaccacggacactcaaattgtttatcc

SEQ ID NO: 145361 - DNA, 690 bp, Homo sapiens
gttcggctgctcctgtttatcctatttattctccgtcctgaagaaccagctagacttggctgtgattaatcgcagaggaaccagaaactcccgggggagagagacccaggggaaagttggggaagcggggctgatcaacagcaaaaatctgccaaaaaagttcgagagagccgggcgctgtggctcagcctgtaatcccagcactttgggaggccgaggcgggcggatcacaaggtcaggagatcgagaccatcctggctaacacggtgaaaccccatctctactaaaaatacaaaaaaagttagcggggcgtagtggcgggcgcctgtagtcccagctactcatgaggctgaggcaggagaatggcgtgaacccaggaggcggagcttgcagtaagccgagatcgcgccactgcaccccagcctgggcgacagagcgagactccatctcaaaaaaaaaaaaaaaaaaagaaaaaagttcgagagccctccaccacctgttcctggaccaaactgagcgtcaggctgctgtttctcctggttcagtaaggagatgcagatgaactggagaggaagcgagtttttatttctgcaaccagttacagggagaaggcctggaaattatcaccagaccaacttaaaattacaaagctttccagagcttatataccttctaagctatatgtctacg

SEQ ID NO: 145362 - DNA, 264 bp, Homo sapiens
tgtgttgagaggtatggagcgggggtccccaattcctggactgtggacaggtaccagtcaatggctttttaggaaccaggccacacagcaggagatgagtggtgggtgaatgaccattgccgcctgagctctgcctcctgtcagatcagtggcagcattagattctcataggagtgcaaaccctattgtgaactgcatgctccttatgagaatctaatgcctgatgatctgaggtggaacagtttcatcctgaaaccatccccg

SEQ ID NO: 145363 - DNA, 273 bp, Homo sapiens
cttttacaaggtttctgcttccttggcctcctctcctccaccctcagccccattctaaccacctcttcattcggataatcttaatgaaaaagtttttcaaatgtgggatgcaattagacaaagctgccttatgtcactggcacacgtctccgaaacaccagtatctcagattcaatttggctattccatttatgaaatattttaaagagtatatctcccattctaaggcagctcctaaggataatatattgatcactgcttcacatattttaa

SEQ ID NO: 145364 - DNA, 336 bp, Homo sapiens
gggggaagtccttcaggaaacttacaatcatggcagaagggcaggtccgacttacatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggtggtgcatgcctgtaatcccagctactcaggaggctgaggcaggagaatcactggaactcaag

SEQ ID NO: 145365 - DNA, 373 bp, Homo sapiens
ggactttaacagtgattatcaagtgccttccaagagacagcagcacttccgtgcatcacggaacattgactgttcctctccatccttttcccaggtcattccagagtagcgcagtttttgactgaaccatgtagaaatttgcttcagttctacacaaagatctggaacagtactttatttttgagcagatggagcctttttggtacctcctggcaagttggtgttggtgtctaccagaaaaataaggtcactcctaacctggatgactgggttgaagtagctgtttggactgagtaaagggagacttcaactgaattaaacttaactttcatatgatgtttttctgaggctgtgtgaaaatagaaaccaggaa

SEQ ID NO: 145366 - DNA, 627 bp, Homo sapiens
gaccccatttcttgttacctctcaactgatgccttcctcactctatcagttctctatagatgcataacaaacttaatggcttgaagcagcattttatgtgctcatgattgtgtgggtcaatgatcggagcagggctcagctggactgttcttccgttggccttgcctgggatcacttatgtgtcatctgatcgcctgatgggagctgggtgctctgagaaccttgctcacctgtctggttggtgctggctgttagctgggccacatgtctccagcaagccagcctggacttcttcacacagaggtggagagatccgtgtgcgggaacggaagcctacgaggactcttttgaagcttaggctgggcaattgcatagtatcacttctgctctgttctgctggtcaaatcaaggcacaagctgggccagattcaatgtttgaggaaagagattgcacctcttgatagaagagctgcagagagtttgcacccattttaaatctaagattgtatgatgtcattcattccttggttaaccttggccatttctttccatttttaattaatcactcattgatttttttaagttttatttttaattgtggcaaaatacacacaacataaaattttc

SEQ ID NO: 145367 - DNA, 233 bp, Homo sapiens
aggaggaaagtcctaggaaaatcggttctaactaatttatgatcttttccaagtaaaaatgtgacaaatgagcaggctgttcaaaataattaagggtccgtggtttgcttggtttcctatctgagtttgtacttttctaacaagcaacttctgggcttttggttactattacataaaggaatagacttttaagaaaaattaacattagagccatggaagtgtatataattctc

SEQ ID NO: 145368 - DNA, 263 bp, Homo sapiens
cagcctcccgagtagctgggactacaggcgtgtgccaccacgcccagctaatttttggtatttttagtagagatggggtttcacgatgttggccaggatgctcttgatctctttacctagtgatccgcccacctcggcctcccaaagtgctgggattacaggcgtgagccactgcacccggcccaaatatttaacattgactgtatgccagggactctgctgggcactgagagtgcagcaatgaggaagagcagggcccattc

SEQ ID NO: 145369 - DNA, 263 bp, Homo sapiens
aggtgcactcttccttactggtagaagattgtatttggttcctttttctgcataacaaattaacccaacatttagcagcctaaaagaacatttattttttcatggtatccgcggtcaggaaagtgggcgtggctaagctctgtgcctttgcctcaagggttcaccaagttgtggtcaaggtgtccccccagggttgtggtttcatcggaaagcttatctggaatgatccactcccaagctcacacacacggatattgtaagga

SEQ ID NO: 145370 - DNA, 377 bp, Homo sapiens
acactacttccaaagttgtagattttttttttaattttcagaaaacaaaataggattttaattatagaggataaagaaatgaatgtttttagttcgcctagaagggaaagtaatttttcatactctatttgcacagcactgtccaggcccaatctgtttaccaattattatacatcaaagtttaccaattattacacatgaatttgcacaggtcctttgaggaaatgtgtaatggcagcataagggaccagcaaaagctggaacaggaagataccaaaaaaagaagagagcgagtcaagcaataatggggagctgaacattattcttaagagcaaagccacctgtttcatattttaaatgatgaaaaaatatgtttt

SEQ ID NO: 145371 - DNA, 256 bp, Homo sapiens
  misc_feature (32)..(32): n is a, c, g, or t
  misc_feature (51)..(51): n is a, c, g, or t
atgacatttacatgatcggagtaagtctaggngcccacatatctgggtttnttggagagatgtacgatggatggctggggagaattacaggatttcagtattttaaatgtgaccaccagaggtctgtatacctgtacctgtcttccctgagagagagctgcaccatcactgcgtatccctgtgactcctaccaggattataggaatggcaagtgtgtcagctgcggcacgtcacaaaaagagtcctgtccccttct

SEQ ID NO: 145372 - DNA, 407 bp, Homo sapiens
agcccaacacccttccactgcagctgagatttcagttaatcagcttgggcaccagacaactgcttggcagaggacttgatagaacagatgtcaggagttgtgttccagatacccagaacagaaaacagataagaccatagcaaaggacaaagcctatagctcctgagcttattcaacatgtcaccaaagaggctaaattccacgtctcaaggatgcaatcgagaaacagagtgatgaagtccatacaaaagtggtttgaaactttgatcaaacattggcatcgcctggggagctcgaaaaaacacaatgtctgtgtcccattcccagatattgatttaatggtctgggatatggcctaggtttcaagacctttaaaagtctaacatggtctaatgtacagctttagt

SEQ ID NO: 145373 - DNA, 220 bp, Homo sapiens
ccaatctgtctgggggtagagcctagaaatttgtgttttgaacaggctttccaggagattcttttataaaccgatatctgaaaaaacactgtatatattttgccatgtttgttctaggtttggattatgagtttgggtattactgtttttattgtttgagtagcgactaaaaatcaactgttcatttaaagggcatttgttaaagttttatgtttcatgt

SEQ ID NO: 145374 - DNA, 295 bp, Homo sapiens
aagcgattctcctgcctcagcctcctgagtaactgggattccaggtgcctgccaccacgcccggccaatgtttgtatttttagcagagacagcttttcaccatgttggccaggctagtctcgaactcctgacttcaggcgatctacccacctcggcctcccaaagggctgggattactggcatgagccaccgtgcccatccttgtttatggttttatgaacaaccgtttcaggagagggattggcataaaggccagattacacaactcctaggagttcattccccgtaaagggaa

SEQ ID NO: 145375 - DNA, 682 bp, Homo sapiens
  misc_feature (650)..(650): n is a, c, g, or t
tctattctcttgatagaaactatttctttctacggtggatttttgttctgcctttgtgttgttttactttgcctgtatgcttttcttatcttttctagtttactagtcatgtatcctacattttagatgccttttcttgatatcatttaattttaactttatgtaatctatttaaaaatttttctcagaatataaataatagttgcagtagtagaactaaaggtagtgtcagaaacagtagggtggtgcctaccatgttatgttagtgaccctgtgtctttggtttagggatctagtggaacatgaccagctatccccttttgcctgagataccctcagcttttgatcatcactactgagtttttacatgttttagtgaaactatgaattactcaaatgttgtgatttaaaatgtggaagataagctgttgatatgctagttcaaaaagcaattcaaactgctatgtgacctagaaaaacaccggtgtttatcgatgccaccaggctaatcgaatttataaaaagaaaatctttcctccttttggttaaatccctttgcggttttctgagcgcgaaaaaaaaattatcaccatgtaatagagtgtagataattcttagaaactagtagtaggatgttcagggagcccagnaggaagcaagattccattggcggtcagtagaa

SEQ ID NO: 145376 - DNA, 310 bp, Homo sapiens
aataaatatatgaaaattcctaaattctttcataattaagtaaatgtacaccaaaataacaattcaatttcttatctctttgacttagaaatttggtgtgagtatttacgaggcatttctccccttaggtgaagtagaagatttaatatcctgcctctttacatatttctaccctttagggataaaaacctgtgagaatattgtagtttcattgtttagtaattcttttaaatgaaatgtattagataaatttcttcctgagtcatggtttttggctttaaacaatggacactgatgctgggataactta

SEQ ID NO: 145377 - DNA, 709 bp, Homo sapiens
tttttttagatggagtttgctcttgttgcccaggctggagtgcaatggcacgatctcggtccaccaaaacctctgcctcccgggttcaagcgattcttctgcctcagcctcctgagtatctgggattacaggcatgcgccaccacacctggctaattttgtatttttagtagagacggggtttccccatgttggtcaggctggtctcgaacccccgacctcaggtgatccgtccaccttggcctcccaaagtgctgggattacaggcatgagccacagcaccaggcctgttctgtccccattaaacactcacctcctactcctccctcctccagctcctggcacccaccatcctactactttctgctgctggaattcgactactctagggacctcatgtaagcagaaacatacaaatgcttgtctttttgtgtctggcttctctcactgagcacagtgtcttcaaggttcatccgtgttgtgacatgcataagaatttccttcctttctatggctgaatgatattccattgtgtggatggaccacatttgttgatccttccatccatggatggacacttgggttgcttccaccttttggcatgtgaacagtgctgctacgaacatggttgtacaaatgtctcttcaagaccttgctgttggccgggtgtcatggttcatgcctgtaatcccagcacctttgggaggccg

SEQ ID NO: 145378 - DNA, 636 bp, Homo sapiens
ccatgcagctgacagtgtctgcaccagaatttgaaactggaacatctgttacttctcttttctcacactgcctctgtgaagcctgggggtgagagtaggtgccagtaggcactggaatgctccaggagaatgcccgtgtctaatgacaccttataaacacttgccgccagcacacatatgtgataaaaacttcaataatggaaacgtgacatgaggtggatagaatgaatggacactttttgaatcaagcctcttcattttctcactactacctgctctgcatctaatttgtcttgagtacacattgaaaatgtgtttccactaatattgaactcattgaagaattgaagatgagatgctaaatttattagtttcgtggatcttatatggtgtcttcttaaaccttatgcctcatttttaatttacatgtgagttggaagtgactacacctgctttgtcattgaagtctgcatttttaagtaaaggtgaaagggtgtgtatgaaaacttctgagatacagaaaatgaaagagactgatagtcgcttattaagggacaccaaattctaccatgaaggttttattttttcccagtagcataacatggctatttctacattttaaaaaatctctgaaac

SEQ ID NO: 145379 - DNA, 274 bp, Homo sapiens
atttaatagcatttaacttgagacccttatctatcaaagtcataaattgcaaacatgtctaatgacctctggtgcaatgtaaaaactgaatccactcaagatattaaaagatctatatgagatgcaaagatattttaaagagaaattgtttccaaaatgatatatcaatttaatggggaagcgcggtgtcatcaagggttacatcaatctcagccaaggctcccagactcgggctagcattgacgaacaccactttttgcaactacatttagtt

SEQ ID NO: 145380 - DNA, 515 bp, Homo sapiens
cagagtggtcatttaatcggacattctcttcatgatacaaccacctaaaaaaacccttgccatctctcatcggcattctggtgtggtgtccaacaattatttgccttgaaagaaattgtctctttgtgaaacagtggcattcttactatgaagtttgcaaagtacattttaatgcttggtggagtaggatagagcaatttatttttgggaagtgaattttgaaggaaagggtatagttttgccatcagacagatgtagcttcagatcccaggttttgccctttctaatgatgtcatgttagttccttaagtcctctgagcttccttttttttcactgatagagacaaggtctcactatgttgcccaggctggtctcaaactcctgagctcaaatgatccttccgccttggcctcccaaagtgctaggattacaggcgtgagccaccatgcctggtcccatatcttcacttaagttgtttcatctgaatttaccagtggccactttgcattgtgaa

SEQ ID NO: 145381 - DNA, 395 bp, Homo sapiens
  misc_feature (341)..(341): n is a, c, g, or t
gctgaaggccccgtcccttattcctcactctctgactctggttgctattgcattagagctctactcttatgccacagccctcaatgtctacagctgggatctctgtgcctattgcttacaatattggaagcaaggtaagagtcttcaacactttccactgtcaggactggacctgcaggaaagtctaacagatttgaactccagtgctcccttcactgctgacgtggccttctgactacctaagggcgcttagttcctgcctgtgtttaaatcagttgtctgactacatctcaggactgagaactgtaaataccaatccttgaaagggaccatggtgcggncctgtgagacataagaaccagtcaattactcacagtttgaccactctgacagtg

SEQ ID NO: 145382 - DNA, 797 bp, Homo sapiens
gtggcatatgcctgtaatcttagctactcaggaggctgaggaagaagaagtgctagaaccccggcagtgagccgagatcatgccattgcactgcagcctgggcaacaagagtgaaaaaaaaaacaagttgctttgtggaagaaagtaagtatacacagggagaaagagatctgatgaccaaagcagggaatacgtgtttggagtccacggcatcctgagaacttcttgggaatagagtctaggcccccagtgctgtcactctcacccatcttcttctacacatgtgagatgtttcaggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactgg

SEQ ID NO: 145383 - DNA, 716 bp, Homo sapiens
aaatggccaataaggacatgaaaagatattcagcatcaggtagttattagggaaatgccaatcaaaacacaatgagatcccacctcacacccattggattggctgctattaaaaacaaaaaacccagaaaatagtgttagtgaggatgtggagaaattggaactgttgtgtgctgttgcaaggaatgccaaaccgtgcagctgctgtggaaacagactagcagttcctcacaaaactaaaaatagaattaccatgtgatccagcaaccccacttctggatatagacccaaactgaaggcagggtcttgaagaaatatttgtatgcctgttttcatagcagccttatgcacaatttccagagaatagaagatacaatggaatattattcagccttaaaaaggaaggaaatcctgacatatgctgaaacataaattaaccctgaggacgttatgctcagtgaaataagccagtcattgagattcctagagtatcacatttgcagagacagaaggcagaatggagaggtggccaggggctgggggcggggagggggagccggtgtttcttggggacagagcttcagtttgggaaatgagaacattctggagcggggtggtgtgatggctgcacctctgtgtgaatgcgcttcatgctgctgaagtgtgcagtttaaaatggttaaaatggtaaattttatgttgtgtgtattttaccac

SEQ ID NO: 145384 - DNA, 413 bp, Homo sapiens
gggcgttcagaggatccctgatatgcgtctcagtctcctgaatagtgggactacagttgcctaccactgcatatggttatatatccatctttagaacacggttcaaacagtatgacattctacgtgaatagtaccctgcagaatttgggtgtggcaaccttgatttgggctttcagactatatgtgcaggacatattatctcaaactatgcattaattttgcgtgcatagttctaataattttaattgtctcatccagtcgaggggttgacagactagaacagaccaggctcagttcacatgctgcctatttttgtaacacttttttttgtttgttttgttttgttttgtttattttgccctacaaaaactgatttgagtagttgtgacacaactatgtgagactgcattgag

SEQ ID NO: 145385 - DNA, 294 bp, Homo sapiens
tatactgttacgcagggagacagacgctaatcaaacacaaacacaatggtgtaaacagggtgacaagtgctgtgaaaaggacaccgtgtgctatgagagtggcaaacaaggtgacatcaagtttctctttcagtggccaggccagatgatctcacaaaagatcgagaacactttacatgtcctctctgtatgtttacttctctgcaatcttttacagtatctttgtgaacgagcagaagaaatgctgtgtgaatctaccatttggagatatctgagtaggtggatttatagcag

SEQ ID NO: 145386 - DNA, 341 bp, Homo sapiens
ggcttttttggttggttttataatattaaattagtaatataaaaaacattcaactgggcgtggtggctcatgcctgtaatcccagcggtttgggaggctgaggtgggcagatcacctgacatcaggagcctgaggccagcctggccaacgtggcaaaaccccgtctctactaaaaatacaaaaattagccgggtgtggtggcaggctcctgtaatcccagctatgtgggaggctgaggcagggagaattgcttgaacctaggaggcggaggttgcagtgagctcagattgcaccactacactccagcctgggcagcagagcgagaatccatctcaaaaaca

SEQ ID NO: 145387 - DNA, 277 bp, Homo sapiens
tcttgttttcaccaaggggaagccatttctaaatatctagtcctagaaattagcatagaagtgcaggaaaggtctgatcagaagggactcatgttaacattatctcactgctttatttcaagagtaagaaaacctctgaagcagtgactggggaggtgggggataaatgcaacatgccattctgccgtgtattataattattgagaacttgttttgtcttttcgagtcatctgtaaacttgttgtaagttcaattttgtgtctctgttacccggtat

SEQ ID NO: 145388 - DNA, 267 bp, Homo sapiens
gaagggaccaggctgggagaagtggggcaggggtggggcatggagctccacattcggttaataagtctgtaaccaaaaacccatccatcttggctggcaggtggctgactgaatttctattattagctgacaggtgatgtcacaaaacctgtcatggatccaactagggaatcctcagtggaagataaatgagaaagggactcaggttataaacagaggtgccctctggttgacctctagtcactgtagacctgggacatatcagct

SEQ ID NO: 145389 - DNA, 527 bp, Homo sapiens
gggtggtggggatgctctgggaagtggaaggactcgaaaacccccagtggaataaaacattccctttgctacttgtgggaagaaaaacaagtatataattcattattcctaccttcaaagaattgactaattgtggaaaaaaatatttaacatacatgaaaatacttgagactacagcaacccaggcaaaatgtctgcagaggtattgctacatgaacaagcattcctctacagaaaaatttaggcaatcctttaacaagaggatgaccagagatcacaaaggcctaaaaacattatataggtctttaatcatcaacattttaaattaacttctcattcttcacgcagctcaaaggaataagtatataatttgtgtccagggaaggcagggtagagtcctatagatgttttagataatattgaaaagtcataaagtgttggattcacatgattttagcactgttttctggactataaaaatccattcattgaatatgcatctacttactgcaaaataaataaatatc

SEQ ID NO: 145390 - DNA, 201 bp, Homo sapiens
ggccactgacccactagtgaaatgttagggcattgctagattggatcctgtttatttaagggccgagagaaagagaaagctaacattaattgaatgcctattaatgtgccatcatatttggtacactattatctcttttttgctttcccagcaactcgggaagtttatattatctctgtttttccagcaagaaaagtagct

SEQ ID NO: 145391 - DNA, 309 bp, Homo sapiens
tcgcacgtcctcgcacgcgtcatcgcacgcagaaacatacacctcgcacgtcctcgcacgcgtcatcgcacgcacaaacacacacatcaacaggtgagaaatatttcaaattaacaatctaacattacaactaggagctgaagaggataaagaactaaaaaaggaagcttttcccaacgaaagacaagagatcagcatctttacttctgagcagctgcagggccaagtgttggtacaggtccctggggtagagaatgaaccatttaagagaatggcaggtgatggcaaaagcgaggaggagaagcagca

SEQ ID NO: 145392 - DNA, 403 bp, Homo sapiens
aactcctgtggaggagaacaaccatttctgtggaagccgcagaccagaaaaagatgctgtctcccaagccagggttcctgttatggaagctgtctctccatacccccaaccccttcccccaagctcttttcagccagtgaatcagcttccctagtcctgccagcttgcaccctattaagcaaagcaacttagtttgcaaaggcccctggagatagagaccttcacagcaaactttatctgagacatctctctatcttttttggcataatatgtgttcagagagccagtttgccactgtacaacctgagaactgttatttccattctgttaggtcatccatggcgaagctgtacaaagggctggcttcccagtgtgccaatgctgggcaagatgcttcccccac

SEQ ID NO: 145393 - DNA, 440 bp, Homo sapiens
acagcgcttcttcagccttcagtttactggaagtgaaagaaaagtcttggactagtcttcgacgatactttggaggacagagaaaaatgctgctgctgaacctatttgaggtgacagtatttccagaagcagaaacacacaggtgcaagcacccctatttttaggtgcctcaaacctcagatatttattaaatgtctagtaagtaccaggcacaatgtaagaaaactgataggaaggagtttaaaggtacaagcttggagggaatgagaatctgagaatcccagagactgacgcagcctgatggccattcccactgaccttgtgtccacgtagacacctgtgttcctaggctgccacctcccttcctggtgggcagttagcccccattttgtctgttctggaggtgtgaaggggagggccatggcagccagagagcgagg

SEQ ID NO: 145394 - DNA, 841 bp, Homo sapiens
taataataatgattccatcagttataccagaagctaaagtattatgctccccttgccaattgcctactcttaagaactgaagatagatcatctctgaagacaaatgtggcttggcactgcttcctacgagtacctttctaaggcatagcatgtcacctctacagggtcaagtagctactgagatgctgaggaaccaagttactgagctgagtcactcctaagtggccaagatggcaggagggctgaattctccacctgggactctttgcagggtccaaacattgactagctcgcttagaggtggggcaagggctccttgagcaatgtgtttcattctttagccagacagtatcagcaagatatttttagcccaattactaaatgcagaaatgtgagtttgaaatgcatgcctcaggagttcactcaggtaacgagactgtgtgattatgactctcagggcgtgtgtttccttcacatgtcccggattttcagaatagttctgattttcgaacattctgttctacccttctattagtaaaattctgtttgggcagatatcctaattctatagggaagtggttgggaaaatatggtcactgtagaccaagatagagatcctattaaagacttggtggttgaggaaaaagtgccacatactataaataggtatgtcttcccctttacctcactgatgagtcagaagtgacagaaactaactccaactgggtttggcaaaaagggaatttaccagccttgtgacggaaaagtccaggggatgcatggctggctggatacagattcccgaacaatgatccaaccgacctgcctctcttcacctctt

SEQ ID NO: 145395 - DNA, 471 bp, Homo sapiens
gacggtagaacgctattacatcctatgtgggtaattgaggagtatgctaagatttgcgtagctgggttggtttaatccacctcaactgcctgctatgatggataagatttaggactactctctgctttttatgataattaactgtcatttctccttagacttttcaatttatgtctaacatcaacatgcttgtccccattatatttctttcttatggattcctttcttatggatttttttctctaattcttgtaacaaaattgttgttccaggaaagtatacctagttaatttgggtctttatagcctctggcaccctgctgtttatgtgccttagcttaaggagcacttctttatttgattatggcttaacttgattttcaggaaagagtactggactcaaagtcaaaatctgtacattttttttcctgatttaatcactcgttaaccttgcaacctggagaattcactt

SEQ ID NO: 145396 - DNA, 240 bp, Homo sapiens
cacctccataggaagaaagctcctcttctttcctgggagctccagagaaagacctgtcttaattctgattggactgactcacctcctcccttccttgaaccaatccctatggcaggaagataaggaatgacctgaactgcccaggctactcctaaggcatttctaagtccaaaccaggtagaccaggacattccacaacagtggggcttttttttttttttttttttttgagacagtctt

SEQ ID NO: 145397 - DNA, 674 bp, Homo sapiens
cagatgaggatgctaaaggtcatgaaggttagagggtaagtgacttgctcagggtcacgtggcatgcgtgtggcagagtcagggtacagcacatgtgtttaacactttccattatcccaagattcttggctaacctccctggagagcctcaggaaacatcatgataagatagtcattttgctaagagcatttttgattagtgtcagttctgcccagcttgtctccttcataagattgaatcaagagctactttgttttatacatgatctatgggatatgaaggactgtgaataacaaagtattggtgtattcataagataataaagagaagcccagtaccagagggcccttgtggcataatagaaacagcacagactctggagtaaggcagaactgggtatgaacaccccctttgccattttctagcttttggctcctaggtgagttatttcatctttcttgagccccattatatgtattggtgaggaagctccctgctgggtgccatttgagagttagagataagacatgtattacagtctctgtcccactgtgtgcatgtagtaaatattgggtaggtgaatgaatgagtgaatggtagcaattattacacttaacttctattttgttaaaatgtatttgactcactaaaacataaatctgaaccctgtcag

SEQ ID NO: 145398 - DNA, 682 bp, Homo sapiens
gtgaatgaaagagaattccagttttgtgacccacttggaccaggtggatggttggcccagggaagggatggagcagccacactaacttgagcttagaattgagcctttcgtaatccaaggacatgagtgagggaaagaaacacacaatgaggttattatttcagtctgattctgagagggctattttatatataatttttatctagaaaaacttttcaaaagccatttactaaattaagcccctcaagatctccaacaatgtttatccacagaccaaacaccaaaaactctaaaagtttaaccgtaaatacggttaaactaaatacgcaaaagcagatacagtcatcccttgatatccatggggaatgtgttccaggacctcctgcgaaaaccaaaatctgaggatgcttggtatttgcatataatctgcatattctctctaggttacttatgatatctaatacaatgtaaacactatgtgaatacttatactgtatgaggtttttatttgtttttttaattgtatttatttattttttaatgttttccatcctcagttgaacccatgggtgtggggcctgcagatatggctgtaatttcatctttagtattgacataatggagcagctgcagtggctcctagtgtttcagaaatctgcctctgctcacactcagaaccaac

SEQ ID NO: 145399 - DNA, 271 bp, Homo sapiens
ggcagatgacttcttgaagcgttccgagggagaatgaatctcagtagtaagattcatttctcactcaaaacagtgcttcattataaattactgtccttttctatgccagtgacagattgcatgctgattgagacactggataaattgcaaacaaaaatggacctttgtcacaggccactaggaagtgagatggagttagcatagcatggatcctctctggaagggagcttccagccctaagggatggctgggatttatgagggtgcttcag

SEQ ID NO: 145400 - DNA, 193 bp, Homo sapiens
caccctgttgtgtgatcaaatagtatgttttattcattcgtttttttttttaacccgttaaccatccccaccttacatctcccctaccttcccaccacacttgtcatcctctagtaatcatccttctactctgtctgtctatgagctcaatttttttttatttttagatcccacaaatgagaacatgggatgt

SEQ ID NO: 145401 - DNA, 288 bp, Homo sapiens
gagaagctctgacatggtcccaggatgctaaatttggatataggggccagaggcagtggctcatgcctgtaatcccagaacccaccactcccaccttgggaggccaaggtggaaggatcacttgagtccaggagtttgagaccagcctgggcaacatggggagaacctgtctctacacagaatatttttggaggattgcttgagcccaggaggttgaggctgcagtgagccgtgattgcagcatcactgcactcccctgggtgacaaagtgagatcctgctaccaaaa

SEQ ID NO: 145402 - DNA, 305 bp, Homo sapiens
ggggatgggagccccgcccacatcctcccctccagccgcccgacctcgcctagcaggcccgggtcccggaagcccaggcagcgcccgagtccgcagctgccgtcggagctgggacgccgctgcctccagctctgggaagcggctggggctcacctggggaccacgtgcggaggtactagaaagcatgcaccgactagtcgccgtaccttccaaaaatacccatgggagtctgggcttccctgagtttagtgtaactgctgcccaaactgatgattaaaacactgagtaatcaccatttaccctga

SEQ ID NO: 145403 - DNA, 758 bp, Homo sapiens
atggactggtatcttcaaagcaaaaatctaaatgtctttaacatattctaattataatataaaagcattattcacaaagaaggttttttaaaacatatgaataatgtttggcaacagttcacattcaatgtaagaatcactaagactcctgagtagcagtaatactaaataataacataggccgggggtggtggctcacacctgtaatcccagcactttgggaggcaacgtgccgggggggtggatcatgcggtcaggagatcgagaccatcctggctaacatggtgaaaccccgtctctactaaaaatacaaaagaaattaactgggcatggtggcgggctcctgtaatctcagctactccagaggctgaggcaggagaatcgcttgaacctgggaggcagaggttgcattgaaccgagatcacgccactgcactccatcctgggcaacagagcgagacttcatctctagaaaaaaaaaaaaactaaataataacataaatgtttatttaataataaccactaacattcattaagttgttatctgaaggtactgttccaaccactttaaatgaatttatagaacctcacaacaactcggtaaattccattattatctttatttcgtagttgagtcttaggcatagagatcttacctaagatcatagagtgaattaagtatcaatatatgtttcatgtatttgtataacagaattttaagtttattttatgaagttatttaattgaacccaaaatatt

SEQ ID NO: 145404 - DNA, 335 bp, Homo sapiens
gaccgatactagagaaagaaggaaagaaagaaagaaagaaagaaagaagaaagaaagaaagaaagaaagaaaaaagaaagaaagctggcttaagggtttgaaaagtagtgtaatcaacgaacaaatgagttttgccatgacaaatttaattaaaagcctcattgatatttgaaataaaaatgtttttagttagcttccttttgaaaaatgattaacgtcatatagcttctttttcattctctctttcctctctccctttttctttttcattttttctctctctttttctttttcattctctctctgtttcctcccttccttctttctctttcttt

SEQ ID NO: 145405 - DNA, 467 bp, Homo sapiens
aaggctacttactgccaaagagaagtttcaaaattcatttatatagtgaacatttattgagcacttataatgtgctaaacacactgagatacaaagattggttaagtctttcttttctttctttctttcttcctttcttctttcttttccttccttccttctttccttccttcttttctttctttcttccttctttctctttctttcgaaagaaagctggcttaagggtttgaaaagtagtgtaatcaacgaacaaatgagttttgccatgacaaatttaattaaaagcctcattgatatttgaaataaaaatgtttttagttagcttccttttgaaaaatgattaacgtcatatagcttctttttcattctctctttcctctctccctttttctttttcattttttctctctctttttctttttcattctctctctgtttcctcccttccttctttctctttcttt

SEQ ID NO: 145406 - DNA, 776 bp, Homo sapiens
ctcccaggggcaggaaaacaaggagaaaccatcattgattgcggctgccagaagccgtcaccacctctcaggcccctcctcgcctgaccttggggtccagagagaggacatgccagtctccccactcccatggtctcacagcagcagctgcagggacagccaggctggtctgggatgggggtcgagggtgggtcctctctgccagctccaggttcagctgctgtctcagggttaggctccagctcaacccctggggctgctccctggctttctgagaagatgccgtcaggcagattccatctcataacgtttcctggaggaaaacgttccgacaatgagcgttccaacaatgaagggatctgtctctgatcctggggcctgctcatgaggaaactgagcctacccatggcaactgagagacaaagagggaccacgggacggtgctctaactcacccaaagaaagcacagagatgggcacaaaggtaacaacacgcaacactgagggatgcagacctgagggccccatccctcagcatccaatcccagtgcttccccttccggtgaagacctcctgctgaacagatgaggaacagaccagagacttgccctactccagtgggatgcaagcccatgcccacactgccagggagtggactgtcaacaacccaaggccaggtatgcagcctcagcaaggacatcagctccgctttggacacagcagtctcagccttgccttgagggtcatgcaatttgaggacatgccctcaggagccta

SEQ ID NO: 145407 - DNA, 341 bp, Homo sapiens
caagagcagcctgggcaacatagcaagacctctgtctctaaattagaaaaaaaggaaactaaaacaaatgaagagtatgtgagctagtatatgaaaagcacttacaacaaggcctggcagagaataagtgccagttaaatgctaaatgttattaagaaatggacagaaaaggacctcagtatagaatcttgcttgctccagagagtaatagtgataataatagtgtttggttttcacatttgagcacttactaggtacatcagactttgtctatggatatataccccaactatagcctacaaatacacacacatacatacacacacaccatctcaaaacag

SEQ ID NO: 145408 - DNA, 1111 bp, Homo sapiens
tttcatcgatatgcttctctataacgaatcacatcacatcccttctgtgactagcaaatatttcattttatagactacaataatcacctacaaaaaataaaattaccaactgtcatgattttgtttcccaaaactactggggcaaactactgaatgctagaactgttttctttctaatcagggtatacagcgcccaaacgacagcggtcaaccactgataataacaccacaaaataacaccgggtgcccccaaagccagagctctttgtggttccatcaagtatgctatcaccaaactacaatgacaggtcacgcaaggtgaaaaagctcccaaagctcaggaaaggactgacaaaataccaactatcctcaacggggtggtgatgacatcgtcccaacgtcccgctccctccctccttccttcccagagctatgcgggggctttctggagacccccctacccggaaccggaaaagcgaccatcttccctaaccccccggccggaagtggagcgtagccagccggagcactcaccctggaagaacaggacgcccagcagagggaagagagcgcagccacggcttccagctgctcctctctgctgcatcccggcagctcttcagatgcttgcacaccttgtttacagctcccggtaacgacacaggtaacaccggaagtgacgtcagagcaggaggccgagagacaacttaaatggcgatccgaagttaccataggaacctggcttctttccagaaccacacctggtttcactgaccagagatttattaactttcaggcgggagctaaatgctctcttttgcttgaaaatgaagtaggctacggacttggaataattacaattttgtttttatggaattctgcagaactaaataattttgatgctctgactgcatgtcagacatcgtttttacgtctcgagatttagttgaaggttctcagaatacactactgtaaatttagagttcagaaacacctgggagatcatacagtatagataaatatatattaggtgcttgtagtgatatgtgccacaagcctcattggttggtgtcctttttagtgtaagtattgcagcctccaaaattgggtg

SEQ ID NO: 145409 - DNA, 383 bp, Homo sapiens
acaagttggttctctatggggctctggggctgcctctggggctcaagctggggactggcagtcagcaacaggggagttttgccactgtttctgagctccttggcttccctgtccaggagagtccctgattactgagatccttggatgggggagatggagctcctgccctggagaggtcttgccttgaaatagaagataggccagtgaggaaggaaggtgagcagatggccaagctgagagggactttaaggatcatctagaatctagattccaggccaacccctccatttcgtagatgaggaaactgaggctcagaagggagaagtgactagtccaaaatgacatggcccataaatggcagcactcagacaagaacccaggtg

SEQ ID NO: 145410 - DNA, 308 bp, Homo sapiens
tcttatggaaggaaaactacatttgttaaatcacattatcgtaagttagacaaagatcatattcatattttaggagtagattccattctttcatggctaaagtttaatctagaaatacattttccccacaaactatctagtttctccagaattaacatctttctcaccaaacaatagtgtttctactataccagcatgctggatgatctatgaagagtttatactgtgtatcacatttactgactcggtaagatcacactgtcatatcatgatgtatttattaatttctcacactcccattttgaatt

SEQ ID NO: 145411 - DNA, 869 bp, Homo sapiens
gagacagggtctcactccagttgaccaggctagagtgcagtgatgcagtctcaactcactacagccttagggctcactacagcctcaacctcccaagctcagctgattctgccacctcagccccctgagtagctgggactacaggtgcatgccaccacacccagttaattttttgtatttttagttgagacggggtttcaccatgttgcctgggctggtcttgagctcctggattcaagcaatctgcctgcctcagcctcccaacatgcgggggttatgggcatgagccaccacacccggactgttattagatacacatgcttataattgttatttctttctgatgatagacacttttatcattataacatgtccttctttgtctctcataatttttatcttagtgtctattcataaattagtatagccactccagctatctttcagttagggttcacatgttatctctttttccatccctttattttcaaagccttttgtacatttgaatttaaagtatgtctcacatagacagcatatagttggattgtgttgtagttttcttttttaatccattctgccaatctcttccttttaatgaagcatttcatccatttatatttaatgtaattgctgatagaacaggatttatgtctgccattgtgctttgtgttttctttttcttttattttttctttttcttatttttttttgagacaaggaattataaagagttcccatatatcccctatccccacaaatgtgcagttgtcttttaaattagataggaaaacaaaatcattacaaacaaaaatacatttatgctgtcttttatgtttacctatgtagtgacttttaccagtgctctt

SEQ ID NO: 145412 - DNA, 330 bp, Homo sapiens
tggcctacctaggtcatgtgcttcaactccataatttcccagaacctcatggatccccaaggggaaatatggggctgttggaagacttagatgctgaagaaacagccaatgaatgtccagtgagtggcctttgagagtggcgtatcatctgagtgcaggagcttagaagcagctgcacattaagttgagagactggaggcaacatgtgtagaaaacccaaagagtttggctcaattttggtaaccaagaagcctatatgaaggatttttctccccaaaattaaggcaatatcagtgcatattcatacacccaagaaaagaaaccacaggg

SEQ ID NO: 145413 - DNA, 265 bp, Homo sapiens
cccagcctaaaaagctagacatggtggtggccacctgtagtcccagctagctactcaggaagctgaggtaggagaattgcttgaacccgagaggcggaggttgcagtgagccgagtccacgccattgcacttccagcctgggtgacagagcaacacttcatctcaaaaataaaacttgtctactattgcgattattttgcattgccgggttcgggcaccactggtacagattctgtgtcagctttgtgtgtctggtggggcagag

SEQ ID NO: 145414 - DNA, 477 bp, Homo sapiens
caggctgagtgcagtgacacaatcacagctcactgcagcctccacctcctgggttcaggtgatctgcccacctcagccttccaagtagctgggactacagacatgcgccagcacgcctgggcttgagcaattcagtttccctgcctgagtgttggtgacctgtgctgtgaaatagagagagacacctacgacctgctgtcagagcccatcaaggttatcaatactctggctgaccatcatcatcgtgggactgactttggtggaagtccttggttacgtatcattattgcatttccgagaagttataaagttgtccttaccctctggacagtttacctttggttgtctttcctgaagactatcttccagtctgaaaatggacatgatgtatccacagatgtacagcagagagccaggaggtccaaccgccgtagacaggaaggaaataaaattggcctgaaagacgtcattactcta

SEQ ID NO: 145415 - DNA, 507 bp, Homo sapiens
acaggatatcttttcctgtgctgtatgctttgtttcttcaaatggcaagtgagtttcttcttggaccagggcatgttacataggtccacagtgctttctctggaatggttggggctgtatgtgtttcagagttcagaatttttcagattttaggaagatagtacaatgtataagaggtgtattatgtaatccccaggtggggtctaggactgcaccctgtaatcaggcacattcacacagctctccagtgaaatgtgagtattcacagtaagggggaggagttaagattataaatagccatgactcagtttaggtcagattttgccgctcattgaattttgacatcgagcttaaggaaaacccagttttcataatgttgtggatttcagcattctggataaggaattacgaatgtatactgcatttcacattctgtaaccccaggctgtttcttagacttagcagttagccggtgggaagacctttgtgaacgtgagacatgaactg

SEQ ID NO: 145416 - DNA, 130 bp, Homo sapiens
ttgcttttgtgccctcctccccataaagaggttggggggtggggtgacaagtatttgccaggctggtatgaagctgaatcacaggaggctggaactgtacacagattgttggccaaagtcagagaagaag

SEQ ID NO: 145417 - DNA, 940 bp, Homo sapiens
ttatgatcataagtttcctatgatcccagcaatgacccatgactaaagttatggggatgaccattcccagtagctaccaaaaaaacccataaattccataagaagaaaattaacaagtttataagatctatatagaaaaaataaataaaagtaagaaagccttgctatagaatataaagggaaatgtgaatagatagaaacattaacatgttcctgaatgggaacactcaatactataaaggtgataaaagaaggttcccaaggggagccgtatgtgccatatattggaacatattataaagctacagaaactaaaactattaggttggtgcaaaagtaattgtggtttttgccattattttcaaagctgcatttacttttgcacaaacctgatatatgatataggcataccatataccaacgttataatgcagaattctgaaacagactcctttataaaggaaagttaagtttgataaagggggaatgataagtaagtggggagaggagaggcttccattgtattgagaccacactgaagatccctttaaaaatataaaatatataaatgtctaatggattaaagactctaacagagaaaacagtctgtaaaaatgctagaaaaaagtatcttgggctggatgcaatggctcacacctgtaattccagcactttgggaggccaagatgggaggattgcttgagcccagcagtcaagaccagctgggaaaccatctggaaaagctaaaatagtggcatggaggatgccagtccgctatagagcgagagagcactgaccaagcaggggggggacgccacgccactgagaagggccgtcaaaaaggggtgaaacccggcacaagccgttgaagcaaaagaaacagggccgaaaggcacaaccggtgcaccccaaatatgtacacacagactcaaccggacac

SEQ ID NO: 145418 - DNA, 762 bp, Homo sapiens
ttatgatcataagtttcctatgatcccagcaatgacccatgactaaagttatggggatgaccattcccagtagctaccaaaaaaacccataaattccataagaagaaaattaacaagtttataagatctatatagaaaaaataaataaaagtaagaaagccttgctatagaatataaagggaaatgtgaatagatagaaacattaacatgttcctgaatgggaacactcaatactataaaggtgataaaagaaggttcccaaggggagccgtatgtgccatatattggaacatattataaagctacagaaactaaaactattaggttggtgcaaaagtaattgtggtttttgccattattttcaaagctgcatttacttttgcacaaacctgatatatgatataggcataccatataccaacgttataatgcagaattctgaaacagactcctttataaaggaaagttaagtttgataaagggggaatgataagtaagtggggagaggagaggcttccattgtattgagaccacactgaagatccctttaaaaatataaaatatataaatgtctaatggattaaagactctaacagagaaaacagtctgtaaaaatgctagaaaaaagtatcttgggctggatgcaatggctcacacctgtaattccagcactttgggaggccaagatgggaggattgcttgagcccagcagtcaagaccagctgggaaaccccatcttgacaaaaaacgcttaaaaattag

SEQ ID NO: 145419 - DNA, 393 bp, Homo sapiens
gctgttagcacaagctgtcatatctgcaggccctatttcaataactgctttaagtatccagtgtgttaaatatcacacacttgaagactttacttggctggtatttactgaaggtgacagctagtaaaagttccaaacaggcttatgaaatatgcaattaagactctggagaggagacttgagaggaaagatggttagtacaaaagaagagcaaatctctggaagcttttgtttgatttgattaattaccttagatttacattggaggaggaggatctcaaaggcagagtttggagtgatggatgcctggtgactttgttctacagcccacctgtgatctaggagcttgagctcttcaggcagattcagccacagagatggtccgttccctgc

SEQ ID NO: 145420 - DNA, 432 bp, Homo sapiens
taaggaatatctctcctcctccattaaagtctaactagtcctgtcaataatgatcctgccttctctgaactccaaccatacatagaaaaaaatttactctttctgtttatatgtatattcattgtttccttaactagctaaagaaagaactccttgaatacagaaacctcactccacacttaggaaatgttttacctctcaattattttacaaacattaacttcatttaccctaattaagggcacatgccttgcagtgggaggaagccagggaagaatcctatcacttactagatgtgttacctttggcaaattatttcatctctcttggcctttttccttatccggataatagaactgtcctcatagagttattaatcagataatgcataaaagccccttagcatctacctatgattgataaatggtagtt

SEQ ID NO: 145421 - DNA, 336 bp, Homo sapiens
caggttctctattaaggttaatatcacttcagagctcactatatcatcttcttatttatagccagatttaggaaaagcagtgtatattaggctgcaatgagggaagctttttggattacttataggcagaaggaaagggaaatttttgtaatgcctggctgtacctggaagatagagaaaagtggaagaagtttgagggagatgtatgtgttcaaataaaaagatttctaagtttgaattagttgaactgtaagcaaaactagtaatgcaggtgtactgttctcccagtggggaagaaatgaagcggggaaaaggataattcattttgttgaccac

SEQ ID NO: 145422 - DNA, 468 bp, Homo sapiens
agggccagcaccgagtcctgaacatcctgctctagtcccacatcggcccaggggcgttgagctgaggacagctccctaccccctttctgtgcttggccgactccagcgcccgttcttctgcccctccttggctctgcctccccaccccttggctgaatctctcctcctttcgtgcttgttctccaggtgacttattcaggtccatattttcattacccttgcatttcattaattttctcatttattttattctgtaggtttaggacattctttaaaacatgcaggttctgaattttaataatataaaagtcctctgtgagtgcccatcacattgcttttctgtcctccctacattaaagttagcactgatgcctttatgtttaaggaaagcctcctgcagaggggctctgcccatgtaagttcattagaaggcaggtgtacagcctctgtcacctgaagacctcttaa

SEQ ID NO: 145423 - DNA, 134 bp, Homo sapiens
tttctattactgctcatggggtttctatgatgttaggggagggatgcttgaaagcatgacaccaatattatcctttaaaaaaaagagtagggacctcaaaggatcttgtggaactaccttactctttcaagggt

SEQ ID NO: 145424 - DNA, 288 bp, Homo sapiens
gtggctacacgaaaccacaccgtgtgccaagggaaagggcacacctcagctttccacactaccctcccatcccccagttcctcctggggccatgtggaggcagaccacgggcaagtaggatggtgtgagagtgtggtgttcaccctctggccaaggccacaagcagcttcagtgggggggctgatagcttctctaggcaagaggagccctaggctggcaagggctggacacaggattccacgccggcaccatcctgtctcagggcagagttagataagctactccgag

SEQ ID NO: 145425 - DNA, 561 bp, Homo sapiens
gcaggcaactcgagtttggctgagaaaagaaaagagagatgggtagtagctggaggggatgtgggtttcagaaggtacatatgtatacatgtacagataagagacttaggcatccttaactgctgaaggaaagacaccagcagacaagtggaggccagatgcataggccaaataaacagtggaacaaggcccataaggttcctggagaggaggcaggtgtgacccacagcacagctggcacgctgattttcagtcaagaggaaaagcaatgagaatggctgtggaggaagggattatgtttagtgctgcagaggtcaactgacaaattgttattattattatttttgagacggagtctcgctctgtcgcccaggctggagtgcagtggcgcgatctcggctcactgtaagctccgcctcccgggttcacgccattctcctgcctcagcctcccgagtagctgggactacaggcgcccgacaccatgtccggctaattttttgtatttttagtagagatggggtttcaccgtgttagccaggatggtcttaatctcctgacc

SEQ ID NO: 145426 - DNA, 570 bp, Homo sapiens
aaatgaataatgaaatgctgggtgtggtggtgcactccagcttgcgcggtagagtgagtcttcatctctaaatgaaataaaatgaaatgatgaaatgaataatgaaatgccaggtgcggtggcgcactccagctttgggcaacagagcaagtctctgtctcgaaatgaaatgaagtaaatgaataatgaaatgccgggtgtggtggtgcactccagcctgggcgattgagcgagtttccatctcgaaatgaaatgaaacgaaatgaagaaatgaaataatgaaatgaataatgaaatgctgggtgcaatgaaatgaagaaatgaaataatgaaatgaaatgaataatgaaatgtcaggtgcagtggcgtactccagcctgggtgatagagtgagtttccatcttgaaatgaaagaaatgaaatatgaaatgctgggtgtggtggctcacacctgtaatcctagcactttgggaggccgaggcaggtggatcacctgaggtcaggagttcaagaccagcctggccaacatgatgaaaccccatctctactaaaataaaaaaactagccggg

SEQ ID NO: 145427 - DNA, 477 bp, Homo sapiens
caaacaaaaaaagggtatcctgcttaacggtttagaattagttggagctgagtcaattctccagactaagattaaaacagccttagtttctaaggaaggtgcatttgccactgcttggaaagggtaacctgacaaagccgctagccacagcccctggggacaagaagactggaacaaaagttcccaaacctggccagtcaacaaagtacccaaagaacttaaggtttttttcatgtaacaacagtccctactctatccccaccctatccacttcccctgactgcaagattctgaatgaaaagataaggagtagggtttgagaatctgcatattaaagctctccaggtggttctaatgattaccagattgggaactactaaactaaggcatttgcccttctatttcccaattttagcctctcttgggttagtcccagtgttccaagtattttacaagaacgcaccgggggtacaaaag

SEQ ID NO: 145428 - DNA, 428 bp, Homo sapiens
tttttttgagacggagtctcgttctgtcgcccaggctggagtgcagtggtgcgttcttggctcactgcaacctccgcctcccgggttcaagcaattccctgcctcaacctcctgagtagctgagattacagacatgcatcaccacgcccagctagtttttgtatttttagtacagacggggtttcaccatgttggccaggctggtctcaaactcctggcctcaagtgatctgcctgccttggcctcccaaagtgttgggattacaggcgtgagccacggtgcctggccatatttttaaaaatattaatagagcctgcatttcattacctttccacttggtgattccacacacatataggaaatccaaagtgtgatattcattcactgcttccgtgaataaaacaactacttgattagaaaaaaatgac

SEQ ID NO: 145429 - DNA, 156 bp, Homo sapiens
acccatatcacagagttgtggcaatatatataatctgccttaggacaatgcatgaagtatagcagatgctgaatgtcttaggggatgtaattatatcacctgtattttcacctgctgtaatttacctgtgtttgccccagtcatcaagccaaaata

SEQ ID NO: 145430 - DNA, 393 bp, Homo sapiens
acatgtgattcttctgcctcagcttttcgagtacctgggagtacaggagtgcaccaccatgcccggctattttttttgtgttagtagagacggggtttcaccatgatggccagactggtcttgaactcctgacctcaagtgatccacctgcctctgcctcccaaagtgctgggattacaggcgtgagccaccatgcctggcctcccaaaaggaattctaaactctttgagggaaggatctatcttatacatctccatatcctctctggcaattaacataatattgcgtgaacattctagactaggaaggcagatgtgtcatactcatgctataatttctctatgctgtgcccatagcgaacattgctgattggtcttagaatcttttcccact

SEQ ID NO: 145431 - DNA, 577 bp, Homo sapiens
cacagtggctcacctctgtaatcccagcactttgagaagccgaggcaagaggttcatttgaggccaggtgtttgagaccagcctgggcaacaaagtgagaccccatctttacaaaaaaatttaaaaattagcagggcaaggtggtacacagctatagtcccagctacccgagaggctgatgggagaatcacttgattgcccaggagtttgaggctgcagtgagctatgatcatgccattggctaggcaacagagggagaccctgtctcaacaaaaaacaaacaaacaaaaaaaaagatttaataatcctaatacttatctgcaaattcaaaagaaaataaaacaggccaggcatttgagaccagcctggacaacataaaaagaccccagtctctacacaaaacttttaaaaattaaaaatagaaaacacacaccacctttgtttcctttaaatccaaaatcagaatcagtcctaaatactgaaacattaactattctcctaactctagtctagaaaaggggagctatcttagttgaagatgaccctcccaggaatgacaaacacaagatttatggca

SEQ ID NO: 145432 - DNA, 482 bp, Homo sapiens
ttgccctctcctcacagttcagacacaccaaatgtctcactagctcctttggtgcctctgtgactagaataccatcttcccacttcccctaggaacaaaatcctatttgttctaccagatcgaacacaaatgtttcctcctctgggaagtcttctcctctccctagtggcgggactggagagtccccccatacagtctcggcaccattcacgcttctctatcacactttctttttttttttttttttttttgggaggggacaaggtttggctcggtcccccgggtgggatggcgggggcccagattacaggctcactggaaccttggcctcccgggttacaagcagattttggggcctaagcctctaaagtagctggaattaacgggggtgtgccaccaggcggggctaatttggggcgctttaagaaaagaggggggggtcccatgtggcccaggcgggtcgggaactccgggggccaagt

SEQ ID NO: 145433 - DNA, 1297 bp, Homo sapiens
gggccacgcggaggctcacgaggaggccggcggccacgcgcatcccgtagcccaggtggcccagggctgcaccccggcggcctcggcgccatggagtcctggtattcgctgatggcgcactacgatgagttccaggaggtcaagtatgtgagtcactgcggcgcggggggcgcttgcggggactttctgcccgcaggccaccgggcccaggccgggctgcagctctggaagcggcgcaagttgaacctgctgtcgggctggtgtttgcagccggcctctgctccatcctggcggctatgctggtgctcaagtacctgggcccggtcgcggccggcggcggagcctgtcctgaaggctgtcctgagcgcaagacttcgcgtgcaccgctcgcttcttggccgccaacctggacgccagcatcgacccatgccaggacttatactcgttcgcctgcggcggctggctgcggcgccatgccatccccgacgacaagctcacctacggcaccatcgcggccatcggctagcagaacgaggagcgcctgcggcgcctgctggctcggcccaagggtggacccggcggcgctgcccagcactaggtgcgctccttcttccgcttgtgcctcgagatgcgcgagatcgaacgactgaacccgctgctcatgctggaggtcatcgaggactgcgggggctgggacctgcgcggcgcggcggagcgccggggggttgctgcgcgatgggacctcaactggctgctgtaaaaaagtgcagggcgtgtacagcgccgccgcgctcttctcgcttatggtcagcctggacgacaggaactctttgcgctacgtcgtccgtgtgagtgcgcgcgttgagcgccccgccagctgccgtagacccggggcgcagtggccttgcccaggggtccctgagggcgggaggagggtgcgcgagaggagaggaagggaaagcaggggaggggagggagcgcacagtggcagcgcgcgggaggaggtcataagtaatttccccggggtaactgcggtgttcagcggtgcagccatttcccagccctctggcaggcagtggggagcgggtggggtgcgcggcaatatattcaagcttatgtacaaagcatttgaggtctagttgaagaaacaacttgaagaatggtctcgcagcaattacaaacaaatacccttcagcaattacaagaaggctttcaatgactgaacccgaatacttggttgtctgggttaaacatacgcatttgggtgatggccgctatattcttttttgtatctgat

SEQ ID NO: 145434 - DNA, 272 bp, Homo sapiens
agagagtccttctaagaaaaggagggcatcccgaaagcactcagctttaacttagtggcaggcagggttggattgacaggcccactggagcagctgacatacagaattctcattccattttggtcacttccctctcactcactttctggaaccctgagggcctgtttttctactccagagtcactgcacacaacctgtgtatccctgtgatcggaaagatgagcaccatgccaggactgcccacccgggcctgcttttatgacatagatctt

SEQ ID NO: 145435 - DNA, 268 bp, Homo sapiens
tatgattggctttcagtccaccatttacattattaacctttaaaaaaaattccattattttttaaagagatttaaataatatgaaaaaatgtatgtatttatccacacagttgccatttctagagctcttcatttcttggcgtgatccttgtcttcattttccttctgtctgaaggaaaccactcaacatctctcgtagtgtgtatccggtaatgacttctttcacattctgtatgtctgcaagtatttttttccttcactttcgaaa

SEQ ID NO: 145436 - DNA, 411 bp, Homo sapiens
gaaatattattgggtaaataacataatgtccaggaatggaggagaaagataaaattggcaaaatgttaataatatttgaagcagataaagaatatatggagttcattatacagatgggaacaatggctatcattattcataatagccaagatactgaatcagttctcctgacttttgtgcatattttgaaataagaagttttttaaattaatatttattgggtatctactgagtaccaggtattgcttaggtatttgacacaaaaataaaatggcctcaagaaaaaaaaaacagtaaagcagattcttaacccagggtttatccagggaaatatccatgatttctatgggtggctaaatcacaggtactgccattactgctgttttattgcctatattcataataaaaaag

SEQ ID NO: 145437 - DNA, 727 bp, Homo sapiens
ggaagaagggagctccccccttctatttgctttctgtttctaacaacgatggcacagccgtggttttccagaagctgagcagtggctgttcactcctgaaggaatagtgggttccagggtgcggttttccacacttgtagaaccagcttcatctctccactcaaagatcaccgcaccgtcagccggtggcgcctcttcagaggtttgaatccgagctctgtggagtccccacatttctgaggtaccagttaccaggagagtggtgtccacgcctgagaggtttcactcccagctcctggaaaagcttccacattttaatgatcccagccttgcctctggttcccagccctaagcgtggcggcttcctattgcagttatctctgtgatacctgagagtcccctttttgcctcctacctcttcactatctgttgacagttgtttgttcaatcatctctcttagaataattgctatggtcttggtccgagatataataggcaaccaggttttcagctcctggaaaagagccatgagacccaggtcctcttctacgcaatcccaagctcaggtggatttttcactagctttcctcaatacaacatagggatccctccctagatgatgtgattcacccccgtggggatagctgcgagattaggggaaactgatgttttacctacaccctggtcatgaagaccttgctttgctccctccttcattcctaccct

SEQ ID NO: 145438 - DNA, 147 bp, Homo sapiens
tcttatggaaaaagataatttaaaatattctctaaaatgaatggtttttcttttttcttaagagatggggtctggctatgtttcccaggctagagcacaatggctattcacagatgtggtttagcacactgtggactcaaattcctg

SEQ ID NO: 145439 - DNA, 243 bp, Homo sapiens
ctgtaggatattttgataatgaaagttattctgaagaataagtatcatggaaaaagactaattgtataatatatgttaagaaacggccaggcacggtggctcacgcctgcaatcccagctctttgggaggccgaggcaggcggatcatgaggtcaggagatcaagaccatcctgcctaacacggtgaaaccctgtctctactaaaaatacaaaaaaaagagaaaaaaattcgccaggtgtggt

SEQ ID NO: 145440 - DNA, 258 bp, Homo sapiens
caaatgaagaggacacaggagaggagatctgggtggatttcaaatactttttcactgaagtagtcattcatttatggagtaattacttactaatgaccatccgtccaaagcatggatggggcaaaggagataaaagaatgactcagaggtcccctggacctcaaggagcttgtgctctgctgagatgggaggcaaaccccagatagaggaagggcagagagtgtggagcatggatgctggagaggacaggatggatgc

SEQ ID NO: 145441 - DNA, 373 bp, Homo sapiens
ttttttaagacgtagttttgctcttgttgcccaggctggagtgcaatggtgtaatctcggctcaccacaacctccgcctcccaggttcaggcgattctcctgcctcagcctcccaagtagctgggattagaggcatgtgccaccacattttgtatttttagtagagacggctttctccatgttagtcaggctggtctcgatctcctgacctcaggtgatccgcccacctcggcctcccaaagtgctgggattacaggtgtgacccaccgcacccggccccattttacatttttaagtcatacacttctttctaatttttccatagctccacattactaaaatcctgactttgttagttacttaccagctaatt

SEQ ID NO: 145442 - DNA, 349 bp, Homo sapiens
aggactaattttaaagaaaatacttcagtcactgagaagtatatggatcacaacataggggttgcacaaatgtcagcaaatcactgctactaaaaatgtagtaattaaagggtgttatagagatttgacaaagaaaataggtattaatgttatttttctctcaagtaaaaattaggtaggccaaacaggtaatattttaagttaaaatatcaactatacagttctgtttagttcagagtccccaaaacttcagtcagctgagtgtaacatttgtactttctccctatcctcatactagttttcatgctgatttttaaaatcaacacactttttaaaaaagcataagtaa

SEQ ID NO: 145443 - DNA, 414 bp, Homo sapiens
ccccgccccagcttctaactggttttgcatatgctctgtcttcagtcccctactcaggaactcccctactcaggaaccttccgtggctccagtgttatcaacaggaacatgtcagaactggggctaaaatgcaggctggtttaaatacctgtctccccccacccccgcctcttctcacaaaactgctgggctagtctctttagcataccaaataatgttttcaggcctttgtctatgctattgcccctatctgcatacttttttttttttttttttttgagacagagtcttgccctgttgcccaggctggagtgcagtggcatgaacttggctcactgcaacctctactactcaggaggctgagacaggagaatcacttgagcccaggaggcagaggttgcagtgagccgagat

SEQ ID NO: 145444 - DNA, 150 bp, Homo sapiens
atttgcgattctcactcttctaacacatcctgaccttttgtggcttcctgcctttgtccttgcggtgttggctgccggccataccctctcatcttctctgcctgtagaaatcctaccattctgctgacctcagctccagagtcccatctg

SEQ ID NO: 145445 - DNA, 400 bp, Homo sapiens
gcatacaagaggaaaatgttgacagtcaactcatctctaccttgccatagctcccttgtctatttattttttggacacagatggctggcccaagcgagcacacccaatatccactagttggtttcagttaccttctgtcctggaagaaggttcttatgggcatcaacatgtctgtttagctccttaaattaccatagtggttttcataggttcatgccccatgtgggtataccctcaatagccctgtgttctgtctgaccatgtggcaagccatggctactgcccatgaatatgtatatgctcaaacttcaggactcatattgttgcctatatttttttcattatgaggaaaacagtttacagattaggacactgagctgatttactcttaaccttcttt

SEQ ID NO: 145446 - DNA, 207 bp, Homo sapiens
caaggaggtgaactttcaagaaaaataagtgcttggaatggaagaaagaacatttcatgtgagaagacaagtacagaagtagagagtaggagaggcttggaggggaaataataaataatccttacatgatgcttgtttatgcttgctaaatctttacttcagttagcacaaagcaggaacacaaatacatgctattgcaatttgaaa

SEQ ID NO: 145447 - DNA, 993 bp, Homo sapiens
ttgggacttcccttctccctgtgtctctgctcttttccggggcgtggcacccggtcaaatcgggggaagcgaccttctcccaccggatgggccccctctatttgtctagttcccgtgggaaaggcatatccactgggccaacttttttccagcaattctggtggcagccagagcagaactcagcctctagcagatgcccaagaagcagaggagaagcagagtctagaagctcccctcctggtgtggagcctggggtgtaaagggtacttagaaagcactggtatgaatgccctgtttattcatcacagtcctctcaagcattcagtcattcagcaaacatcgatcgagcaccttctctgcgcctgaccctgtgctgagcaccagggcccagatgaatgagacatggtccctgcaaatgcacacacataccttttcccataatgagaaagggctgagtacaggggtgagatgggacaggcagggatgcggtcaatccaacccaggtggaggagaaggaagactttccagagaaagagtcaacaggttggtctctagcaggccagtgctcagtgcctggtggatgcctggtatgcatgtgctaaaagactgaccaaactagacttagaagcaatagaactctacctggaggcactgcagtgaagtccctccttcctggagggaacgagtctctggctgagcacatggtgaggcaccaagtggagacagcttcctgtgtgaggcttacgggagcccagccctggcctgggattctaatagcagtgggcatgaccctccagagatggcagctttgccatgaccggcctctcatcatcatgtgtgtggactcccgctgaaaggtgtctgcctggaggagcctggaagagagctcacctccagccttgatgaagtggcatctctttggcacttggcctgacttcctagacctccctggggctggaagagcctgctaggggtcaatatgtactgaccctc

SEQ ID NO: 145448 - DNA, 405 bp, Homo sapiens
tctaggcctatctgattccaaagtggttgagggaaggagattcagtgataactagagtagtagacatacagggctgagcaaattccatgtagattgaatttcttcttacttttgagtaatcctgagaacaggaaacatgagattactaaacgtttccattttctacagaaaggtgcacaaacataacatgattcattggagaaggagatttttttttacacgttcatgtatagagttgatgactttaaattattccaatgttctatcaacagaagtgtgccaaagaatgtgttcaatgccaaaaatacagaaatgaattaaacctggtctttgatctcaagggggctcataatccagtgacggagagagtgctagtctagcgaacagatgatgggttggaaaaat

SEQ ID NO: 145449 - DNA, 329 bp, Homo sapiens
catcccccaccaggaccccatactttcctcccatgggtttcctatggaatgttgctgcttcaacttctgagagcctcttgctggggggccccatccctagcccttgcctccctgtgctgctttaccttctttttgggaggataactgccctctgttttcagcaccccaataagaaagaaaaagtcatgaccagaagtcagtgtcagtgattgctgatgtgtggaaacatctgatgaatgaagagtttgggtaaaaaataaagggaactgatgaaaaccacttgtgtgtgaagcctatatagtggtgtgtgcctgtagtcccagctactc

SEQ ID NO: 145450 - DNA, 137 bp, Homo sapiens
agacctcaattaattgcgcgttgaagagaggaaaagtggatttggttttatggtgtgtggaatagaaagggagaattaggagacttgattagcttaggcttaatttcctagtgacctccaaatgtgcgcattctatt

SEQ ID NO: 145451 - DNA, 714 bp, Homo sapiens
ttattacatttgacagtgtctcaataataagatatcattaaattcgttttggaacaagacaaagaatgttggtagagttgttggaagaaaaaggcactgatactactgttatttctctttagattaatgtggccaaattaattagaaacacagtgttgctctgttgcccaggctggagcgcagtgggaccatgtcggctcactgcaacctctcctttctgggttcaagtgattctcctgcctcagcctcctgagtagctgggattacaggcacctgccatcatgcccggctaatttttgtatttctggtatagatggggtttcaccatgttggccagaccataatactatggtattatgtggtcatgagttctaaggtcaaactgtcttagttgttaccttggttctgccaccaatctgggtgacctttgttaatttagctcaatctgtccaatttttaatttccttgcatataaaatgggatataattagttacccaagggagtatggtaagggttagaagaatctgatatatatttagtgcccagtaaatggtaacattgttaaatgggaggaaataatgagaggtcaggaagatctatgcattttagttttctcataattgtagtttagatgcaagtgttacccatactgatattatatagtcttagattttttttatttaagggtacacatgtgattattttacttagtt

SEQ ID NO: 145452 - DNA, 403 bp, Homo sapiens
ttcctgtaaacttaaataaaattattattttctctttttgctgtctgaatgcatcactgttattttctgctactgatttgagggtaaggtggggtagtaaaaaaatgttctcccactattgcaggcatctgaaatatgaagttagagaagtaagttatgctttttggctttatttccagttcacactcccagttcctgcttcttgaaaactaccaatgtgatcaggttcttccatatatgtcttcagagacagtctaccatatacaaacaaataggaatacatacacattttttcttcttatacatcaattgtagcatgccatacagtttgacaccatgcttttctcaataaacattattatgccttagagatcttttcatctcagtacctaaagcacttctt

SEQ ID NO: 145453 - DNA, 146 bp, Homo sapiens
atgatttttaaattaagttataaacatcagtatactttatctctaaacacttcagcataaatattcatagaggtttttttttttctttttcttgagacagggtctcactctgtcacccaggctggagtgcagtggtgcaatcatga

SEQ ID NO: 145454 - DNA, 171 bp, Homo sapiens
ctaataaaataatgatgatgaaagtactataaataattgtatgccaataaattggataacctagatgaaatggaccaactcctagaaccacacaaaaatatgagtataactataatcagtaataagattgaatcaataaaagcatttgatgaattcaatattttttcataa

SEQ ID NO: 145455 - DNA, 356 bp, Homo sapiens
ctttattagttttgtagtctgccaagtaggcagtcctgctacactgcctggagaggtgacagtttatgccagaggagactgaggggagtcctttattttacctttacttactcaatctgggagtcagattaaaatttttttctatggtgttttttgacttttagaacttttccgaaagttggattttggaaaaaggtggaaagtgttttatgaaagttggatttcagaaacacttcgaaagtctgtaaagtgatacataatctgttctctctatatacagtaggaaaaggatatttttcagcaaggatgcttgtaaccttcaaacttcggccaaatttgtaatatagtgggcactt

SEQ ID NO: 145456 - DNA, 500 bp, Homo sapiens
gggattacaggcgtgagccaccacacctagcagattgtctgtcttttatgcaggtggccagaccagctccccctcctgggcttggggctatgcgtgtaccctcaaaccactcctcttagctcccctcttgccccacacaccccagagatagccacttgtttctgcagtgggatacatgttgagcaaaatagggcttaagtcagagacctgcagctctccactagacaccacaggcctatggtttcttaccctgaggcacctgcctcacacaggccctagagacctagagagaagccagccctgttccagctgttcccacagcgtgcggtcactcctccccagccagccctggggagctttccatgcctccgggttttggctctgcagggacagagggccaacctctagcctcctgggctgggggaaccacccaaacaggagttttcttccctgctctgtgctctgtgaccatgggccagtcactccccctccctgggcct

SEQ ID NO: 145457 - DNA, 453 bp, Homo sapiens
acatcatgctaggggctggggtgggctgcagaataagtccatggcatggtccttgcctttagccgacttccagtcctctggggaggacaaaagtacacaaccgatgtgagagctagcctttaataaggatagattcctacaaggtcagagagtacccagaaggcaggaagcttagtggaggaggcaagacatgacacagggcctggagaatttggagtgggaagctgtctgctaggcagggaatatgggcttgaagagatagagacagtcaaggttctgggagatcttgaaagccatgttgatatagtcacaggagagggaggttcgtattcttcatgcaagtggcgctcagtaaggacagaaccatctaaagaagataagcctggctgtagctccacaaagaacagcctgacccctaatcctggggtctggggctggggctgggctcgtgac

SEQ ID NO: 145458 - DNA, 330 bp, Homo sapiens
tcacattcttacattagctggcccctgtctacttctgtggatctcatttcagcactactttactactctcttggtcattttctatgcttaagccacagcggactttgtatttctcaaatacattaatctgcttatcctttgtgactcttgtactagctgtttcctttacctgtaattctgtggcccacatcttcccatggctggctccttcatttaagtctcagcttaaatgcctctaaggtcttttttgaataaactaaattaatgtatttagtcaaataatatctttttttaatagcacttaccacgatttgaaattctttggtacaa

SEQ ID NO: 145459 - DNA, 396 bp, Homo sapiens
aaagcctgcctgcctgctttgtgtgtgccttccctttttcttgcagtggccctgtgggtttgcatggccctctgtggccagcctcaggatctagggtcctctctgcttgtagtataagctttgaatgctgtggcccggagcttttccacagcctgtgtttcctgcttctggtctgctctagagaaattcaagtcaggtttggcctggcttggccaacccgagcttgccatgtacctgagtcccaagggtgtctgtcccctaactctagccacctgttggggaggtaggaaggtctgggagggagatgctgaggagagcagagtcgtgtgcagaccaggtgggactggactacaggagagaccaggtgggactagactacaggagagccctgggggg

SEQ ID NO: 145460 - DNA, 734 bp, Homo sapiens
aaaataaattctcaagaatagcttaattagttttgagaaagaagaacaagataagagatttgctctgctagataacagaacacattctaaagctattataactctaaaaaatgtagtattgatgcaggccaaacatatagatttagtggaactgattcgtgagtacataaagagataagattcacttgtctacaacgtgcaccttgacttatgatggggttacatccctaagttgcaaataatgtaagtgcaaaatggatttaatacacctaacctactgaacatcatagcttagtctagcctacctttaatgtgctgagaacacttaacattagcctacagttggtcagaatcatctaacataaagccgactgtataataaagtattgaatatctcatgtaatttattgaatactgcattgaaagtgaagaacaaaatgattgtgtgggtactcaaagtatgctttctactgaatgcatatcacttccatgttagctgaaaaatcctaagtcaaactctcataagtttgggacaatctgtatatgggatttggttttgactgaaggtagtgtttcaaatcagtaggagaaagatttgtactaagaaaattgaccatttggaaaaaataaggctagctcttgtaacctcatttcattcacaaaactaaattctacattgattaaagaactgaatatttaaaaataagtaaaagtgtgaggtctataaaatataa

SEQ ID NO: 145461 - DNA, 633 bp, Homo sapiens
ggttcggttcaagtcaacaaacaagtgaagcagcagtttctgtgtgctggagtatgcagagagggctaggacttagcgatgcggtgggcacagactatcttcacggtcactttgaactaatcttggggtgggggttgaacaaccacaaagaaagagctctgctatccccagtttcaccctatgcccttgccagaagcagttactctctgacaaacaaatgtctccctgtgcctcaaagctgacacatctacagcaaggcttatgtgtgctgaagttaacatcccaagaatatcctggaagctgcacctgaagagctttccagcagaagtcaaaaagcacttttcataccccagatcactagtaaaatgaagcagtgcttagcattttaatacaaggcaatatcaagatttcaggtcaactaatatcctctattttattacacgaaataaaatatattctattgccagcatgtattagaaatttgtgcaattggagagacctgaagtcttcaattttccatgcttcagctattacttttaaaaataatatgaagtgttggatatggatatagaagaaagcatttaaacactcatggtctagcataataaagagactttcagcattgacacttat

SEQ ID NO: 145462 - DNA, 465 bp, Homo sapiens
aaaagggaaaggttaaggagaatgtagttaattctaccagaagaaactacctcagtattctcaggctgcacccatagtacctgtggcactaaaatcttaggatagaagagtgctaagaaggaagaaagaataataaaaataatgttttgtgttttttcctcatattagtgataatgaaaatgtgtttaaattcaggcctcccataaagtattgcgtatcataaagtctaaggcaggtacctgaccgtgaaaaactacattttgaagcactgatgactgataagagagacacaaaatgtttaacctgtaattttggtgaagccattggaaattagcaaacctacactatgttttctctacatttggagactattcatctgttaatgtagatgcaaaagaaagtcttattcaaggactccaaagacatatttaacacaatattaaacattgaacctgcattttaagc

SEQ ID NO: 145463 - DNA, 476 bp, Homo sapiens
tatagatgcgtatgctagatatctggatcttataatagactgtatattcctctgagtagataccacagtagtgtgactgctgtatcatatggtatcctaaggaatctccacattgtttcccatagtgattgtactagtttacattcctaccagcagtgtagaagtgttccctgtttaccacatccacataaatgtctattatttgttgttttatgtattatggccatttatgtggatgtggaaaaactggaaccctcatacaatgttggtggcaatgcaaaatgctatagccactttggaaaacagattagcttttcctcaaaaatgtaaatataagccagaggaagtggtagaatgcctgtagccccatctcagctaatttttgtgtttttagtggagacaaggtttcatcatgttggccaggctggtctggaactcctgacctgaagtgatccccccacctcggcatcccgaag

SEQ ID NO: 145464 - DNA, 216 bp, Homo sapiens
agctttgcccttcatttggctgcagctgctaacttaagggaagagagaggctcgattggggcactcaggaagtgggcaggtggggctctgggtgccctacccctacttcagccgcagcaactcagctttcacctgtcatgggactggacttttgtgtaagatttcttttaaaggattcttggttaggcacagtggctcatgcctgtagtcccagca

SEQ ID NO: 145465 - DNA, 209 bp, Homo sapiens
caggcaaaatccttaactagtttttccctaagtgcaatactagatccctcattcatgttttgcagcaatactgacatgctttattcacaggttttctgcttcgtaatgaagttgtcattgcctggtccttatattagaagacgtgtttgcaaatttggactgaaatggatacaaaatgcaatagtagtagttgtattgaaaatatattg

SEQ ID NO: 145466 - DNA, 419 bp, Homo sapiens
agggctaacgtcagaggcggaccccaaggacacgtgggtatgctcagaggccagcatctgacatcgaggcagcaagtgaagaagaaaggcctcccaggaggtgggtctcgccatctggttctgggcaggtgacctctggaaagctacgtgttactccaaagctcagtttcttcctctataaaaagggtacaataaaagattctctgtctcatgtggttgctgcagggaaaaaaatatagtaactatggttggacaactgacaatgaatagataaaatcagccaaggaataggcaaaaagtgttctttttatttttatcgagacaaggtctcactctgtcgcccaggctggagtgtagtagtgtgatctcggctcactgcaacctccgcctcccgggttcaagtaattctcctgcctcag

SEQ ID NO: 145467 - DNA, 549 bp, Homo sapiens
tgagaaagggccatgtgagggtgcagcaagaaggtggcagtctgcaagccaggaagagagtcctcaccaggaactagtcctgccaaaccttgatttgggacttccatgctttagaacaccgagcctgtggtactttatatggcagcccaagcagaagggttaaagacattttagggattgtaggaagagggatataaaaaaagtagaagcaggatcctcaacctcagtgtaatcaatgtagttagtgttggctctctctgtgatttgagatctgactctgcaggcccacctctggaggcacagacttaattgagctagaattttttttttttttttttaaggcatggtctggctctgtcgctcaggctggaatgcagtggtgtgatcatggctcactgcagccttgatctctcaggctgaagtgatcctcctgcctcagccttctcagtagttgggactataggcatgcaccaccacacctggctatttttattttcattttttgtagaaacagggtctcactattttgctcaggctggtcttgaactc

SEQ ID NO: 145468 - DNA, 357 bp, Homo sapiens
taaataaaaagccataaagaggaataaagtattgatcctgcagtatggatgaaccttgaaaacatgaggctaagtgaaagaagccagacacaaaaggccagactgtacaggactccactcctatgaaaagcccacagtaggctcagaaatagagacagaaagcagattggcagttgcttaaggctgggagttggggcaaaggaaaaaagtagtgactgctaatgggtacagagtttctttttggggtaatgcaaatgttctaaaactgactgtagtgacagctgtacagcactgtgaatatactacaaaccgctgagctttcaatgaataaactgtatggtatatgaattatagctc

SEQ ID NO: 145469 - DNA, 532 bp, Homo sapiens
tgcactccagcctgagcaacagggcaagactccatctcaaaaaaattttttttggatttatatttactgagagggtctgttactaaggtatttagatttggttggatttaactgctaaaatgttgtagagtctgaatctatggcatggtaaagaataatcacagccattcagcaagttgtgaagcttctggttgggatgaaagaaacttcaagctgagaggaagaatgttctgaaatatttgggaggtttggcagactcctttctcaggggtatgttcatttgggccagtgattctgaagcccactttgcagatatcttaggtgtgtcatgaagttttacaagaacattgtgagtagttgcaataacaaaaggaaacaaatgtttcatattactttccattatccgtgtctcaggtattcttccagagatactttagccatgtgtaagtgaatacacttccatacaatatcatgcgtaaaacacatgacattctgaaccctgccgtttttattaaagaaaatttcaaatgta

SEQ ID NO: 145470 - DNA, 386 bp, Homo sapiens
ataccccaaatatatttctgggtaagaatctttgaagcctggacccagatcataatttaaggtcttggcctgtctcttatacattaaaatttaagacataccagccaattcatctcaaccttattcccagtttataatcatttttctctcaacttctggcctatattacttagtcctctaatccttcaaattagaaaactcattcgttcatgcaataaatacttatatacggtttaatttgtgccatgctaagcagatggatatgcaaagacaaactctttaggagttcatattagtgaaatctagacagagctcaactatgtcaggacatgagtgtgaggaagatgtgattaaatttcttgatcagatgaccagtgagccagaca

SEQ ID NO: 145471 - DNA, 333 bp, Homo sapiens
tctcactctgtcgcccaggttggagtgtactggcgcgatctcggctcactgcaagctccacctcccaggttcctgccattctcctgcctcagcctcccaagtagctgggactacaggcacccgccaccatgcccggccaattttttgtattttttagtagagatggggtttcaccgtgttagccaggatggtctcagatttcctgacctcgtgatctgcccatctctgcctcctaaagtactgggattacaggcgtgagccaccgtgcccagccctaaattgaattcttaaatccctcttgttcataaagcagtatatttggtttacaggaca

SEQ ID NO: 145472 - DNA, 459 bp, Homo sapiens
gtcttgaaagaatccacttcgtcatccagatcagtgatgcagatggcaatatttgttaagaacggctcttcctgtagttctaagaaattatctgactagaaagatgacaggaaaagcactattatgagactgcccagtgataagttattctgggcacccatggtaatgcgctgggccccaaggtattagaatttagtaacagcggccgggcacagtggctcgcacctgtaatcccagcactttgggaggctaaggtgggcagatcacctgaggtcaggagttcgagaccagcctggccaacatggtgaaaccccatctctactaaaaatataaaaatcagccgggcttgggggctcgtgcctgtaatcccagctacttgggaggctgaggcaggagaatccctgaacctgggaggtggaggttacagtgagccaagattgcaccactgcactccagcct

SEQ ID NO: 145473 - DNA, 499 bp, Homo sapiens
tattgcgtgtgtctgtgtgttggtgtgtctgttggtgtgtgtgtctgtgtgttggtgtgtgtgtgtgttgcacccacttgcactttcttgaaccctgcttgatgtctgtgcctctgttcccgtatccctgctggttcctttctgtgctggctgtcagcagagctgcgagtgtggatgccaggctggagtgagtgaaagagcaaccgctggtatgggccattcgctgggggattttggcagagaaaaggagcaaaatacaagtaacggaagcttgggggtcaatggaagaattgtttagaggaggggagacttggcaaggtttgaaagcagaaggggaagggtgcataaggagggacatttggaaaagtgctggagaggggagcagagggaagctgccagggaggtgcaccagcagagattggggtgagggcacaggaaaggacacagaaaccccaccccaggacttgttacccagctctcagattgctaatgcccagca

SEQ ID NO: 145474 - DNA, 463 bp, Homo sapiens
tcccagctactcgggaggctgaggcaggagaatggcttgaatccagggggcggaggttgcagcgagccgagatctcgccactgcactccagcctgggcgacagagcaagactctgtctaaaaaaaaaaaaaaaatagatattgaaatgcccgagttccatgctgggtctccccaggccccttggaggctgctgtctgcagaggaaagccggcaggaagccggcagacagagaattcccgggtgctccgaagggtgaggtagaggcagcaggggccaggagagaggtgttcgaggaggtgacattcccgttgagcccagaggtgaaaaggagccagtcttgctaagatgtgagagagagctctaggcagaggcacgcccatgcaaaggcccgggggcaggaccgcctggcatgttgaagaggtcctgcagtgaggagacctgcatggctggagcagagagagaa

SEQ ID NO: 145475 - DNA, 307 bp, Homo sapiens
cctgcctgatagaaaatctgctttaataagaaacaagaactcactcagtccgtccggagagcccctagatatgtggcagtgtactaagcactatgagaaggaaataagatgttaaaaaatatcattaaccaggctcggtggctcacttctgtaatcccagcactttgggaatctgaggcgggtggatcacctgatgtcaggagtttgagaccagcctggccaacatggtgaaaccccttctctactaaaaatacaaaggccgggcacggtggctcatgcctcttatcccagcacttcgggaggccaa

SEQ ID NO: 145476 - DNA, 443 bp, Homo sapiens
gcgtaacccgtcatcaccaggaacactgtcatcacaagtcaccagcaccagcaccatcatcaagcacatcacgagcgtaccagtcccaccacgtagtcaccatcaacaccaccagcatcatccccatcactatcaccaccactactaacatcatcacccccatcaacaccaccatcacccacatcaggtgggtcagaacataagcttatgttctgacccaccgtgatttatcagaaaggaaaaacttacaatatgcatatttcctatgcataggctactgctatgaattgaaattcttaaattccaaagattaattaaaatgtttctcaagacacataaactgttagaatctgcttataatgaggctgaagttgagtaagaagagaactggcatttaggacgctacttttcttctgtcgagtactgtcaagttttggttctgc

SEQ ID NO: 145477 - DNA, 287 bp, Homo sapiens
ttcaagtgattctcctgcttcagcctcccgagtagctgggattacaggcatgcaccaccacatctggctaatttttgtatttttagtagagatgggatttcaccatgttggccaggctggtcttgaactcttgacctcaggtgatccacccaccttggcctcctaaactgctaggattacagatttgagccaccacgcccagccttttcttaataatttttaaaatgataaggagcatcattaaaagcaagcctattatctataataataaaatgtttccatgtaat

SEQ ID NO: 145478 - DNA, 456 bp, Homo sapiens
aatatctgtacatacttagaaataaaattgcagagcctttcttacagattgcatcatttcagacttccccaaggaagagtgaaagtgcttatctaccatgcctttactacagtgttatcaagcttttaaaatttggatcataggtggacacagttaagcaccatagttttaacttgcatttctcttctcatgaagttaaacaacatttcatatgtttaagaactatttatatttgctttactataaactactactgatattccctgccaattatcctagtagacagttaatatttttgttaattatttttagaatctctttgtatattaaagctattaatctatgtgtcagcattagtgctacttactcccagtttctcatttctcttttgatgatgttatggttgttatctacacatatacttctttatctttagactacaggagaacatgtcag

SEQ ID NO: 145479 - DNA, 300 bp, Homo sapiens
tccagtctgggtagtgtgttttagcgaggctctctgcaagccagccactcctgctctgtacctactcctctctggctcctgggctgtagccacaagggtcctgtgtgtcacccattccaccaggggccaccaccctccttaatggctgctgcctgtcctgctcaccccaactggagccgccaagaccaccctgttccacacttgtgccctcagccagatgtcacccctccccctccctagcacagcaccctgtttattccctttatatcatttgattcatcttgtaatcatataattatc

SEQ ID NO: 145480 - DNA, 379 bp, Homo sapiens
gaccttctctaatgtctaagagcagagtgaaagtgagcaggccatctgaggagagagagacttccctgttggctcatcatgatgcttaagcagagccaaaaagctacttggtagggatgtcaaggaagtgagtcaggtgttttcagcaccgcgactctgtcattgtgtgcctctctccttaatacctcagaattagaataaagtcttgataacagtagtggcaccagtcctgtggtttgttttgcgatgactgtgtggttgttaaactttctaagtgaaacaccatagtgtcgggagcaatgccgacaagcctggccacctttggtctacagcagatattgcaagctggtatcccgtggccacagtcaggcttggtgat

SEQ ID NO: 145481 - DNA, 238 bp, Homo sapiens
tggtcttcagccccattttttctcttttagagaacttccctgatctgtgatgaaaacttgtctcctctctctttaaaatatcttctctcaaatctgactttactgatactgtttgatctcatttatgggtaatttaaataatcatttcatctcagacattaaacactaactctttgagaatcactcagctgagttgttggggatacttaaaacacagtccttgttttgtttttttccc

SEQ ID NO: 145482 - DNA, 540 bp, Homo sapiens
tctgagatggagtcttgctctgttgcccaggctggagtgcagtggcatgatcttggctcactgcagcctccacctcctgggttcaagcaattctcctgcctcagcctcctgactagctgggattacagatgtgtgccaccatgcctaatttttgtatttttaatagagacagggtttcgccatgctggccaggctggtcttgaactcctgaccttgtgatccacctgcatcggcctcccaaagtaccagggttacaggtgtgagccactgtgccccgcctagctgtggattttgagagtccaagttgactgtaggtaaatttgtagaaagacaatataccattttgccaattagcaaaagccaaataagaacacagtaaattgtatttaaaagaaagctcacccatttccacagacgttgagcatttaagaaatgctagacatctgaaatataaaccatgaaattgacaggttgggtgaacaaaactgcagtgacaaggctgaatgaatggctggaggtaagccacattgaaacaaattt

SEQ ID NO: 145483 - DNA, 271 bp, Homo sapiens
ttcaatatgaagcacaggggaatttttagggcagggcaacttctgtgtaatatgacagaggcagatacatgatccagtgctggaggtggggcctggtgggagatgcttggatcatgggggtgaatcgatccctcatggcttgctgctgacttgctgacagggagttcttgcaagatctggtcatttaaaagtatgtggcacctcccctaccactctctcttgcttgctcctgctttcaccatgtgacgtgtctgctccccacaaccacctg

SEQ ID NO: 145484 - DNA, 370 bp, Homo sapiens
ttgcagattttcaattacttctcagcaaacaaaatagttttatttgcattgtttactcggcatttaatttaaaaggaatccgattgattgtttttaaagaaagatgaatttggagggttgggagaaaataaataggtaaatgtttgagtagccctacatctgtatttttgttttgagtgaaacaagtgtacaggatttggcctaaattcaatcgagtctatcacacaatctcaaaatgcctcctgtgcaatttgtcaaaagagagatttttggcaactgcatataaaactcttgagatttgtaatgaagaacataatcagaagggaaaaaaagcaaagttgcattttctgcgaattaaaactggtaaatc

SEQ ID NO: 145485 - DNA, 196 bp, Homo sapiens
caacctgctttcagagtttgaactcaaaaccagcaatatatatgctgcatcagataagtgtatttcattgattttgaaaactcaaagacatataatactgcatcctaagctttaaaaagacaaaagtttgttggctaatgtattaggtaaagaagttatctgattttaataaaaaagggcaaaagtaggctgcagt

SEQ ID NO: 145486 - DNA, 104 bp, Homo sapiens
ctaataattgcaatagaaatatataccgttttggatttgtaaacatcttagaaaaaatacctagaaaaaaactcttaatgagcaaatggattaacatgtctgct

SEQ ID NO: 145487 - DNA, 408 bp, Homo sapiens
tcagtgcctatcacatgaatcaaaatagagcagatgtaaaactctactgaagatgtcaaaagcttgtgcatatttgtgaactctagaaaagtttattgactttcattgaaatgttctttttttctagtttattggtcagggttcttagttttcgacaacagaatttaaatcggttggtttaaactgagagatttgttagagggaatacaatagtttccagacacattgggagacctaaaggaacagactgtattttcaacttctagaaacttctagaaccacacctttgaactggcctgctacagagctgcctgttttaaatagcctagcactgtaggttctatttaccttaattcccctagcccactccgtgttagccaccactgacaaccccagatgaacaaaacc

SEQ ID NO: 145488 - DNA, 403 bp, Homo sapiens
aaaaccttctttttctttaggtactattagaccatggctctaatttcctaagtaagggaatattttatatataacagatattttgctgttattcaaagatgtgtaagactgtcagttcatacaacttgatatggagtgagtgtcataaattaattattcccactctctggtctaataacctacaaaattattaggaaagtcacttactagcgttttacctttactctcagtatttctttattccttttacttcttcttcagccttctccttttcagagctttcagagtttcttatggacaggaagacctagagaaagtatttccccttctccttgatgatagccagaatgaggacaagaaagtattggagagacttagatgattcagaatgtaaattaaccag

SEQ ID NO: 145489 - DNA, 491 bp, Homo sapiens
taagttcaataccacctctctgcttcccccttccctgcagaaatctcctttctgagcttcccagtttgctaagtgacaactacaactttccagctacttaaaccctttggagtcatccctgacgcttgtctttcactcataccccatgtctagttcattggcaaatcttgtcagctggaccatgacaaaaatatccagaatctgagtgcttggccctacctccattgttgctacccttatgtcagccactgtcatctctcatttggacaatgatagttgcctcctgactggtttgcctgcttctgctctggccacaccatcttccacccacctcctgctctgatctgttctccacctgacatctggaatgatcttcttgaaaccctggtgacatcatgtcactcttctatcattttattctgaatataacccaaattttcatcattgcgtacaagacccatatctgatcttgggccccggtcactgctctg

SEQ ID NO: 145490 - DNA, 291 bp, Homo sapiens
ccacgttgcaactttgtttgaaataaaggggtgttggccatgtctagaagcattttgtttttgtgggattttactgtcaccagacctgactccagtggtcctgctctgtctagctaaggagtgaggggtgtctgtctgtagagattatgctgagctcccaacaatgacttgtgggactagagtaagccctaagattggtcccgaacaccgaccaagtttcacaccgcggggttctctgctgaagggttgagatgtacacatgagaagatccaacagcatggggctgcaagg

SEQ ID NO: 145491 - DNA, 370 bp, Homo sapiens
aagggaagttgaaactaggaattttgcataggaataagggaaagtttctttaatttttgccagcccattccatattgaaccagataggagaggtggttggccagattgagactcatctgttgttttctggaattctccctaggtctccagagaaggacaggccggaggatacagaggtttctctttgcacaatcagggcaatcatttggaggagtggaacctgggggtcacctgtcaggctccagcactgaactagaatttcaacccagttggaaatatttgatctccgcttccacaagaaaaagaacaattaaagccaggggtagaaatgagaaacacctccagggcttctttggtcccttgaaatact

SEQ ID NO: 145492 - DNA, 225 bp, Homo sapiens
ccagaaggacatattccactagcactaactcaatgggtgggtctactttttaattgtctatttattgtggttcagcaacaaaatcttaaaagtatgctttcaaaatctctcaaaagaggaagtagtcatattacagaatccctattgggaaccctccttggtgtctcttaccctggggaagtttattctcatccacctctttgcaggaatgctaatgagactaca

SEQ ID NO: 145493 - DNA, 443 bp, Homo sapiens
aacaactgcaacaacaacaatgtaagacttattaaaagtacagcaaatttggggactaattgaatgtgactttcaaagccaatggcagagactagagcatgtactttgacagggttcatagtcatttctagtgaaaaatattgacaaatgatagtgtgctttatgtcacaagaattttatagcagctaagttttgtgtattaagaccacatgatgtattttcacacattccaaaaataaactgttataaagaaatactgagaagaatactctatttaatactccattaagcagtagattgaaattaagaactcaagaaccatgaaagcatgatataaaagaatgtgatgacattaagccattcaaaatgtaggtgtataaatattttaaattaaataattgttttatataatctagttataaaattgaatgaaaatgtttaaa

SEQ ID NO: 145494 - DNA, 366 bp, Homo sapiens
tggttttcaaactctgctctgcaagaccctagtgacactctggtggtgtctcagaggttactctggagagccactcatacctttgagaatgttcagatcttttcatcaaagcggctctactttgatcagttgggcttccgtaaaatttggggaaaaaagggttccattttctaaaaatgaaatgttctcaaaaatttgaagattattgaatgaccaggccaatgaggtttgtttctccaacatcataatgtttagtacttgtagacacttatatttctattgacaacatactggagttactaagtaccaccttatagctagggaaaatctttccatatttgtcaatgccagaacccttttaaattg

SEQ ID NO: 145495 - DNA, 577 bp, Homo sapiens
tccccagcagcggccggcgcccgaggccaactgagtggaccccagtgggggccaccaaaggacaatggctggtggttctgggcgccccgagccgcccgcgctggggtcgggggcgccaaccctggacctggccaaaagtgctgctgaggtccggctcctgagcggtctgggttcggggagacgctccagatcaggggctcgcgtgcaggaagtcggacaggcggtccttgggggcagcccggggcgcatgaagcccaaggccgccctgcaaggggcaccgctgccagcagtggggtcgcaggtcctgcctcttaagggtccggctccttagcctttgtttaattttgcctctgccctgtaacacccagtctgggctgttggacagcggcaagggccgcccccattttcctttgccaaaagggcgacagctggcaaaagatgcctgtggccaaatggaagaggtgccacccagcttttgtgatgcagaaacgtttaaaggcttcggagtgcacactttttacaaagttaaggcaccagagcagatttttggaaggaagttgtgggttgacaggcgtaa

SEQ ID NO: 145496 - DNA, 771 bp, Homo sapiens
tctgaggtggcaccaggcaagatcctatatcagggtctgaatcaaacagtcttcagccagtgtttattgttgccttgaagattaacaactctccaacaactaaaggtcttccccagccaggccactgttctctgcattaggtagacctgggcgtgaatcttagtgttatcacttcagaggcgtcactgtaggaaacacctcctaagctctctaggcctccattttatttccttatctttaagaagggggatggagctgctgtgagcctgaagtaccatcaagcactgaaaacatcaggcatgtagaggaggggttaaaagcggctcctctgtaatcacatcacatgaccttgaccaagtgacataattccctaatctaccttctccttatctgtacagtaagcctgtgaacctcatgggcttcttgtggggattatgtgagatgatgtgtctaggtacttacttgttggtaatagtagtgatgacagtggtagtagtagtagtaagaaactgttatcacaggctgggagtggtggctcacgcctgtaatcccagcactgtggaaggtcaagtccagaggattgcttgagcccagtggttggagacaagcctgggtaacaaagcaagaccttgtctctacagaaaatcaaaatattactcaggtgtaatgtcgtgcacccgtagtccccactactcaggaggctgatgggggaggatcgcttgagtcttacaggtcaaggctgcactaagctgtgatcatgccactgcatgc

SEQ ID NO: 145497 - DNA, 291 bp, Homo sapiens
gggatgcagtggtgactggaccagcctcatggctgggtggctctgccctcatgcggctccccatccggtgagggaagcagaccttcagaccccagagtggtcaggtctgtgatcggggaagcccaggggagtgggaacccagtggaggtgcctaacccagcctaggggtcaaagagggctcctggaagcagcttttgggctttggaggtggaatagagattcatcaaggagccgtttctaccatcttctccacctgcctttcttcagtgaaactctcacgacagctctcct

SEQ ID NO: 145498 - DNA, 336 bp, Homo sapiens
gttgaggcaggaggtcacttgagcctaggagtttgagaccagcctgggcaaaatggtgaaaccttatctctacaaaaaatacaaaagattagctgagtgtagtgttgtgcacttgtagtcccagctacctgggaggctgaggtaggaacatcacctgtgtctgggaggtcgaggctgcagtgagccatgatcatgtcactactttccagcctgggcaacagagtgaagccctgaatcaaaaaaataaaaataaaaagtatatagtaccaatttacttacaataatattaataattttcttcactgtagataatctcctatcactgtaaatgatctt

SEQ ID NO: 145499 - DNA, 297 bp, Homo sapiens
caagccaaaatcatgtctcatctgaatttttatcccccttcctgcttctgcattggccctcaccctcagtctattctcaatacccaagcaagaatataacatagtatcatggagatcatgccactctgctcattcacttttaaggacttctaattccactctgggtcattattgtacagattatacagctctactcatgctccccaccaggcacacctctttgatcacagccctgttgctcttcccctcatgcctctgttctagttttgctgtacccaacacttcctggtgctcttt

SEQ ID NO: 145500 - DNA, 265 bp, Homo sapiens
ggattacaggcgtgagccactgcgcccggccggcaaaggaaacatttttaaagggacatatccattttcacagagcaggcaaaaggattaatttatagctaaggtggactgatctaaatattcaaatgatgttagcaggatttgctttttctccatttctcagcattgctttcttctgggtagtttcattctaggctggctgcctccatattatggtatgaagaattcagcagaacaaaatttctcttcttgtcaattgtcacaa

SEQ ID NO: 145501 - DNA, 636 bp, Homo sapiens
gaaaccctgggccagggccaaatagcacataatgcctctgccttccaccttccagccagtaagtgcaaaattcctaagaaatgaaatcaaaatttctcctctttaatcagcttttaaagtgttgacctagttctgcataaccttgtccttttctgtatttttctatggaacaatttttggaagactttcagagttttggggggcaaatcgtgtcttctatttttcaccaaagggaaagattggggcagggtaaactggtagtgggcagactggagtgtgggagagcatgaaataagaaccaggtattcggccaggcacggtggctcacacctgtaatctttgggaggccgaggcgggcggaccacttgaggtcaggagttggtgaccagcctggcctacatagtgaaagcctgtctctactcaaaatacaaaaattagctgggcatggtggcacacgcctgtagtcccagctactagggaggctgaggcaagagaatagcttgaacctgggaggcgaaggttgcagtgagccaagatcgcgccactgcactgcagcgtgggcgacagagcgagactccatctcaaagaaaaagaaaccaggtattctttcagggttaattctgacagttttttgaa

SEQ ID NO: 145502 - DNA, 659 bp, Homo sapiens
gtctgttgcatcaaatttatcataccctgtcctcgagaagcttcagcgagcaccatttgcatctttaatggttgtaaactccaaatctgtatttatgaactgggatttgtgttaaaggccttcttagatttatcagattcttcattgcttcatttcgtggtgattatttggaccctagaccttgcttcatcttgcagctagaatccttgctaccaaatcaattaccataaagttgctattcttacacctctttcattgtgtaacaaaacatgataaatgttctttctgttgcaccaatttttgcaagctatgtgttttgagttcatttttttttccagtaagggaaacagatttttcttgaactgttatattcttgccctattcctggtaattgttgaccatatgtacaacagctagcaaaatgtatgcctttgataaggttcactggcctcataaaacctgtaaaaaatattctttgccaagtaccgttctttatctacttatcataagaaatgttagttgttggccaggtgtggtggctcacgcctgtaatcctaacactttgggaggccaagacgggtggatcaattgagttcaggagtttgaaaccagcctggccaacatggtgaaaccccatctctacgaaaaaatacaaaaaa

SEQ ID NO: 145503 - DNA, 612 bp, Homo sapiens
ctggaggctgaggtcgaagaattgcttgaacccaggaggtggaggttgcagtgagccaagatcgcaccactgcactccagcctgggtgacagagcgagactccatctcaaaaaaaaaaaaaaagattaaaaaaattccttttttaagacctgcaagattcttgagagaccagcacccaaacaagggtcatatgttggggggccacaggatattgtaatcactgcctcctgggcagagcgactgcagctctcccagcctccaaaccccagcccagggtgcttggaggtccctgtaactcctcacgctgccacctgccactctgtcctcaggggttcccagcttggagaaatagaggccctgcggagggatgcagtagagagaccctgcccctttccacactaagatctgacctagtccgaaggtgaaatgtatgtcccaagaaagactgagaaaactaatcaaggcagaataacagtcatcactgcaatccacaccagcaaccaatatggcctgcgggctcactgtgtcctgtgcttcactgtaagcccttacctcgttgaactctcacaaccccacaagctaagtactaatctgatcccactttcaaagggt

SEQ ID NO: 145504 - DNA, 169 bp, Homo sapiens
tggactgagggtttgctagggaagggtttgcagggggctgggccagtccttagacagcgatgggggttcagggagcctttagcagggaagtctagggtgcctgtgcccgtgcctgcagaagggaagggtcaggagagaagtgaaggctgtggcagcccggtcctgagag

SEQ ID NO: 145505 - DNA, 422 bp, Homo sapiens
gacttttagtggtaatgcgtgtgtggctctgcactgtgttcttggggtctaacataatgtaggcaatctgaaggttactgtccagtgtgggaagcaaaaggaaatcacggtataagttttgctttctttaatagcagaaggggctacatcctactgtgggaatgcagaaaagggagtgataagctgccttcatagactgtgctttcattttttgcaaaagtaaatgtaatcaatatgaatttgtggaaagtgtagcatatattgccatgtgttatgactttgagcttattttaaaataaagatggatgcctgtttctgcctaacatgttagtcagtgttatcaaagacaagaggcagaccattcattcactcatttccaaaacactgaatgccattctgtgcctagcgctatacaagacatc

SEQ ID NO: 145506 - DNA, 166 bp, Homo sapiens
gaaattgagttgcaggagtaaaactgatcttacaggctttaaaagaggatataatgaggtgatgtgtgtaatgcatacatagccaggcactttatagactgtaaagtgctgtgtggtgttattattttcatcatgactctgggagaactggggtaacagaagcaca

SEQ ID NO: 145507 - DNA, 244 bp, Homo sapiens
cccctaggggagggaatgtaacctcccaggtattagtggattaggtggtccctgtcagccaaaatgatcttctaaagaagagcataggtgtggcccatgggcagctgacacctgccagctggggatgggccggtgcgccagcctgggaagcagatctggagatagtagccacttggcttttcttggtttgcccgtcagtgggatggggctgaaggtagcacctgcttcctaaggctgctgtggc

SEQ ID NO: 145508 - DNA, 165 bp, Homo sapiens
gtcacgctcggccctgttggatgatctactttaatttttccgtgactgaattgttctagaaatcaggtcagctgttctatagacaagagtgctgctgctttatggcggcattattttggtcttctattccctatatttccttttgactacaaatctgctatagag

SEQ ID NO: 145509 - DNA, 770 bp, Homo sapiens
actcaacagtcatatagtcctctctatgtatggaggaaataccatgctaaatattggggatacaaagattattagatgggcccctggcctctggaaagcattgaatagtaaagggataggcatacaaaaaatataattctaaatagtcatgggtgtggtagggaccatgctgcaaagacattgcaatctctgcctataggactcacagaaggcatctctgaggagtaatatttagctgaaatctgaaggagaagtggaagtgggccaagtgaagtggagaaagttatagtattggtagtaaataacttaattgatcacatttttcaatattgagcatggaatcttttgttttaaagaattgcatgctcgatattttgaaagccaccattagatagtttttaagaatatccaatgaaatgtaccaccgtatgtgcttggaacccattagtcataacttggtgatataaagtacgttcttgacctatgacaggactattattgctggagttgctgtaccaaaaaatgtgatcatatttgccatctggtgaaatatactgtctcgcccaggttgaggtccacaagtgactaaatgaccaaaatgactaaagccctaagtagcccacaattactcagttgcctgtaggtccacatggagaatggaaagttgtgtttcatcagatctctgaactgaaggtcatggtgggggcagggaaaggatgcacagtgctttatcttttattttcctttgtagtttgaggtgcgtaagttct

SEQ ID NO: 145510 - DNA, 764 bp, Homo sapiens
tcgactttcattttagattcaggggtgcacaggcagattagttacatgggcatgttgcatgatgctgaggtttggggtacggatgatctcgtcacccgggcagtgagcatagtatccagcagctaattttgcaaccctccccctctccccgccctagtagtcctcagtgtctattgttatatgcatcatttttctaaagtgatgccataattgaaaatctagacaaaatatgatagttttttttactttaagaaaaccccattaaaatatatatttagagagaaacgtattaaacccttacatttaatttgatgtagcaaatttactgaatctgtaaaaattacaagtcaatataaatacaataaatctctgctctgatttgaatgtatatcttcatttatagtgtgtgctttactgacacagccattttttctccctcaattcactcaaatccagccccacctgttttgtctgtgctcttgtgtccaagtggctgtgtcctgggaaagatgagaagaaataaggcctgatctcagactcacagggagttttcgtttctagttgaggcatgatataaagaggtaactgatagtaattaaagttattaagaaagccaggagaggtaatagaaggattactactttggtcagatcgtatgtaaatagcccatgggtctttgaaatgccagagaactgaaggggggtacccaacctaatggttctagcatccacccttcctgcagcatgcagacgttagcagtgcct

SEQ ID NO: 145511 - DNA, 532 bp, Homo sapiens
tgatacatggtctcactgtgttcccagactagagtgcaatgtcgcaatcacagctcactgctgtcttgacctcctgtcaagcaatcctcccatctcagccctgcaagtagctgggactaaaggtgtgcagcaccacatctggttaatttttttttcttgagagatagtttctcactattttgcccaggctgcagggtaacatttctacagacaataaagcacaccagaagaatgtgtaaacaaaactaatatttttaacataatataaaaaaccaaggccttttctctcatgttttaattttctaaaaagataattcactacttaaagcatacatactatcaacaaacaattaaaaatttactttttaagaacttcacaatagcagcaaaaagcatgaaatatttagaaatctatgtaccaagagatgtgcaggatttgtatactgaaaactagaaaatattgagagaacctaaagacctaaataaagggagagatacaccacattcatggatcaaaagactattgtcaagg

SEQ ID NO: 145512 - DNA, 131 bp, Homo sapiens
ccaagctggacagccctgccactgtgctccatggccacagatggccagcccttgacagaatggctgcctgctccttggaccccacacagctggcaaaccagccctcagcactagggcagcctggccccagg

SEQ ID NO: 145513 - DNA, 308 bp, Homo sapiens
agagcatggaattttatttctttttatcacttgaaaaaatcacttccctcctaattcagtaaaactgggtggaggccacttcctccacaggtgagagaaataaaacttgttgatctgtcattgtcaggaattttaaagttaaccatttattttacatattttgaaaatggaaacaaaaggcagacaaaacccagaatgagaaattggggcacattctccatgctttcaaataaaacctctacctacttttttgtcattttaagatggtttctaaattagaaaacaagtgtccttaacttgaataggtt

SEQ ID NO: 145514 - DNA, 196 bp, Homo sapiens
ccagtcccaggttatttttatactgtggtttgtgcccaaggccaggaaggggaaagagttcgcatcctcacactccctgcctttccccagacctccgaggtgttatattctcccacaggacagaagtatccaaccttctatctctggctgctcacccccaccatggggacccaggcatcctgcccccacagcctgg

SEQ ID NO: 145515 - DNA, 765 bp, Homo sapiens
ccacactctcttcatgactgaagttttctaggaagtttaatctttgctcaggaaagactttcagtgttgatcttcttcaagaagttcttgatttttttcaggtcgttaatatttccatatgttttaggaacagcctgtcactttctgcaggctagcccactgggatttcggctgggagtggattcagtctgttgattatctgggtgaggtttgacatatgaacaacatgagcgttcctgtgaatgtagtgtccgtttactggcatcttttttgtttctctgcagtgtaaagatgttatacctctttcattaaatttatccctaggtagctgatgttttggaatgctattataaatgttatttttctttaaatctccttttccagcttcctgttgctagaatataaaactatggttgactttcgtaccccatatcctgcaattgtgctaaatttgctattagttctagaaattggtttgtccattcttgtgggttttctgcatacacagtcttgtcatctgcatgaggccagttctccttctctctgtccagtctgtgcggttgactccttttcctccccgcctggagatccccgtggtgtcgactggaagcatggaggcaccttggggaggtattgggcattttgtcgtgggcaggggctcagctgtcggttccatagaggaccttccagataaggaggcccctccagcccctgactgccgagcttgatttccaggaagggttgtggaagtcaccgagtgccctc

SEQ ID NO: 145516 - DNA, 177 bp, Homo sapiens
gactgtgtttccaattcattggcaattgcctgaggaactttcatttagactttttgtgggattttactaagctctaattggaccttcctttaattttataatcgtgtattgtgtatgacttcttcttgccaaggtgcctaagaggagctgacagctgtttatttagtatatgcagtg

SEQ ID NO: 145517 - DNA, 185 bp, Homo sapiens
aggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcag

SEQ ID NO: 145518 - DNA, 424 bp, Homo sapiens
caacatctaaagaaactaatagcttttcattataatattcgtgcatgccattctgcttggaaggaaacatattgaaagagggaaatttaagcagagtaggtgatacctgcttcctcctcaaggaataaagaattctgccatcaaataaatgaaaagggtatttcaagaataagaaaccagttgtacaaaggcatactggcatgactagtgtgtttggagaattttaagcattagttaatgatatttgcccaacaaacattaagttactggagtgctgtttttcctgggctggcataatacaagcctccagcccactgattacagtggggttataaggctatcaaaattttaaacagagtggatggtagtatgctgtttttacttcatcttggtacatgagtacgatatagttaaggctttgtgc

SEQ ID NO: 145519 - DNA, 264 bp, Homo sapiens
ttcctccaagcctcttgcctcacaataaacataaaaacagatgaccctatcactccagactgtccttcataatggcaacaacaacaataatacaagcttttaatttttgaactcccactgtacggcagacctttatctcattattggaaggagtataaagtaaggcatgaaaccactggacatgaatgagcagagagggtgggctagggatctagttggcagttaacactgatgaccttgggggatgaaaggcctcgacatgaa

SEQ ID NO: 145520 - DNA, 395 bp, Homo sapiens
gacctggggccggtaggttggagtccagagtcagccctgaatgagtttcggtgagcagggcaagaggggagcagggatggtatagaaaaaaaggcagaaaagtgcaaggtgtgaagccatggcttgcacggttagtagagagcaaagagactagctgcagttgactcgtccactgatcaaatgatcagcttgtagggctgtacaaagtaatatatcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacactta

SEQ ID NO: 145521 - DNA, 175 bp, Homo sapiens
ggatttgctggtgcagtacaactaggcttaataggtcctcatacaaaaagaaaatttgggctaggtgcgatggcttacaccatctacccagcactttgggaagctgaggcagtagaatcacttgagtctgggagtccgagaacagcctgggcaacataagagactccatctctac

SEQ ID NO: 145522 - DNA, 233 bp, Homo sapiens
tctaagaaactcgggaggagaaagtaatcgtgaaacgccgcacgggggaggggtgagaagggccgagaaacgcggaggtggtgtgaacgaatggaacagcagccgctgtgtcactgagtattacatcacacccagcctacacacgcacggggcccggcgctcacacacacgcggaggacagccagcacgcaccgacgcagcaccgacgcagcgccaggaggggccggggacac

SEQ ID NO: 145523 - DNA, 443 bp, Homo sapiens
tcatcttcagtaggataaaatctaagcactttcgtgtaacactgaaggtctctcctgacctggttcccaccttactgtactgtctcgtttcctttcacacctgctaggtactttatatactgtagtgagcaaaacactagacatggaccctgtcctcaggggaggagtaatagcagtcagcttttattggactatgtgccagacactgatttcctcctctgagaagcctttctcgtttatgtttgcataccatgtattatagctgttaccattttattgtgaacttggtctgtctcttcactgcactgttggaggcctttgattgtttctttaaagctcttccaggggcagggctggtcgggttgggtccaggtccacgtgggcccgtcctttttatttataacttttcggggaatcctctaagacgtcgaccttgcagggct

SEQ ID NO: 145524 - DNA, 249 bp, Homo sapiens
cggatcatgaaaattgacaatggaaaatgggcatgccattctggaacttttcccagcttttttccagagccaggtctgtcctgatgtgagaaatgatgtcctcatctgccaaatgagtacaataacattagctctacctaccttgctgggctgatgaaagaaacagaggaaataatacatataaaaactgtgctgattgaaaggagctatgtcaacatattaattcaggctgtccctggttggagtatt

SEQ ID NO: 145525 - DNA, 952 bp, Homo sapiens
taagagacgttgtcttggtgtagtgcagtggctcagttatagctcattgcaacctcgaactcctgggctcaagtaatcctcctgccttaccctcctgattagtcaggactacaggggtgcaccaccttacctggcttatttttaaatttttttttgtaaagataggatctcactatgttgcccaggtgggtctggaactcctggcctcaagcagtcctcacaccgcaggctcctaaagtattgggattataggcatgagccaccacacctggctacaacatgatattttgaaatacatatacattgtagaatgacaaaatctagctaattaatagtattataccattttaaaaaatacactaggtttgctaacatgactaggaatttatgcctttgatttccagacaatgcttgaaatcccccatttttacttaatctaatttcctgtagactccattaatttggctaggtaatataggatctcttataattcttccacgagttttcttacaagccaaaatctaaagtaaataagcctactttctttgagaaaaaagtaacaaaattaaatgttttatagctgtagcctaagcagtaagctgattgaaaaatagccattagcattaatactggccaaaacccatgtggggaaaaagaaaaactgatgaagcaactgattatgtttaattatcttgaaacctcaaatgtgtacttacacaaaactatatggtcatagttagaagcaccattattaggcagattaactaccttctgcattaaatagcagacattttgattaatgagctatttttgaagattatctttttatagagaatttgcctagctaactggtatttccaatcatggctctggggtttacctgttatttgataacagccaaccattgtcagttttatctgttgattgaattttattcataacattaatcatg

SEQ ID NO: 145526 - DNA, 142 bp, Homo sapiens
ttttctctaaggcagactctgactttgttatgcaggggcttgttttgaccacttgtggagtgtggggaaagactgacctgtgaaggccaagaacctcaagaaacttgggctcaggcatcattaccatcttagagtgcagtgt

SEQ ID NO: 145527 - DNA, 548 bp, Homo sapiens
tctagtgtataccattttaattcccttgctgtttatttgactgtattttttatttgttttcttggttgtcctggggattacaatttagtatattaatttttgataatgtagtttgtattaatactatattacaatactatatgaaatatttatttgggcatagcttaatttcttttgcccttcttgtactgttattgtcatacaaattacattacactgtgtgcccatctacgcagatttatagttgctgctttacgcaattgtctttcaaatcatataggagaaaaaacaaattataaattaacaaatacatttatactgtcttatgtagctgcttttatactttacctgtgtagctgcttttactggcgctcttgattgcattcccctcccctcccctcttgacagggtctcgctctgtcacccaggtgggagtacagtggcacaatcatagcactgcagccttgacctcctgggctaaagagatcctcctgcctcagcctcccgagtagttgggactatgggtgcgtgccactattccctgctga

SEQ ID NO: 145528 - DNA, 151 bp, Homo sapiens
aaatatttgataacattcctgcactgagttatcatggtctgaatatttatgtgacgctctacgagtggtaccaaaatgttagtgatggagtttttactaatggcaccttttcctgtttttaaattctagaatcttaataaatccaaagtgt

SEQ ID NO: 145529 - DNA, 808 bp, Homo sapiens
tagaaagacatagtgcttttagtgagcactgcaaatctaatgctcattttgaataccatttgtgctatgtaagttttatgtgattttgatgggcaaaaacatctttcacattttattatattaaagaaatatttcattttctttgtttctgcttaaatgtggcattgcttctgcttaaatgtggcattgcaaacaccttaccttatgatttccttatgagagtacaaacagatgaaattcagagcttttgctaactgctttattaccatgtaaagcaagttgaaagcaataccttccatgagatttggaattagctgtgtgtttcatttaattgctctctcaacccaatgaactagaagacgtgtgttagcttgagttgctctacatgaattaacagggaaacatacttaaaggaatactgatttcatgatgaatataagcagaaagagaattctaatttttccttttaaatactacagataatgatttaaaaatgtcatacacatgacaattttttcctagttaactaataaaatgaaattatatttaattttatttacatatatttgtcttcaaagaagcacgtgtattttaaggacatatgtttttgagctaaacattttaaattatctttgtatatattcttacaaattatgaaaaatttgttcttacgttgccagtgttcctttaattatagttacaaagtgtgagttaatactttgtgcaaagcactgccttcgtggtgccctcaattttataatattgcatgttaatgttttaagacaagtcatactatatttcaagatgg

SEQ ID NO: 145530 - DNA, 405 bp, Homo sapiens
cgtagagtctggcacatagtagtgctcactaaatggtagtcattaaagatacaacctgggacagtggcagctagtttaacaaaccaccacactccgtagcacctctcacctgggtgcaagtgccccaggccacactgcagtagctgcacgctgagggtgtccccagatatataagaagcctctccaagggccacagaggttttttgatggcaaatggtttaaaacatcgtttttatattaagttgtataaaatatactatgttataaaatgcaaagtttgcatcattttagagctaaaacttaaggccacaaaagaatctattttcttattaataaaaaatcctatttttatataatgcaaataacgaagatgaagtaacctattatttaattaaacatgtcttt

SEQ ID NO: 145531 - DNA, 603 bp, Homo sapiens
tatgctttgagctacaatgtaaatgaacaagtgtcatgaagatatgagggaatagcaccccaggcagaggaaacaacaagtgtaaaagccttgaagtgggaattagactggtattccaggttcatatggctagaggttattaagcaaggacagaggccagggaggcaggctggggttagatcacaagagcccatgataaggatcacagctctaagtaggagagtaaactactcagctgttttaaataagaaaaatgacacagatttatgtttgaaaaaagtcaagattatgaaatggtccagtgagtaaaaaggtttttcttttctttcttatataagcttattcaagtcatccctttttagactagactgaagacatccattttcccagctccccaaaatggcaatgattttattctaaccgcatctaaccttccagaagcactacttgtaacatgttgccccactactttctaacctacaatggctgtcagttcttacttagttctcagaacttagcctcagtttggctctcctaagaaccagttgggaggtctgtgcagtaccttcacacagtaccaagtttgacactttttcttccaag

SEQ ID NO: 145532 - DNA, 480 bp, Homo sapiens
atcactggattggtgtaaggcttacataaacttaaaccacttttacacttaagcactttatatgtggttgagctttacaccaacattagcttcctgttgtttatcttgcctacaaagtatctgtaatataatagttcatcacaatagtctatatgacaaaaacaggaggttagaacatcccctcacctaaaagaggttacaatcttggtcaaaaagtattaactttgacatgttacatgtttaaccttttttcttaaaataactttgataagaaaattatagttgtatgctataagggtacacacagttagagtggccagttttgcacattggattatacttctctacctaaaatctaatattttaaaactatgatcattaaattgctgactttgagggagacgaacagtatatacttttaagtactaatcagacaagatcataaataatgtgcctttataggggaagaaagattaataa

SEQ ID NO: 145533 - DNA, 163 bp, Homo sapiens
agagcagttttctgttctcacaagtagttgttatctagcttactaagggaacataagtctgttttaatcacagtttgggtttgttttgtttttgaggcagggttttgctctgtcacccaggctggagtgtagtggtgtgatcatggctcactgcaacctcgac

SEQ ID NO: 145534 - DNA, 325 bp, Homo sapiens
ctaacttgaggaccccaaagccgacatacacgcataatgggagggtgcctgcctcataatcagtgcagtcaaagggctaaaccacagatcagaggacagcttggtaaacctggaatcagaaataggagttgggtttcatgatgagatagtttcatcaaactaggctaaccaaatgaattgctatttcttcaggggagatacgcagtcatgcatcacttaaagatgaggacatgttttgagaaatgcatcattaagtgattttgtcattgttcaaatatcatagagtatacctacacaaacctagatggcttagcctactacacac

SEQ ID NO: 145535 - DNA, 210 bp, Homo sapiens
gcggccgcctactactactactgctcgaattcaagcttctaacgatgtacggggacatgtagcagaaatccacttttgctgaaaaaaaaaagtgtgtgtgtgtgtttagacacaggaaatgtccaagatattgacagtgattatatttaggaattaaattagagggagaacaggtaggtttcactctttattgtttttaaagggaaaaaa

SEQ ID NO: 145536 - DNA, 313 bp, Homo sapiens
gaaaccaatgcttgttctttgtttcattctttttaatattcttattatagactgctctgttgacgctgagtgtaaagccataacttgcccctatgagcgtctctttggatgcttgcatcccgcttgatgtttcatcagctttcttttcttggttcaggtactgctaaagtagctgagggctcagaacagtggggaataggagcatgaatgcaagagactttggtagaaagaattatggtagtattatggcagacacattttggttgtgtcaaaattaaaaaccatagtgttactctggtaaagaggatggcac

SEQ ID NO: 145537 - DNA, 319 bp, Homo sapiens
ctcacatgtactgcaatgggaatttttaccatgatcctaatatctgtttctgacccttgttactcctgagagttgccctctgttgtctgtagcctggtcttcctttgctttttcatcatttcctgtcaggtattttctgcattaatgtgggggctgctaagaattcagttctgtgctacaactgctacccaaatcctgatttaccttgagtggttactttgctgttgaatggtttctaagcaaattggtcactcatacttcatgttgctgctggcacgtttagatggaagaggtcatactttttgaaaatttatccttc

SEQ ID NO: 145538 - DNA, 814 bp, Homo sapiens
cataggaaaagctctcatcatgaatgaattgaactggagatgacctcacaacacaggtgttcagggggattacagtacaggagctcatccctcattcacatgaatccatgatttggataaggtttctaacttgtacataaaatattttgtgttcgtttaatgagttcccattgttgaagatcccaatacccctcactccctgctcccataaatatctgtagaatgaggtatttaaaaatattttttgtttttatgttgatttttattcattatccgatttctgactcatttagtgttataactggcattaagttagaaatggtctggataaagttgctgcttttttgacatctgtgtctagtggagcctggacacactcacatgtacatacatacaacatgcaaaataatgtaagagtattttctctttcagtatatagaccataggaattcagaccttaaagtcagatacatgcatctaaaagtattaaaaggggctgggtgcggtggctcacacccataatcctagtactttgggaaactgaggcgggcacattacctgaggtcaggagttccagactaggctggccaacatggtgaaaccccgtctctactaaaaatacaaaaattagggtggggaaccctataatcccagctactccagaggctgagaggagaactgcttgaaccctggaggcagaggttgcagtgagccgagattgcaacactgcactccagcccaggcgacagagtgagactctgtctcaaaaaaataaaataggccgggcgtggtggctcatgcctgtaatcctagc

SEQ ID NO: 145539 - DNA, 394 bp, Homo sapiens
atgtgactcaggcttagcaattaaactgcccatttccctgaccatggtggttgactcaggaatgtgatcaattcagtatcttctctgggatttttccgttagtccaatttgaaaaggttttctccataggctattgtttctaattaaaatatgaattgcacagttgttagtcttcttgtctgacatgtggaaagaaatgctttaagagatgaaatgagactgtctaaaagtgataattagagtcctttcttacctttgcatttttattgataagtttaacttatggttctaagttatgaagttgttgattggctgatttttagaacttaagaaacttttgattggttgtttgatttttagaaccatttctaagcaaatatttatctgtacataa

SEQ ID NO: 145540 - DNA, 878 bp, Homo sapiens
ccacccatgccccagctggggttggcatttcagagtttgcagaatctttgtgtggcttgataggttggtccctcgtcctctaatgagtcacctgcctttcactcaacacacagaaaacaaggcaaatgctgtaaatcccatccctcctcctcgcctcctgtgcagctcggggggcacgcaagaggaagtgttaaaaagatttcattcaatgactgaattccatgctgagcaaaagcctaggatgcaagttgaaatgtggcttcaaaagccaccatcaacgaagaattacaggaaaagggcagtcaagtggtaaaagattccactcactcaacatctatcacttatacaacagctgggccacatccaatttagagtggcggaagaaagtaaaatcaatcagaaatccaatctagcactgtcatatactttctaatagtctagcccattaaatttgccaatggttaaggtagtcatgaaaatccattacaaataccggtaaaaagccctaccaaatatcaataaacgaatgtactctgaaggcagtctccatagaaattttacttaataataataatacaaaactctatttgtgatgccaatgacatctgtccaaaaaggtgtcatgaaatcagctcttttacaaatcatctcaactttgaactagatgttagcaggttgtgcaatcccgagatggtctccacagtatgaccactattcctgaaattaagccaggaataattcagatgaccaaattcactgataatccttaattattatattagttattagtactaaacctattttaagtcaaattattaaatagaactggtaaaaaaagtagtaggaatgtctattttgaaaataatcttcatatccta

SEQ ID NO: 145541 - DNA, 521 bp, Homo sapiens
aatgtaacacctgttttctgaggctttgctgaatgtctcaggatgggttatttcagaggtcagcaaactaggctcaggccatggcagcctcccatctttggggcctggggcacggcatggtttgaggtcacagatgcaaatggatcccttagaagttgccctggaatcccaaaggatgctttactttgccacatgaaaaccaccccagatgatcctgcccaactgcctggcgccactgaggaaatcgttcttgccgagggtgttggactggccaaatctcccctactggggaaacaaagggttgtctgctcccggctcgccctccagcctgtcgggactgcctcctggaacagctgcagcgtgcaggcgcagccctgcttctaatagaggaaatgaatttataatgctgcagtctcttcattttcacccagcacaaatttccccttaaatacttaaaaacaacacccagagctggatataccttaaatttccaataaatgaaaccttaatccagtctgttg

SEQ ID NO: 145542 - DNA, 513 bp, Homo sapiens
gactagatcgagttactgtatccaaaatatttggctattcctaatcggactgtggttaagaaaaggcctcctgcagctttgctcagttggcaggcagacaatttcccatgattccagcttagcaccagttagaaaattatagggggaaaaaaaagtccctaacaataagattgccaagtaaatctggagtttccttcttggtaatgattttgatttttcacaacctgagagggaatctacaagttgccctttgtcagccccttcctttctagcccccccatctccatacagttgtgtggtggttaaccagtggggctataaggtttcattcccattagtcaagctcagaccttcaggtgagcttccagatgtattaattcactcagcaaaaccgtgaatgttatagtggttaggggatactgtgaagaaggcacataaaagtgcttctattgtgaaacttccatgatagaccaggattaaccagataccagtcctactggtcattggtgtttg

SEQ ID NO: 145543 - DNA, 229 bp, Homo sapiens
ccacccaatacttgaattaacatattttaaaggtaaacccctcaaaactacaaggttattaagaacagtcctttagtgtcagtcagaagtaaattcttctgtttatagaaagtacagctagcagtatgaaaagggacccaaagatcaagtagcactcattttgcccacctctgcttctgtcatcccaccacagtcactttggataagggaatccaattcatattgggtg

SEQ ID NO: 145544 - DNA, 215 bp, Homo sapiens
tagctgctggacgtgaggctgcagccgccctcttcatgggcactggcatcgccatcatcctgttactgagggcgtttttaaagatgtgacagaagtttcccctaactctgataagacgaaaggactggctgcttctatttcaggctgaaagacttgcatactgagtacaggcccatccccgcccagtgctggagcctgctgcatgccacggggtg

SEQ ID NO: 145545 - DNA, 224 bp, Homo sapiens
ccttttggtgagaccctagcagatgttgggactccctcccatctgggtagatggccacccctgaagaactctgctgttcacaggaaccccttgtggccatatgtctgtcattgtgggtttcttgaagacattttgtatttccagaattgatttcgtagcaggcctttgcctctatatagttgcattgtttaattatgtatctgttgtcagtttcagggattccg

SEQ ID NO: 145546 - DNA, 175 bp, Homo sapiens
gggaacaggctcctgtgacttggaaatgaaaatggatcacccaacctggaggaacagtgaggctggtgtccaagacttgccccttgcctgcacttccagcaaagatttggagacactcagtggaaaccaatcgagcccccagcccacccccgcccagactcagccaccaaagttc

SEQ ID NO: 145547 - DNA, 1276 bp, Homo sapiens
ggcgtcggctcactcggttcaaggcagcgcgactgcgggtggcgcacgaccagggcgcagaccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgcgatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactga

SEQ ID NO: 145548 - DNA, 1308 bp, Homo sapiens
cactgaagactcctgctaagcaacccactgaagacccctccgaatcatcgacggggcgtccttggggtgcagcccaggaagctcagttcacagccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgcgatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactga

SEQ ID NO: 145549 - DNA, 1181 bp, Homo sapiens
ggcgtcggctcactcggttcaaggcagcgcgactgcgggtggcgcacgaccagggcgcagaccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgcgatctgtgcactctacgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactga

SEQ ID NO: 145550 - DNA, 117 bp, Homo sapiens
cgtaatggcctgagctggtttcacaggcaccagcaagcttagctgtggggacactgctctggtctgccttgggtagctcccacggctcctcacagaccccccgcaaaatattttgta

SEQ ID NO: 145551 - DNA, 711 bp, Homo sapiens
gaaccctttcataccgctttgtgcagcggcgttaacgttcaaaatggtttaattcgcctcggttcatctggtggtggtggtttaagtgggggtaagatgcatgcacaaggctttttttttttttttcttaaacctttgccgcgggagctgattacgtacctacggcggttaaaagtggttaaacatgatcaaaacatgcacatgtgggcacatgtggcgtgtttgcatttccccaaactggtgttacgtgggagtggtgatgtgccgcagacatgctgggactcctacggctccttggctcgtttccgcaacatctcgtcgcattatgcgagtcaacaacagtaccagtgctgggttgcctcgtggcgactacgctgattctccagctattgtgaagcaagtttctcggccagagtggctgacttgactgaggagcttctgggagcatggaccacaagctatagtcctagagctattcattcatggctgaccagggcccattgtacagccggcgcctcgacgatgaccccttggtggcaacaccatggtcactcgagcaggctatgctgctggccagagcttcctcggttatgtggccatgcttggtgttgcctatgaggccccttcgctggcccctggttcatggcgctactgggctcacctctgctgcgcccacgtcctggcacacgcccagtgctccgcccacccgcg

SEQ ID NO: 145552 - DNA, 274 bp, Homo sapiens
caaaaaagaaaaagaaaaatatctttctataagtataaagagaaaagagtagtttttgtttgctgaatgaaaatgttttcatttatggtaaaaattttaaaatagtatggaaaaaagttggataatcccaaatactataaactacagagttattaatcacaaagtttagccatatatgcccaaattaaaccttatcctcctacatcatagtttaggctttttgctttcataagaattgtttttatgttctggtttatggatctgcaaacatgta

SEQ ID NO: 145553 - DNA, 262 bp, Homo sapiens
tgcagatactgtgcaggctggggtcgttatggcctgtctcttctggattttttctagttgttgtgtcctcaaaagaaagaccatgatgctttcattgattgcttatgacaataaaactaactctctggaaagcttgaaagttttgttagaggcgtttgaaccagagcaactccatcttgaataggagctgggtaaaatgaggctgaaacctactgggctgccttcctagacagttaaggcattctaagtcacaggatgagaa

SEQ ID NO: 145554 - DNA, 333 bp, Homo sapiens
aaacagagtccaaaatcatggtgagcgcaaggagcaggtttgtctctccctcccagagcagctgggaggaggtagtcgtggatgggcatggtggcttggctccatgagttgtccagggatccaggatccttctagcttggtgctccactctgccacggtatcacccttgtctgcactgtccgagatggcttcctaccatcgtgtctaggttccaaacagcatgatgaaggagcggcagaccccctcctaagaaatgacctagaagtttctcctgtcatttctgcttcttattgtccaaaacttggtcacatagccagccctacctgcaaggga

SEQ ID NO: 145555 - DNA, 387 bp, Homo sapiens
tgtgctgggtcgctctgaggatccccacttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtg

SEQ ID NO: 145556 - DNA, 406 bp, Homo sapiens
taagatcgcgcgaggagtatattacttggctaaagcctccataacaaatcaccacagactgggtgacttaaacaatatatgcttatttcccacagtcctggaggctagaaatctgagatcaaggtgtgggcagggctggttcctcctgaggcgtctctcctggggttgtagacactgtcttctccctgtgttctcacagggtcgtccctctgtgtgcgtctgaatcttcatctcctctgcttatgggatgtcttagtccatttcaggctgctagcacagaataccatagacttagtggcttataaacaacagacattgattctcccaagtcttggaggctggaagtcccagatccaggtgagggcagggctggttcctcctgaggcctctctcctgggcttggaga

SEQ ID NO: 145557 - DNA, 561 bp, Homo sapiens
aggccagcgcaaaccagacagcataaagctgagggtcagcaaaacaaaaattaggaacaatttttttttaaagggcaagttagctgaaaaacacacgcacacacaataaaaacaatacatttgggaagattcatcaaatgaaaattcaaaactaagcaaaacatggaaaaatggactctacaaagaagaaaatgcaaacacttctaaacaatgtggtttcacagaggtaatatcgctgtcaggcctatatcagtatctgctcggtctcaccaggacttctaactaagggactgcagacactgctaaaccgctacttgctactcctaaaatatcttcttcacctacgtgcccggacttctatatttaaaactcaggcataagtaaagcagggtaagttattatgaaaccgaaagttactgggactaaggagtcgcaggcatggctatgctagtactggttgcgaccaaatatggacttgcaagagctaagaaatcacattcacaggggcacttaaaatcgaagcatgcacttgttactctaagaaatccctaacccaggact

SEQ ID NO: 145558 - DNA, 445 bp, Homo sapiens
tagagacgggttaacgggcgtcttgtgacccggggacaaggtattactcagggagcagggcatgaacagcgagagaccgtatctcatatgaatatagatgcaaaaatcctccacaaaatactagcaaacctaacccagcaacatattaacagaattatacaccatgaccaagtaggaattattccagaaatgcaagattgtttaacatacaaaaatcaatcagtgtggccgggcacggtggctcaccctgtaatcccagcactttgggaggctgaagcaggtggatcacttgaggtcaggagtttgagaccagcctagacaacatggtgaaatccgtctctactaaaaatacaaaaaatattagctggctgtggtggtgcacacctgtaatcccagctagtcaggaagctgaggcaggagaatcacttgaacctgggaggtagag

SEQ ID NO: 145559 - DNA, 162 bp, Homo sapiens
tggtgggattacaggcgtgagccaccgcgcccggccatgtagtagttacttattgagtacttactcggtgccagtcagtaggtcaggcttggagaatacgactacaatgaagacagacgtgttcctgctctcaagaagtttattttctaagagggagttaag

SEQ ID NO: 145560 - DNA, 168 bp, Homo sapiens
cactctggatgacacagcaagactctgtcacaaaaataaataaataagaaatatattttatgaaacagtattcattttgtgtccattgagattatatcatgcttgatggtagggattcttttatactttattccaataatgcctgtactcccaaaaaagattggcaca

SEQ ID NO: 145561 - DNA, 369 bp, Homo sapiens
tgagggttgggggtatgtctcagcaatgtgggccaggaaccagaagctctgtatgagactcagataactaacggagaggctttctgcaaagggctgggtgtttgagagtgcagaatctctgcattccagaccctgacttcgggctgggcctctgaaacccacaccggggcagaagtctgaaccccaatccacagcagatcaggagaagcctgcgccccccactggctgaagacccttggtcccaacatcctgccttctgatcactgagctccaaatgaactcccaaatactatccttggggtaaggagggcttcatgattgcctgtcccagcttctcagggccctgtctgtcctctgggtccagacagt

SEQ ID NO: 145562 - DNA, 714 bp, Homo sapiens
ttcccagcttttaatttttaaggcacagatggagctgtgaaagaggaagcatctcccagctagaggtgacccacccggggaccccatcaccctagatgctgaggaggtcagtatctcacacaatgtaacctcttgttagaatctcgcttttggggctctgattccagtcgaaggtggaagactgttcagaggcaatggaagcccagagaggtgatgtgtgttgtccagtgtcacacaggagtgtgacaatcatctaggccactcttcatttaaagaaggagggaccaggccaggcacgtgaaagcccgctaagggacccagcagtgaggagggcgagttcttttgaccagatagcctgtccctgggaggcgggttgtgaagccacaaggccctgccctagcacccaccagcctgggtcctggtttcctgttctgatccgagctgggctgattttccgctggttcctaacagacagacacgtgcccccaagacctaaaagcaccaaaggagaagaaactctgctcaacagagtcacatcttcatggtgaagttcagaagtcagcacaataggcaaaaaaataaaaaataaaaaattctgtgaagttcagaagtcagcacatttgggaggctgaggcagatggataacgaggtcaggaatttgagaacagcctgaccaacatggtgaagccttgtctctacactaaaaatacaaaa

SEQ ID NO: 145563 - DNA, 928 bp, Homo sapiens
accagagagttcatacttaataaaagcaagataagggcaattactgtcaaaaggtctttcagaaaaatataaccctttaaagtgaagaagagaatttatattgaagatggacattacaaacataaagagggttgtagtacctttacttgaatcaaattttattgtacacattttgtactagaggaaaactctgaagcagttgctcaagctttgttcaacattagggcacttatattggaaaagtgtcttgcagatataataaatgtggaaaaacactttttcaaaaactacatcagaaaacaccagagtttatactgaagaatatttttgaagatgcactaaaaatgaaaaaatatttaatccaaattagggctatgtaaatatcagaatttataatagaaatatataaggaactgacactgcagatatactaagtcaagagttctgagtatagaaaataatctaaaactaaagttgatagaaaaagtatttgtatataaatttaagaggagtaaaagattttttgcagagtaataactacattctaagtatactttatttcttgaaaaaattacagactttgaaagcaaatgatgtaattcaacactcattttctggtgtttcttcattcttattcacttgtgaaagcatgtgataattgttgcatcaaaggtatgagagattcttttccattaggtgggcatttatgatcttttctatggacaagtaaggacattagaatgtaagatgcatgatgaaaaagtggagaggttctttgtggttaacttatactcttgagtgatatatgaggtaggtgttaagagtattgttcttttgcattatgagaaaactagtagtatattattagtatattattgtactaattgtacttttatataataaaatgcagcacatttttaaaatttta

SEQ ID NO: 145564 - DNA, 357 bp, Homo sapiens
tttcttgaaaacctagtcctgttgatgatttgccgttcttagtttcctaatacccccatggaggaggatgggcagatgttagaattcttcatgaaacatgtggggcaaccccagaagcacagaacagtggagacttacccaaattcttcacagtaaactctgtagcctcctccattaatttttgttactgaaggaagaatcccaatgacagtatatcattttttaaatgttgcttattatacagataatgcaatactggcaataaggaaaaacatttttaaatcaccctgatcctactacccatcaaatcaactattttgagctttttctatgttgcttgcagtgctgatctgtttg

SEQ ID NO: 145565 - DNA, 248 bp, Homo sapiens
gccctgccttcactggcagaattgtgatccatcatgttctctgttcaatgtcatcatccctttcagagcatgggtctcttcctttctaggcagtcttaccaggatgcatgggtgtgcctgcgtaggcacacgcacagctcccaaggactctaaaaaaagatatttttctgcttatatactaataatatgttagagatttatgtttcaaattagtacagaatcacatggttctctccaaattatatttg

SEQ ID NO: 145566 - DNA, 396 bp, Homo sapiens
gactggcttgggacttgagatagcttaaataaggtaaaacatgtaatagcatgtaaaagtacttagtgagtgcttggctataataatgaaaataatcactgacaaccctatagttatagaggccactatttattgggtctaggaaactgaggcacagaaaaacagaatgatatgtataagatgaacgagtcgcagagccagcctggggtggaccatgggtcttctgcctcaaggccttccccgaatcccaagctgcaagtcggcatctcatgagtggccaccagaccacacagcccgaaggccttctccaacggtgcagccagaatgacagtaatgtcactaaagtactaagcgcagccctggtatacatagtcattactcaggtaatggaaactc

SEQ ID NO: 145567 - DNA, 466 bp, Homo sapiens
tccacctcccggactcaagcgatcccacctcagcatcccagaatgctgggattacaggcataagccaacttgcctggccctgtttcaaggttttgagttttcttttctgttagagcacctcaaagacctcgtcacgtgcattttgcacagagcaagttagcaaagttaacaaatacttgctgaatgagcagccctcaagtaaatgccatcagaaatacccactgatgacaactaacgcttatagcagatgctctcatagccatgatctcccttaatcctcccagcagcggaggggagcgctcttctgattggaggggcagggcaaaaagagtggccctctcaggacccctctgctccttccccagacctggccccaaacttccctgcaccactcaccaggactcacctgggcctggcacatgggaccaggttcccaacagtgctggcacccagtgaacatcttgcc

SEQ ID NO: 145568 - DNA, 229 bp, Homo sapiens
ctacaggactatgagaaaataaatatctcttggttaagccatcagtctgtggtactttgttatggcagcctgagcagactaatacagaaggtacacattttaaaagtgtcagagaatgattcaaggagacacaaagaggaaagagaagagcataagagaagtgttttgagcaatttgggaggaaggctctggtaaaatatagagtattgttacaatcctagcaatattg

SEQ ID NO: 145569 - DNA, 347 bp, Homo sapiens
tatgtgtcactagactgtgcccatcctgagatcaggaaccttgtctatatcatccaaatgtccccactgcctaacacagtatctggcacttagaaggtgctcagtagagcttccggactgaatcaagttcccagagcttctcatcaaacactttgcttatgttattttcaattgtcttagtggttttgatgaaatagggcttctgatcactgtcagacatacagaggcactagttctctcagatttctatatttgaatagagaattaagaagtaacagtaaaagcttccagaatttttcagaaaagcatctacaaacagactcaagttgtcaggagggaaagaaaaa

SEQ ID NO: 145570 - DNA, 320 bp, Homo sapiens
cacagaaaaatagtacttgaactgttttagaaggacttgataggatcaaaggagacagtttactttccatgtggctgaggtatgggaaagagagggaggcagacattgtaccgtaaagacagcatgttacaaaatcagaggagcattgtcacttgtccatgtcccttagttgcagaaaacttgcttagaagagcccctgaagtcgtctttgcaatgaaaaggaataattaagcttttaagacaagtataaataatgttctggtataaattctgacctctctaaatctgttcaaacttgtgggacaagtgtttccaactct

SEQ ID NO: 145571 - DNA, 334 bp, Homo sapiens
caaaaagcagagagacatgcttcaacattttatggaagattatccattcttaaaggacaatcatctagtaacttttaaaaacaacttttggattggcttttataaccagtgcctgaatgaagttgactgagtcaaattcaagacaaaagaaaagccaatggcttatttgtacttttgccaagaagtaaccaagggcctctgttcaaacactaggtatattaggttgctatcagtctgtcagtcatcaggggatcaagagagagataagctaggtggtttaagccatggctataggctctcttcaggtaattgtgcagcagtcttcatttcagag

SEQ ID NO: 145572 - DNA, 538 bp, Homo sapiens
ttactgtgctatgtcaccctacctcttgttaaggaggtttgaagttataaggtacaaattttttacatatggctgataggtaagtttttgtccaggaaaatagtattattagcacaaattttgacttaggctataagcttcacctgtgaaccttttcttttcccctcgttttactcttaccccagtatcctattatctcatacctaaggcagtgatggtttctcagacctcttagattgagaagatgtggcatgggtgtaaggtccctcaggtaattctgagggttgggtaggtctggtatctactcttttacttaattgacttcctccaggctttttttttttttttaatggagtccaggctggagtgcagtggcgcgatctcaacctctgcctcctgggcgcaagaaattctcctgcctcagctactcaagaggctgaggcgggaggatccctgaggcccaggagttggaggctgcagtgagctatggtcccaccactgcactctagcctggatgacagagtgagaccctgtctct

SEQ ID NO: 145573 - DNA, 562 bp, Homo sapiens
cgactctatcagtatcccgcacgacatcgagagctttgacgctgagagtcatgcgggtatcttctataatcgatctgatatgctttcaacctgttgtaaggtgcgtcattttactacgttcttaattgaaaaaacccctggtgcagtgggccaagcacgcccccgacaccgagggatggacccctccaactcagctggtttgtgacccaggcatcttggtgttttaaagactccatagattccatggagacaacaaaatcacacaatgacaggaccctgaggggctgctctgaggagcacatggtatcacaagacactcagcttcctgcccggaacgtggcgaaacagctcaatgcattatgggagaagattccaggacaggctggagctgaagctacatcaggacaggggctcgtcggaccttttgcactggacagagcagattgacagcgagaagaaaatcggcagcgggatggagaatctcctgggaggatgaagctgttgcacagcctcctcttcagagcccagtgtcatcagaatgactctggtgggctggttggtc

SEQ ID NO: 145574 - DNA, 251 bp, Homo sapiens
gacgctgctgttgctttcaggtgaaaagaaaattgctttgtgtttacctcatttccacagcagaaacccagttgcatgttagagaactttaaagtagtcaaaattagaactctgtccattctttgtgcactagtttgttgtttcttttcttttttttttttttttttggaaaagggggtttaatttttcaccaggtttgggggcaaggggtttttttttgtttaattgaaccttttccttccaggttaaag

SEQ ID NO: 145575 - DNA, 1091 bp, Homo sapiens
gtggcatattagcctagaaggatgggtaggactggcagaggcagagaggaaggaaaggacattccaggtagcgggggtggcaggagcaaggatggaggcggaggcaagaacatgtaaggtgcgcacacggaatggtgagggggtctccacctgctgacatgcatagagggggcgcttatgttgtctgggagagaacaggaacaagagggttcccttcagctactccctcagtctcagtttccctgtctcatttaatcctcacaaaatctctctggggaatgtactctggttttccccatcttccaccaaagaaatgaaggcacagaagggtagtcacttgcccaagatcacacaagtagtgagtaatgacacaggactggccttggccccaggtctatacaactctaaagtcagatcctaaccaccaaaccagggccaggtgcagtagctcatgcctgtaatcccagcactttgagagacctaggcaggaggatcacttgaggccaggagttcaagactaggttgggcaacatagagagaccctgtctctaccgaaaaaacaaaataaaataaaacccccaaaactaatcaccaagccacgctgtctcactggaagctaacagaaggctcaaagtagagggaactgacaattcttggctccccaaagcccttaccaaaataagtgagtaagagatggcgagtctttaaaggagtggctcatctttcctctccctggggcattttggtgtgggagactacaggggatgaggttaaaaagcttggtcggcaggtagaggatggggagagaggttagggccctgggaaaggtgggagatcagccagagacaggtttcccagaacagaatgtctggcctttgtggtgaggagggactgtggtatgagccgcagaagcgggccaggggtaaaccctcctgtgcgtccttccttcagcctggtcctgagggtgaccctttgatcctgggttctccaggtagggctgtgagctgtgagttggatccttttggtgaaatggtctctctcatctggcctgtcactcaatgtggaatagagtgagtgagttctatgggttc

SEQ ID NO: 145576 - DNA, 196 bp, Homo sapiens
gtttctgtggaatggtttccttcatttttgcattcattcatttattcatctattcatccattccttcagcagccatctgttgtgtacttgtgctgagagatgagggatgtggtggtgcactggaacgacctgacccctgccctccctgggcttccctcctcccatgaggacagggaccatgtctcggagatgcctg

SEQ ID NO: 145577 - DNA, 166 bp, Homo sapiens
gttgggacagtaatgtctgtatttagagccgactgtcattggcatcctcccttgaccttgattcaggtcaagagccaatagcgccactcacgtgaaacactaacggtggtgttgccacagacaaaatagaagtgttaactactagaatgcaaagacagtttttaaa

SEQ ID NO: 145578 - DNA, 383 bp, Homo sapiens
agttctggctccttgcttgacttccttttgctctgtagctcttttcctaaacaaatctgttctcggtgaactcagttttcaaactcaagcatgtttaccacacacttatccattgccccatctcagttattgattacactaccagtcagggccctgatgttgggatcctgagtcgtgcccggtgttctcagatctggatgaattagggtctgactgctttactcattttgattctctgctcatcagcaaaggattaagcagaaagttctttctttccatttttgttaccagacacttttctgagatgttagaatttatcttcccaccttgaaacgtccagcccagggatcagatgggaatctttgccagaaccacaaatatcg

SEQ ID NO: 145579 - DNA, 497 bp, Homo sapiens
gcaattctcatgcctcagcctcccaagtagctgtgattacccgtgtgcatcaccacacctggctaatttttgtgcttttagcagaggtggtgttttgccatgtcagcgaggctgatcttgaactcctgacctcaggtgatccgatccacccgcctcggcctcccaaaatgctgatattactggtgtgagccaccacgcctggccaatttcttaaacttttgattatactaaatatggtccttctgcgtgataacactgtttttccttttataaaattaatctcttaaaatactttaaaattcaaagtacactttttagattctttaaaatactctttgccatgttcatggcctttagatgtgtgatcatagcctatttgcttttcattgacttagtttcatatttctttgcctttttccccctacttttccttatagaactatttactagtaatgaaatcattttaaagaatacactttttattccacctgctaact

SEQ ID NO: 145580 - DNA, 384 bp, Homo sapiens
gggcgcaggcggcgcggggatccccccgccgcgcctttgacccgggaatacccgggccctccccgaccagggcgccccagcctctgggttctgccggccaggctcgtggccccgtcctcggcaccccaggttcctgggactccagctgctccctgaggatccagggcttctgaattttcctattctggtcgccgtggggaccatggcacccggggatgcagctcccaccccgttcgggaagcctgtccgtgtctacacctctgctggccccaggtggtagccctcaccccgtcagcacctaggaatcctgttccccagcgtttgctctgcttagaaccccgctgtgccctgcagacacacagacttagcctcctggcacccagc

SEQ ID NO: 145581 - DNA, 154 bp, Homo sapiens
  misc_feature (11)..(11): n is a, c, g, or t
aggatcacgantgtccgtgttctgtcgggctagtcgggggaggatcacgatgtccgtccttatcataatggccttcctcaagtcaaacttttcccaaatgtcttcacttctccaaacaagaattactcctttctattttgaaaccctgtttgtt

SEQ ID NO: 145582 - DNA, 161 bp, Homo sapiens
gctggtcatttgtaacctttataataaaatatcattgtaactatagtaactacagcgctttcctaagtcttgaatcaattctaacaaatttttgaacctgatgggaacttccatatttatagtcaaattgagcagaagagcaggtagcatggggacctagg

SEQ ID NO: 145583 - DNA, 193 bp, Homo sapiens
taaatatgagttgtgtctaagtggtaagattctgggtgatttttactttatgccatatttttaaaatattttgtaatgaatctgaattacttttgtaatcagaaaaacagagaaacatcttttcaatctcagcaccccagaaccctcctagctgacttgcctagacatggcctataaacactcgggctcagca

SEQ ID NO: 145584 - DNA, 354 bp, Homo sapiens
ctggctggctctagaggatccactaaagccaagcccccgacttcaggtgatgggtgatgctatggttagtggttatgattagggtcaaatgtcacagtcaaattcaggagttataggtcacattcagggccagagtcatgagggtcacaattgctatcagggtatgggcagggactatcatcaagggtgatggttagggtcaaatgttactgtcaagttgggtctcaggagtcacattcagggtcaagagttgtggtccaggtcagggtcaggagtcacaggctctggggactgagggactgaggtccaggtcaggaggttacggccaggtcatagttgtgatctgggtcaagg

SEQ ID NO: 145585 - DNA, 269 bp, Homo sapiens
cttgcgaatttagtgactcagactgtcccatcgacttctatttaattttaaggatgtattacacacacaccgctcaaaaaaaagctcctcaaaataattgcatctacatcaattaacatttttattctataattccataagggcatttcatatatacctctattttcttctgcaacaacacccttagaataaatacaacacgagaaagtatacacacttaagacgcactgcacaattacttccacctaatccaaagacaattttcattt

SEQ ID NO: 145586 - DNA, 316 bp, Homo sapiens
catggtgccactgactgttgatgctcggaaaaatagggtttgtcaaataacagatctttgctctcttcagattggagacatgcagatagtttttctccgacaaatctcacattcttattggttgtaaaactgtctgaagcacctacagagcaaatttctttcttaatcataagactcatgcttggttagattttaccaagaggtagcataatgaggtcattttgttaagggattcatactgaatgtatttatttgcccacattagaaaaccagtatttctctaaggtaagttggctagtgtttgaaaattgtattc

SEQ ID NO: 145587 - DNA, 275 bp, Homo sapiens
tgcgcctggcctgcctcacacttctaatctttctcctttttcatctctctcatctctatagctcatctacttctctacctacttctttttcccttttaaggactcaaaagattagatgggctcatccagaaaattcaggagaactttcccatttcagggtcagctcagcagcaacttgatgtcatctgcaaccttaatacccctttggcaggtaaggtaacaggttccagggatttagatgtgtatgtttttggcgggggttgggggggcattct

SEQ ID NO: 145588 - DNA, 131 bp, Homo sapiens
tcatagcttaagaaaatgcctgacctagagactggtgcaggcttgtactctcagactgtagtctaggagagaaatagactgcatagaagaatgaacaaaataacaatgtttagcatctgcctgagaaaaat

SEQ ID NO: 145589 - DNA, 443 bp, Homo sapiens
ggacccactttcctcatctgtaaaatgacaaccacagcaggcttgctgagataattcagagaacaatgacaagggctcatacagtccagccctgcaccagcacttggtggtggggcctggcctgagcctaaagcttgactctagctctgtgtccactttagtgaacatttaaagttgaggagtctgagtttgctcctccatggagggaggacatgccattcatctttctaaatggttgtgagaatcaaatgagtctatgcatggggagtacctaacatgtagttggtggttaacagaagatggctgtcatcattgtcattgtcaccatcaccataatcatcatatcaccatcacaacaccctcaccaccatcatcattaccatcatgatcatcactgtcacatcatcaccatcattaccatcatcattaccatcaccataaca

SEQ ID NO: 145590 - DNA, 262 bp, Homo sapiens
tcccttctctttggggcaggacaatattcgctgtatcacagctttttaaatgagttgtgttctgttctcccggatggagacaccctgatgaattgtgggaagtgccctgttctcatcaataatatgttaaaaatattctagcatgcccctttcctgcttcccatttacactctgtgtatctggcatttgtacatgctgcaaacattaacaatggtgattgttaccccagtggctcagggttggtctccctctattgcctacg

SEQ ID NO: 145591 - DNA, 734 bp, Homo sapiens
tgctgatgtcattctaataatgagatggagatgtttagcctttaacctgtgaagatggcaattgtgagtggattgggacgtagggttggaacatggttcatatacaactgaaccaagggcagctacaatccatcagtgcaaaggtaatttagggaaaggaaaaagtacctaagattaattgcagtcagacggagactgcttttaaagtactttgaagtacaaagacctcgtgtagtccatgatccaaccaaatgttactcattgaaggccaaggagcaatgtgttgggtagggactgaaaacaagcttggtgctttgaacactgttcctgagagcatcaacggaagctatcgagggggacaggagatgacccatgtgaccaagatgcagtgttgagacccgtgggtagtttgattgaaaagccttttaatctcagtgtgaaggagttgcttataagtgacagaaatataacctctgacagggatgcgctgatgaaaaattgataccagtgtcactttcttggcatgggggggaccaaaccaagacagtcggaggctccatctatgtgagtcagcggccactgaggaggaacaggaatcaggaggctcgtctggttggtgatagaatccaccgactgtgctgcctgaatgaaggggagagatttgtgtgaattatgaatagccatgcaggtgagggaggagtgaggttctgtgagaaagggaggcaggccaggtc

SEQ ID NO: 145592 - DNA, 495 bp, Homo sapiens
ggaccctccgacaccacatcagaaaacgctcacgctgcatttagggtatggccatgcagagagaagtgcaaagacacagcacagtttttgaacagggcaattaaattatgtgtgaccatcaggacacatgtactcagagatacacagggagagaactaaacctttttctacggttccgtctcccctctttccacatctacccagctcctaaccagttgttcatttgtgcatgtgtggcctgcattcactcaccatgtgctgactgagggcctcccatagctcactgttacaaagtacaggcagtcacaaccaagactgtgtgtgacaggaagaagtgtatgaaaggattcgagagagagagagaaagctcagtaaagatatatactggtttgatcatcaccacgggaaaaaagaaatcctattgccaggcaccttaagaaaaaaaaaataatttaaaacactgtaggcagttgggtttaagggaactcaacaaat

SEQ ID NO: 145593 - DNA, 550 bp, Homo sapiens
tgggttaaagcagggtatgtcaattctggaaagcagatgaaggaagtcatccactcatgagagacatgcagggagacaaggggaatgacaggcaagggtagacctctacggctgtaggtcaggttaaagaaagctcttatgggattgcccacaatttctagtctatatgcccacagctgatgggagagaggtattttaggaatccctcaaattgtccacctttaatcctaaagagtctcaggattaaaggtggcatcgataaacaccggtgtttatcgatgccacccaagtgtggagtttggtatcctcttaccgggtaaactgaagggatggttgggccatttcatttatcttatcactaattcacaagatagttagaaattcggcctcaagcaaagtaccacatttggaaggttttcttagatttggatggcaagtagatatcagcattttttaaatgaaaagctatattatcttctcccttcaaggcagcctaaggatgttctttcccagaatcactccaagccttcttggcagaattcataaaagt

SEQ ID NO: 145594 - DNA, 147 bp, Homo sapiens
taataagccattccaaactcagtagcttaaaacaacaattactctcattcacacatctgcagattaggtggaggttggctgatccaggttggtcttcactaagcaatgctccgtttttgtgttaaaactgggtccactttatatatt

SEQ ID NO: 145595 - DNA, 185 bp, Homo sapiens
cacctttccaacctgatctcataccatgttcccactactctcgatgccctagccgctctagacactcaccatgctctccctgtcacaggacccttgcacatgctatccctgcatcatctctgtaactcttacttaaccttcaaattccatcttaagcatcatttcctcagcaaagccttacttac

SEQ ID NO: 145596 - DNA, 222 bp, Homo sapiens
taggcagcgggcatccaacggggcaagggtgtcatcacctggacgggggcttgcagtctgggctaaggtcacacagtccggacaggaactccagagctgggagggaccacagaacccagatagaggacaccgaatcccagtccccgcctgagttctcatctccccagggtccccaaccccttcctgggtccccacctccccagggtccccatcccaacaggg

SEQ ID NO: 145597 - DNA, 447 bp, Homo sapiens
aaagtacaagtaacaaaagaaaaaaatcgatacactggactacatcaaactaaaaactttggtgctgaaaactattccatcaagaaagagaaaagataacccacagaatggaagagaatacttgcaaatcatatgtcccatagagaactggtatccagaacaaacggagaacttctacagctcaacaataaactacccaattaaaatatgggcagctgggtgtggtggttcacacctgtaatctcagcactttgggaggccgaggtgggtggatcaccagaggtccgaagttcaagaccagcctggccaacgtggcaaaaccccatctctactaaaaatacaaaaattagccgggcatggcggtgcgtgcctgtaatcctggctacttggaggctgaggcaggagaatcacttgaactcgggaggtggaggttgcagtgagccgaga

SEQ ID NO: 145598 - DNA, 227 bp, Homo sapiens
cacctaacaggccctttctaggtaaatctgcagaaacagtaattgtctcaatctcagtttccctgtggtagaccaaaataaagctttgcatacctaacctagggaagctgcatacagttggagagctggattcaactaaacctggcctgacagctcttcaacatgtttttcttttccaagttccacattgctcactgtgtccttttaacactcctgttttttatttt

SEQ ID NO: 145599 - DNA, 748 bp, Homo sapiens
caccccaactcagtgtccccaagtggtgctatttgtatcatttgtctattttaaagactattatttagttacataatagaattaggtaattctatacatgtcattcttaattaaattatagtttttaattttatgttgcagcttttaattagatgtatgagatattaattattgattttgtttattcaacatgcatcaagaagcaaactaccatatgtcaggtgaagatgcttgtgttcatggtacataaaataaggagtagcccttacagttagagaactcagtgaagtggatagaaagacagtgaacacacttgttatgagtattagtctgttctcacactgctaataaagacatacctgagactgggtaatttataaaggaaagaggtttactggactcacagttccacatggctgaggaggcctcacaatcatagtggaaggcaaaggagaagcaaaggcatgtctttacatgatggcagaaaaaagggcatgtgcaggggaactctccttcataaaactatcagatcttatgagacttattcactatcataagaacagcatgggaaaaatctgcccctatgattcagttacctaccactgggtccctcctacgaccatgtggggatttttacagttcaaggtgatatttgggtgggaacacagagccaaaccatatcattatgtttgagggctggagaaaaaacaataatgggcatgtagcaccacttaataattgatattat

SEQ ID NO: 145600 - DNA, 181 bp, Homo sapiens
tggatttgctggtgcagtacaactaggcttaataggctcgaattcgagcctcgaattcaagcttctaacgttagaagcttaattcgcggctcgaattcgagataaactcttagcatttggaaagtatttgtttgtcttcttccttttaatgatagataaaactcagataagaacacctaat

SEQ ID NO: 145601 - DNA, 442 bp, Homo sapiens
actagaacgctttccagttgaaagagatcatgaaagcattaggccattatgctgaaaccacacctgatctgattacttcatgcatgccttttcctgactgctaaagaaaaagaattttgtgtcggtctttactttagaatcaccacattcaagttttagagaagacagttacaaaagttgcaaatatttgttttctaatcttggcacaatcctcttgcactacaacaggttgcctctgagcatctatgtgttaggcataatttctaggggctgagagtgtcttttttagaaagttgttttaaaacaagtatagtttgcaaatctttttctctagggcctcagattatggtaaagaagatactaaatatgcaaggtctccagggtgtggaagaagagtgtgtgtatcttggaataaaccatctttgtataaagacagcagccc

SEQ ID NO: 145602 - DNA, 551 bp, Homo sapiens
  misc_feature (528)..(528): n is a, c, g, or t
caaaaggctgagggatgcctggcctgatttcctctactttctaaattagtcaaaagttcaaataaatgtctttcatttcccatgaatttgtatcctaatcttagaaagcatgtatcacaaaatatcacaaatgcctttgtactctagtttttacctgattgtgcctgaggagtccttgtcaagaagggcagattggtgagagtaagtaaaacgaatatagctagtatttggtgaaagcagaactccatattctaatatcaacccaaaccaaacacacaactctaagacactggagtagttacaagaactatacttaaattttaagaactattgatccctacccaaaataaatccgatcaaaccaatgcagcacccaatctgactgaacctccaccaatagcttccaaaacttcttccttagcaagaaatcagtaataatcataatgataaaaattagtacaaggatgatcagaacaaagtccaggagaacctctactaggcagaaactatgtattttcccctgtgganaagtagggatcctgtagagtcac

SEQ ID NO: 145603 - DNA, 330 bp, Homo sapiens
ctattgatccctacccaaaataaatccgatcaaaccaatgcagcacccaatctgactgaacctccaccaatagcttccaaaacttcttccttagcaagaaatcagtaataatcataatgataaaaattagtacaaggatgatcagaacaaagtccaggagaacctctactaggcagaaactatgtattttccattttcttattccagagacaaccccaaaatgaatgtattttagaatgtttgttcactaaaatcatgaattatttataaaaattatttttttcagtaactgccaagacatgttaacgcctatgtgggtgaagagtggcc

SEQ ID NO: 145604 - DNA, 154 bp, Homo sapiens
actagttttagactggaatccaccacttattcccctgatcttttccaaacttacccaatcattgagcatgcttgaccctgggcttctgagacagggcctgtcacccaggctggagtacagtggtatgatgatgcctcactatagccttgacctc

SEQ ID NO: 145605 - DNA, 163 bp, Homo sapiens
atgacttaactctgatttcaacacactgtcgggggagtgctgacttctctgatttcaaaatactgtggggccagttctgacttaagcctctgatttcaacacgctgtgaggccagtgctgacttaacgctctgatttcaacacctgcaggacaagggctgact

SEQ ID NO: 145606 - DNA, 657 bp, Homo sapiens
tagcagactaagtttccttaagaaagtaaaaattgacaataaacttgaaagacaaaaagaattaaccaggataagagggtgaaggaatcctgctatgggtggaacagaatgcataggcaaaagagaacttatggcacatgagaaggacttttaaaagtataactagagagggaaaaacaatgggagtgtggtataacatgaggctcaagaggtagagaagagcctcatgcgtggagtcatgcagtcctgaagacagcatttgaagctactgctatttggtaaagtatatgtctaaaaggactattaggagagacagaatcaagcttttttaggttttcagtaatagtgtgttgagaagacaaagcaattgttctcacaaatatgcttccttaagatcattacagaaatttgtttcctttctttcaaagagtatgttttgagagctaaaaaccatcctatcatatttggacaaatagaagtagttactgcttaaggatcaagtgattgtttcttttaaaagttgtgtatgctatgtttgataatcacagcttctaattctcaaaacaagctctcactctggcatatcttgaatttgaatcgacactatggatacgaatctgtatattcaaatatttttgtgtaagtgtgtttgtaaga

SEQ ID NO: 145607 - DNA, 260 bp, Homo sapiens
agtggaaagatcatagctcaccgcaacatcgaactcctgggctcaagctatcctcccgcatcttcctcccacgtggctgggaccacaggcatgcaccaccacacctggctaatttttaaaatttgtgtagagccaggcatggtgactcacacctgcaatcccagcctcccaaagtgcccagccacagttgttagtgtgtataatcataactgccatttattagacagaactggacaaataaagagacctggaaggtatag

SEQ ID NO: 145608 - DNA, 172 bp, Homo sapiens
atgttttgggtggagatagagggagggtggtttgattcatttcttcacaagagagggaatggagacaaagagagggtagaatcctctgtgacccatgatctgaagtcctgtgtgctgtcctaagagttttcataggtgcctgcctgcagttttaagcgactgtcttctgggg

SEQ ID NO: 145609 - DNA, 673 bp, Homo sapiens
aaaaagagcagattaactcgaaatgcatttaggtcatctggaaattgaattcctgtcagttcttatctttgcataatttatcttctcccctttagttaatgcttatggtattttgaagctgatgacatactttattttccaggagagcattaatacagtgtagttgtttgttagtgttggttaaaagaacttatcaacctttcattcccacctccatcttctagttaatgctccacagaagaggctctcagtaatccattttaaaatattcagcttcagaaacctaacatgtacatttcctatcctcagtagagtataggtgtaaatatgaaactaagtgctatgtaagtgtggttattgcattattaggtatggatttcattcatccagcaaacatttttttgagtatttctgtgccaggtactcagatagggactgtgacacagagatgatatatccttgctgcaaggacccttaacctttgttttaacattgccttgctatgatgggtcttgggtgtgagaggctagagttgggtcaagaggataaactattggccgggtgcagtggctcatgcctgtaatcccagcacgttgggaggctgaggcgggcagaacacgaggtcaggagattgagaccatcttggctaacacagtggaaccccatctctact

SEQ ID NO: 145610 - DNA, 401 bp, Homo sapiens
acaacaatttggtagtcaaaggaagttagcctgggctaacttgggtaaaacatggaggagggaatacatcatgtacagtgagcttggagtaacttggatttctcagaggactgccactcaaccagcttgtcacaggtttacagtattacaagcacggcagatgcagtacaatttctacagtccctaaacttgcctcatgcacatgttagcaagaaaactactgatagaagtacaagcctagctcacatgggtttccctaaagaaggcacacagtattatatattttttttctgcacagaagtctgacagctggtgaatcatttgtaaataaaattgatagtttgtttcactgggttttctgtcattgttgactcatgacctagtaaggatttactggacta

SEQ ID NO: 145611 - DNA, 479 bp, Homo sapiens
tctttgtgtacatgtgaaacagaagattgctttatggacgattgacaggtggtactgaaacgtcctcttcaaacaagtgggatcctaaaatgttaatgaaagaaaggacctcattttatgaagaaactcaggtccagagaggttgtgtcatcccaggattacactgtaaattaataacaaattagtagcaggatgaacttgggcaaacatagacagtcatgatgttaaatgctcaaaccctcaaagaacagttttaatgaggattacattgccttctcttgcagaataggttcgattctgaattctcacaaccctgaaagataggtgatgtgtgtccacattttattgataaggagactagtgttagagagcttttgacacaaacagggatggcagagttatgactcaaacctgggtctcctacagtgctgtactgtttctcctacccatttcttaaaactcacagtgtgtcaagggta

SEQ ID NO: 145612 - DNA, 438 bp, Homo sapiens
acatgcataaatgaatatcccatatctttggcttttttttaagtaataggtactaactgaagactctccatttgttactgggatatgaaaaaaaaatagtaacttgtagaactactagacttctagaactactactgtgatcttgcaaaacagcagagaaaaaaataaagagatagataaaatagtaacatgtctagccaaataaaatactcactaatacagtggagtagcatggaatttggcatgagacctcagtttgaatcctgactctaccatttagcttaaatggttgcttctaggcaagttgctaacctctcttagttgcctcagctatagaatgggtataataaaagcttgttttttcagcctcacgttcatgttgtgaggaccagaaatttaattatatcaaagtattctgaaaattagaactcacatttc

SEQ ID NO: 145613 - DNA, 442 bp, Homo sapiens
ttaggtaaattgtggttttagtgtttgagaaagagcctgtcactagtgggagtcttcattattcactggcaagatataacaagcagggctttgcagtaatgcacagctcctctgctcttggcaatcttgtggccgaaagatatttttaaagcccctgttttcagatgaccgtgtttctgattagcatgtgtcttttccattttcagttccacgaagagaaaggcaagtgaaatttgcccagcctcaccatctccaaatgggtgatattactgaacaattatttaatggccccacagcatctgttttttatattttggggtcatactggaagttcaagcttatgaataatccagatatttaaaagccaatgctcaactggatattctccttaggattattttagccttgtctagaatcagagtgtctgtcaattgccacaaca

SEQ ID NO: 145614 - DNA, 835 bp, Homo sapiens
ctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagcgtgggcgggggcctgggaatacagcctgtggaggctgcttactcaacttgtgtctttaattaaaagttgacagaggaaaccacggaagaaaaagaacaaaagggaaaaaacaaaaaaagggggggggcgggaaaaaaaagttcccccccgggggggcccaaagttaacgggtccccaggtttccttgtccaggggggcccaaaagggggggcggaattaaaaacgaaaggcaggggcgggggtttaaaaccggccgggcggggaaactggccgctgggacccttggggagggact

SEQ ID NO: 145615 - DNA, 127 bp, Homo sapiens
ccagcaaggtatgagagagccatttctccatatcctcatcacagagtataatttcacagttttacattttccccactgataggtcagaaatggtgtcctagtgttgttacaactagcatgtttataa

SEQ ID NO: 145616 - DNA, 226 bp, Homo sapiens
taagtaattgcctgactgtgaatgaacagaggtattaaagtaaagttggcacaagggacagcatccacatggcacgttctttgtttcgagagctttattctatcaatactcctggaaaaaagagaagttgctaaataaataatggaagcacacaagacagtgtgaacgccttttcaagtcctcgaattgtcaagcatcttatataaagttctttcccgactctgag

SEQ ID NO: 145617 - DNA, 771 bp, Homo sapiens
aaataattggacaaaacacacaaataaagcaaggcagcgaaagcagagatttattttaaatgaaagtacactactccactgcgtggaagcaggctgtggcaagctgctcaaaagcacaggttgcagaattttctggggtttaaataccttctagaggtttcccattggtcttccacaagtctgattggttgaggaaggggaccaatctgaggcactttcatttttcaactgccacacagaaaaagaagggcttgcaactgccaggcagcaactgccatgcagaaaaaggaggggttgaaggggagtagtctttcaactgatatcccatcagcacaaatcagtcctagcttccctgcttccagaccctattctcctgccgcacaaatacttgtatttaatcgacagatatatcaatttttggaaataatttaaattgtaaacaagagtgtgtccagaagattcctgaatctaggggcaaggtattttcacatggctttttttgtgtgtgaatctatgcaatgaaggtcacctttgaatatatactgtggaggcagcacattcatgcatcacttaaggacggggatactttctgagaaatatttcaatgggggttttgttgtttgttttttgtcatgtgaatatcatagagcacacttacacaagcctgcatggtatagcttactacccacctaagctgtatggtatagcccattgctcctaggccacaaacctgtacagcatgttactctactgaatactgtaggcaattgt

SEQ ID NO: 145618 - DNA, 167 bp, Homo sapiens
gctttcctctgtctctgagtcagcaagtagttagttactgaaatcacatccgctaacaagtccaggcaactgctgactgcattgttcctgttgccttgttttgtatggctggccaaaacacaaacagcagggtgtataaattgattatataaagacatgggaaatga

SEQ ID NO: 145619 - DNA, 802 bp, Homo sapiens
caccactcccagctaatttttgtattctttgtagagatgaggtttctccatgttgccccggctggtctcaaactcctgtgctcaagcagtcctcccacctccacctcccaaagtgctgggattatagatgtgagccactgcatgcagcttgaatgtctttgaacatgtcttttgttgcatatatgtatgcatttctgctgggtatgtacctaggagtggaaagcagaatcatagtgtatacatatgtttagatttggaagatactgctagttttcctgtgggtcaggcatttaagagcagtttagctgggtgattctggcctagagtctctcatgtggttgtactcaggatgtcagggaccacagtcatcttcaggctttactgggattggaagactcacagtgctgttggcaggaagcctcagctcctcaccacggagctgcctcctgacatagcagctattacagcttcccccaggtgagtggtccaagaatgttgcagtccttttaattttagtcattctagcagatgtgtggtgatatatttttgtgatttcagttcacatttccttgatgacaaatgagattgagtaggttttcatttattggtttgttgttttggttttcttaaaaatatttataacctattttaaatttttattagctctttattttttgaatattcatttttcctgacatcctgttttcattttgtggatgcgatattttttatccctctcatattgaggatagtttcttcactacctgcctcttctacccaccccccaggttttatttctcta

SEQ ID NO: 145620 - DNA, 745 bp, Homo sapiens
gtcatttttctcttctcatttatacttcattgctttacatagtatttacgtactttcagtaataagcacaactggcataaataggtttgtgaataaacacactgtcaccattgataagcacacttcacagagggggaaccagaagtgttgttcccatcacattggagaatagcctaatggtgtgatgtcagttaaattggataagagagttctgtgggatagtttgctaagagtataaggcaacagttcacagaagaaagtaatggattaaaattgaaaaggaatccaggaccatatttgtcaaataccttgaaggtcaaggtgacaagtttgtacttagattggtaggaagtggaattttttattctaaatggcatgattgatgtaaaaaagttcaaatggcttaggagtgtatgaagtaaaaagttacatttccctagctccattccatgtcagtagccacttcattttctaatggcccctagaacatgaggttgttgtgaaggcatggtaaacaccacttggggcactggtattaatctgttaaaattttcaattcagctttcctttggattataatctcaattttgaattgagaaaaataaagtttccatactaaatgtgaataaaatgaaatgactgttttgaaagtagataccatactcataagagtctttgattcctaagtctttctctacctcttttgtccaacttggaagtcttggtagagaaggacttaggaatc

SEQ ID NO: 145621 - DNA, 636 bp, Homo sapiens
agggtcacagagatcaggtgtgctcattcagttccagtgaaaggaattagccttaccagaaaagagaacacgctgtaagccactgtaattcagtcagcatggcacttgttcaaatctagacaaatagaccattgaaacagaatagtaaatccaatttacagtatttgggaatataatttatgtaaagatgacattatagatcagtggggaaaggatatataattcattaaatggccctaatatgactggccattggaataccaagaaaaaaaaaggatgagggatataaagtcaattcatcaatttgtctaggagacttacatgtaaatctaaggacagagaaaaacctctgagtttctaagacaagaaagctaaagaagagatagacatattaaagtatactggatttttaaatttttgttgtaagtataccataaacaaagtcaggaaacataattttgatttggaaacaatattagctaatgtttattgtatacaaaagccttctttaaattgacaagaaattggtaaataccccagtgccaaaatggtgaaaagatatggataggtaattcatagaagagcacgtccaaatggccaacaaacacatcaaacaatgtttgaatacatccattg

SEQ ID NO: 145622 - DNA, 202 bp, Homo sapiens
ctgtgcaaaggccaccttgtgtggagcactggatacagatcgagggtcatcctcgttgtctttcctgtgtcttatttcataaatttacctctgccgtgactgacatttgcaatttcctttccgcccaatgccacagccctaaatcagacttttattacctttcacttacacacggtccctgattttccatgtgttattccct

SEQ ID NO: 145623 - DNA, 291 bp, Homo sapiens
agggaagtgcaaccttagggaggagaacgtgaaaagtttggctgatagcatggaggactgtgacgtttatattaaagttatttgtgtattaacatgatgtgagttttcttacagataagcagaatttataaaagtcctattggattattcttctgtcagtaaaagaggtttttttaggggttgggggactagtcaagtgaaacagtgggagtgggagggaacaaaaaaatctatacttgtgatcagttagctgtaaattactgctgtacttgaccagtgatttattatagt

SEQ ID NO: 145624 - DNA, 159 bp, Homo sapiens
agctccaactgggaacttgcgttacatgcaagattgattggatagggaacactccctgacaaagagctacataattagaaatggatcaagttacagggaggataaggggaaggcttcacattcataatagagctcaagacattacaaattcatgctgac

SEQ ID NO: 145625 - DNA, 420 bp, Homo sapiens
gagacagagtcttgctctgttgcccaggctggagtgcagtggcatgatcttggctcactgcaacctccacctcccaggttcaagcaattctcctgcctcagcctcccaaagtgctgggattacaggcatgagccaccgcgcccagctgaggccctgagttttttaaagggggattctgagagcactggttggagggactcaaggagaagacctaaagtaagaagactagtcgggagacaatggtaaagactgaggttagggatcttgagggctgggcagtgccagaagacctagggtggggtcaagtattagaaacgaggggcagcatggataggacctataacgaattgaatatggaaacaaagaagaaggtgaaagaatggctctgctttcatctgggataccagatggagtaaagag

SEQ ID NO: 145626 - DNA, 404 bp, Homo sapiens
gtaactgtacatcacagaaaacagaaacagttttggtggtataatggtacatcagaaaatgatggctgaaggtggttatttggccctgatgggcaggtttcacagttttaaaaggaaaacatcaatatgctggaaaaagaaagttattgaggtcatcaggaaagtaaattatcctaaaacacaatctaatttatttttaaagtcaattttgggccgagcacggtggctcacacctgtaattccagcactttgggaggccgaggggggcagatcacttgaggtcgggagttcgagaccagccaacatggtgaaaccccatctctactaaaaattcaaaaattagccaggtgtggtggcgcatgcctgtaatcccaactactcgggaggctgaggcaggagaatca

SEQ ID NO: 145627 - DNA, 367 bp, Homo sapiens
aggaccaaggaccttacttcactactcaatcacacttgccatccaaaaaaggatagcatatttggatagagttcatctttactggttgaacaatcactgctcttccaccagttcgcactgtcttttaaaaaaattatacaagcaagtaagaatgacagtattatgtacatacattttacatttttcacccactctaaaaactttgcaatagctttctatttcctctcttggcaaatgaaagttctgataatagatttattgttgagtctctaacaatatacctctaactcttattccaaccaggctgtacttagcatcccaatgaactgatcttcccaattctctctctcagtcacataaaggctgg

SEQ ID NO: 145628 - DNA, 469 bp, Homo sapiens
agcctgtaggggcaagggcttcctgggctcctgagagtgcagggatgcccaggtccagagcagctgcagctgtgcctgggagcatggggctcccaccctgccaacttggtagggggtggggctcccaccagcctcgcaaagcacgcaacccagaccctgcctccctgttgcagccggcatcttcacagtggctcctccagatgggccaccactgctatcaccactttaggaggcgagtcatgaggatcacttgagcccaggagttcaagaccagcctgggcaacatggcaaaagcctgtttctacaaaacaaatgcaaattgtagctggttgcactgttgcatgcttgtggtcccaactacttgagagactgaggcgggaagattgctgagtccaagaggtcagggctgcagtgaaccatgattgcactactgcactccagcctgggtaacagatcgagaccctgtctg

SEQ ID NO: 145629 - DNA, 500 bp, Homo sapiens
cacccatattgttgctgcctaccaggagaggaacggtgggtcacaggtagagcccattcagccgctgctcaggactttcaaggttagtgggggcaacagagacaagcagaactggaacccttgtgatgaaaatgtcaaaacccgtgaatgctcaacgatgggagcaaatgtgctgcccaggatttgtctttttcgtcctgatcttcagacccgggaccacccgcacccctccagcatcccgtggtccagcaggctagtgatggttaaatgccatcattatcccaccactggcttggtgggtttctcttttaaaaaatataagcctaattgagttgttccccatagcacacctataacagatgccaaagacaaattgctgttcatgcttttcagagaaaaacagagaacgtgggtgactctccccacattagcagtccagcaggagaacaggagtgcccctgtttcctgccagaaggcacagtgtgctcattccttacaga

SEQ ID NO: 145630 - DNA, 451 bp, Homo sapiens
cacagcaatgggaaaatgctgccaagtattcaacataattgaagctaattgcaaatagcagccttcagttgaaatgcactatccaaagaaaggcagcttggttgagtagggtgtagaatgggttgttattacataaaataattattaggcaaagtacaagaaggccagcaggatagttttacatcacacaagggcaatgatcatactttgatgcaatgatcatactttgatggggttatatggatagtctttctttggttagtagaaaactaagctggtgaaaagggactctagattagtaatgaccacatataaactagtagccacctgagatgcaatctaagagcagcttccagctctctgttgttcaatattaaattaaattattcttcagaaaaggtcagcctaatattctctactgaaaggaagacacataattcaaagttatgga

SEQ ID NO: 145631 - DNA, 668 bp, Homo sapiens
agtcatagcaggccccagccatttccaagcacactcccgcaatcttcctagtcagacagcgggaactcacacacaaagacaagaggactgcaggaaaaaagttgatgaccagatgccaattccctacaagaattgtagtccactgcgggtatacgagaccttaaagtactactatcaaggactgagttctaaagttagactttaaaccatgttaagtggtaaaagaataattagcacccttaataggggacctgaattttggtgcttaatggaaagggagcgtggtgctaagaaataaagagaatggtctcgtatttagtacaattatcataattttagaaacagccttgggcagaaacaggcaaaacaataagctggaggttttgtggcaaatattctccaaacatattgcaaccaactcaaaaccatcaagtctcaagaaaatcaggcaatgtgaagcataaaactgcattagttcctttactgccaccactaaagagggagggacttagagaagtgaagtgtgctcctggtcttcgcagataattgaaagcccccgaaaagcaccccttttttgagctatgttgcataactggggataaccgtatatcgatgaatctccatatgagaagagaaatcaatggcagttcgccatcttggagaattta

SEQ ID NO: 145632 - DNA, 617 bp, Homo sapiens
atatactttttaatctctagtgcctaccacagtgtctggctaacagaagatactaaaaaactgctgaattgggctactgacttagaaacagccatacaaatacatgtgacatggattcatccaagtataattcagttagatctagccccaaaggccaactccattgtccatcattctcccattattgatacttttctgagtttttaaaggttttgatttccttggcatcctctaataaaatgcaaataccccaagccagtattaaatcctagagttgaaagattctatagctatcggttgatgccttagtttgaaagcaaggattttcagaagttgacaaaagagggctgggcatggtggctcacacctataattccaacactttgggaggccaaggcaggaggatcacttgaagccaggagttgagagaccaccgtgggcaacatagcgagaccttgtctttacaaaaaaaaatattttttaaatcagccgcgtgtggtggcagatgcctacagtcctagctacttcaaaggctgaggcaggagaattgcttgagctcgggacttcgaggttgcagtgaattatgatcactgcactcaccttgggtaatagaaaga

SEQ ID NO: 145633 - DNA, 564 bp, Homo sapiens
ggtgcgcgcctgtagtcccagctactccggaggctgaggcaggagaatcccttgaaccaaggaggtggaggttgcagtgagctgagatcgcgccactgcactccagcttggcgacagagcgagactcagtctaaaacaaaaacaaagacaaaaaaaccagaaattattgtcagtttgaaatgaatagccaaatagtttctcatgatttgacttctattttaagtggttaaatctcttgataactttgctttttgccttcccaatattgagtcctaatgtaaaataaaataagataaaattccccaggttttgcctggaacgtcatttttgagaatggcattcatttgggatagctttgatgtctaaacactctttgaatttcccagagggtccctgaaagcacttgttgtcttgttgtctattctttgaaaatgaggttaataagggccgggcgcagtgactcacgcctgtaatcccagcactttgggaggccgaggtgggcggatcacaaggtcaggagttcgaggccagcctggcaaatatggtgaaatccggtctccacta

SEQ ID NO: 145634 - DNA, 915 bp, Homo sapiens
atgcttgtcacatttcatgtgaacagaatcaactaaaaagttctgccacaaatgtcataggaagaatgacaaaaaagaggttcagtgatccgcgtgcctataatcccgaggcatctacgtcactgagataagaaagggcagccggcatatcttccctcccacccctcatgtatctcttcccatcttgatttaaaacaaagccagtgttagaggagactggagttttcagattgttggctttctttttgctgccatttctattcctcaccaagaaagaataataaagctaatactgaaacttccaatttacaagcttccaggtttgaaaatacatagatatgaacgaagttacctttcagagatgagtcaaccactggccctgcaagatcacaagacagtagcttatcactttcaatttataagtggaatggagaacagcctttccaaacataacctgtgagaggagtttctgtaatcagaaaactgacttgttggcttgtatccgagaagcctttcctatcaccttagtatgatagttctctggagagctgtgaggaaatctttcttttaaagtggcggtcatctttgaaaccaagcatgcataaggaagtagagcacagtacaggaaaagaaaggccctctgctctgatcacacaccaccacaacatcctgacagatgacctggccatgcacagctgcctctccaggaaaatcttccactctcatcagggaacactggactggataactcaggtattcctaggtgaagtaagtcagacaatatggaaatgaagaaataaaaagagggctttcagggcacacagctcagtttgccaaattcaacatggctacaactgatccccaaatcctgagtaaacacccttgctatttaataagcacaagcaaaaaaaaaaa

SEQ ID NO: 145635 - DNA, 283 bp, Homo sapiens
catacaagcaaatgagatacgattctgttttttcatgtatgccccagagccaactagagactaaaatatattaagtgctcaataaaatgacctcactgaatgaacaaaccctgaattatttgaaccaatgaagatagaataatggtttccccaaggatatccacttcttaatccctaaaacctgtaaatatgatatgttacatgaccagggaaaattcaggatgcagagggaattaaggttgctaatcagctgacattaaactagggagattatccaggagtg

SEQ ID NO: 145636 - DNA, 363 bp, Homo sapiens
aagatatgtgttcttttagcaaggttggttatgtaggttcccctggtgctgtctctattaagagtctagagtggtttctcttgttaagaatagtccttccctttctggtaaagcaggggaaggcggagtttttcttatgtctgcttcttctcgattgccttcagctcaaaataatccttatggcagagtgacatatttttgggtggcataccgtgaactctttcaaaggtaaattttaagatgtaagaaaaaaatagtttaaaagttgaagttgattgcttgagaaaaatatttttattttttgatagaaatctcatttgaaaaatggatgtacaaaagatagttgcaattatttatggaact

SEQ ID NO: 145637 - DNA, 394 bp, Homo sapiens
ggctatcatcatttcttatcttggccacaatagccttcttactttttatttaccagtctcgatatccttttcactgtagtaacagtgacctttctcaattaaaaatctagagtcattcagaagttaaaacccttcagtggttcctccgtacctgaggatagtctctaaattcctgacatggtaatgacctatctatctgttcagagtaattgcccacccaagtccactgatgctccatcaatatctgatttcccacaaatcctgaatatacaatgttggatcagagatttatgaagttaaccaactattgtctctgactgaaatccccttctttgctttgtcacacttcaaacacctgacctatccaccagaattagttcttcaattcattgat

SEQ ID NO: 145638 - DNA, 406 bp, Homo sapiens
tagttgcttctcctcctcctagctttttctagcttctatggacaagaagaacggaggtttcaggctccagttgctacgtgagacctaaaccgtctgtccttgcccctcagtcccacccaagctcaactccactcattgtggctaaaaatacaaagactgcagcaggctaggccttggtgggcacaaagaggagacagatggtcactgttccttctaggacaggagctttagactcgggcctctgccgggaccaggcagttcacatatataagtggaatgggccaatctgtgggctagacctgacctacgggctgccagttggcaccatttagagacccctagagtttgggaagataaagtttggacacaaacagaagggcaacaaagaatatactcagcctcatga

SEQ ID NO: 145639 - DNA, 421 bp, Homo sapiens
tcctctagatcaaggagtcagcaaacagtttctgtaaagggccaggtagtaaatagtttaggttttgtgagccgtgtttctgtcacaactactcagctctaccatcgtaatgtgaaagtagctatagataataccaacacacactagtgtggttgtagtccagtaaaactgtataaaagcaggtggttggtcacatttggtccaggggccatagtttgttaactcctgccctaggtaaaatagaagattatttctttaatctttaaagtgtgtgtgtgcacttgtgtattagattacaaagtgcctcatgttcaatggtaatatgcaagaagtatcacagttttatttaacgttgctcttaaagagctagtcagtgtaattagataagagagtgaagggagatatgacatcagaaagagag

SEQ ID NO: 145640 - DNA, 473 bp, Homo sapiens
taatattttctaagaagccatgtgaggcagtggttgagactgtggacactctgaagccagactgcccaggcttaactccaccttcaagctgtgtcactcacataacctctctgggcccatgtcctcatctgtaaagtgggaagagtaaccacaccgacttcaggaggttgtagtgagagttgaggtctgtgtggcctggccgttctgagcacaggtcttgcagtcagggacacaggccccatggcttcctcactgtgggctctcggctgagggatctaacctctctaagatcaagcccttcatctatgtgagaatctagtgagatattccagaaaagcatttagtaccaagcctggcacatagtaaacatctggaaatgcgaaacagtgaccaaagtcccatccctttcacggccattgggctagtccctgcctgccaccctggccacctctcatttcacatgccctcaatca

SEQ ID NO: 145641 - DNA, 323 bp, Homo sapiens
gacaagtagggtgatattttccttggtctcgtgccgaccctagtaacaaaagtctctcagttacccagggcacctgggagagagtgagggaacagttctgttcagtgttaagcaagctcctctcctgtgaataaccttttctttaaaaaaaaaaaaaaaaaaaaaaaaactaaatggggaaatgaggaacaaaaaaattcaaaaaaattcaaaggttggttggtggacagaggaaattgattgatatcttgccccagaggccaatcttttagtggctcaggccattttggcttagagctgtgtggtgggaacccttctataga

SEQ ID NO: 145642 - DNA, 429 bp, Homo sapiens
ctccaagctcctgagaaacattatatattcactttggagttttaattgctataaattatcatgcatggggaaaaaaattggagagacgtgggatctaccaccacatcactggagacggccctaaaatccatcagattgtttccggtataaaatcatgttttccaacctcacatgggccttctgtgcaactctgcaattcccccatgcacctcttactgactcagtgtattactcaaagaaccattacctgcctctttatgtaatcccatgtccaattccatcatggttactctctgcaaaaactctacttcttaattacctgggacaaatgaggcgacctgatatgacctccttgaagtcttttcttctctgtccaaaatttctcagcactcatcccttatgcctttgtttctgtcttcatggctgtac

SEQ ID NO: 145643 - DNA, 380 bp, Homo sapiens
aaggaatggagttggggtaagctccatctttgatgttttttaacctcgctcctcattcagaatctctacatggggtggctgtagtaaccacctaccatcatcgtccatctggcttagccactagcagaaaagaacatctctctcaggacctccagcaaatattctggggttgaccttaacctacataggtttccacgaccctccctgaaccaatcactttctctggctctgtgcatccagaatgatttgccaaagcaaaatcaaagtggcattaccaaaaaagggaggaatgcatgcagagccagcagagtccatagctgtccactacattctctatagggttgcaaccaagtgctttgaactcaggcaaactgaggttc

SEQ ID NO: 145644 - DNA, 718 bp, Homo sapiens
atgaagccatggtccttgagggagttggaccccctggaagtttcaccacatgagtggtgacgcaggaggattctgtcatcatcagtgacaaagtcatgactgttgactgaagcagggtgaattacatggtgtgcgttgctatatgtgcaaagacatatcttttgtttcctgaatataattttggcctagattgctttaaatggaacttggaaaaatcctgcagaagaatcgagtcttgtttatttctccaaaaatgacttcagttcctttctttgctctccctcatttcatccttcccgtctctgcctttcagtgatgctcagaggtcagggaattgccctaacaatctgtatatttctgagtggtggtcattaattttccttggcttggctgaggaaacattcctctcacctcttttgagcatcgagcaccaccttggtgtgaatgagttttgacaacggaaccttgttcttcagccagggttgaagaagttggtgaaattccacttcctattaattttcttgtacaatttggacacctaggaaaacatctgaagaaagttttcattttgtgagctcataataaatgccataacatggtgtgccatgctgttggcttcgggtgtgacttttgtacagaaggtgtgcaaagaatgattactataaagattaattaggaacatgtaatgattctgtcttttaaacttttgaaatatgga

SEQ ID NO: 145645 - DNA, 534 bp, Homo sapiens
agctgggcatggtggcacacacccacaactgtgggaggcgaggcgggtggactgcttgagccaggagttcaagaccagcctaggcaacatggcgaaacctcatctctacaaaaagtacaaaaatgagccgggcgtggtggcgtgtgcctgtggtctccactactcaagaggctgaggtgggagggacacttgagcctgggtggtcaaggctgcagtgagctatgaccttgctgagtgaaagaagcaaagacccaaagagctatgtaactgcatgattccatttgtgagacattcttgaaaggcaaaattataggaatgaacagatcagcgtggccaggggatgccaagaggggaagggggagggatgacctccaaggggccaatgcatggatggaatcgtttgggggatggaacagtctttaccttgatggtggcggtgaaaacacattctgtgcatttgtcaacatctactacttaccaaaaacactgtattttgctgtatgtatgttaaaaataaatttagggaaagattca

SEQ ID NO: 145646 - DNA, 411 bp, Homo sapiens
ggaccctgtctcaaaaaaaaaaacgtactgtggtagccaactgaaaagatttgtcacagaaagatggttgaaatctggaaatggtttacttttggggcaataaggattgtcagtgccatattttggatgtcccctccaaaatgcatgttgaaatttaattgccattgtgatgttattgagaggtggaacctttgggaggtgattgggccatgggggctgtgccctcaggaatggattaatgttactatctgaggagtgggtttgttataaaatggagttcagccaaatttttcttttgctctcctcagcgcaccctctttgtcctctcaccttccaccatgggatcacacagcatcaaagacccttgccatatacaggtgccatgcttttggatttcccagctcctaatca

SEQ ID NO: 145647 - DNA, 695 bp, Homo sapiens
ttaagctgaaggctgcataccaagaaaggaggagacattcaagaggcattcatagaagagttggattgggggcacgttttcaaagaaaaaaagttatgaaatggcagaaaggaagcaaatagcattctcagatgggatatacatatagacatagtggtactaaactgtgcactagggataaggaatcaatttccctagagaaacctatgttggagacagaagttgggcagagaacattaaaacatactcagaacataaaaaggtgcaagtctttaaaagggaagccaagttacagaggaaataaaaagcatttgacctttttcagaatgttttttaagggtggactgaggcatcatcataaccaacaggggaggcagacaagctgaggcagtctgggcttagagtaataagcacctggacagctttgtattttgtgcataccatggagactgtaaactcctccaggacatggactgagcaatgttctgtgtcttcaactaagtccactactgttacttgaatacatgaacgcttcttgtgctacttctggtggaaaagagtgcactgtgttattcaagttaatagcggtgtggaaatgttacctgtgtttcatgcctaactatactgattctcccaaatgtccacacagttatcctgccttcctccctaggccaatgtcaaaaatccattgtttc

SEQ ID NO: 145648 - DNA, 348 bp, Homo sapiens
gaatttaaaccctggcctggagcaaaattaaaagttatcatgaaagattttcctaagcctcaggggtggttgagcagaaattagttaacaattcaggattttattaggtacttattgttctggattaaacatctgtaccaaatgattcagttaattgttagtccatccaatagagaaaaaaaattataagcagcagggtaagaaaaaaattaaataactcagttgtgcaaaatgaaaaacaaacgccttaagtggacaagaaaaaccttgaaaatccagtacaaaaagcaatttcaaaaaaatctttcttttaaaagtatgttagacaaagattaaaaattgtaaact

SEQ ID NO: 145649 - DNA, 625 bp, Homo sapiens
gaataggaccgcggttctattttgttgtttttcggaatgggccggaatgcccatctgtgctgtgccatctccagcacagtcctcttcacaccattatcagcagaatggcttccccatgcaaaacagtgtcttatttctgtcaagaaagatccttcctcacaccctcacctcatcataaggggaacccaggctcaacccacctccccagctccatccactgccaggtgcatctctttgaatggatgtacctccatcatcctgtttgctgataggcccaaacttttgtggattatgactcctgatcctggaagctgagaacttgtgcaatggatcatctctgaaatgaggcttttggctcgctggggtgcaggcttagcctccctgcaggtcctcagcagcaccagcaggattaatgatgagcagtgtggcagagaggtaagcttggagacattatgtgaaaaggttctgtctttcctggacagttgcagcgaccctaggatttctcagttctagtctttcttcccacacacctctagtaatccttccaaaagaaatgcaacttacaactcatttgctaagaaacctccagagttcccagctgctcaacggtaacggctgattatat

SEQ ID NO: 145650 - DNA, 278 bp, Homo sapiens
tcctgcagacagacggaagagcagggactgaaatccctgcaagcacaggctctcaaatcagtccattcagatgggccggaatgcccatctgtgctgtgccatctccagcacagtcctcttcacaccattatcagcagaatggcttccccatgcaaaacagtgtcttatttctgtcaagaaagatccttcctcacaccctcacctcatcataaggggaacccaggctcaacccacctccccagctccatccactgccaggtgcatctctttgaatggat

SEQ ID NO: 145651 - DNA, 1121 bp, Homo sapiens
gaataggaccgcggttctattttgttgtttttcggaatgggccggaatgcccatctgtgctgtgccatctccagcacagtcctcttcacaccattatcagcagaatggcttccccatgcaaaacagtgtcttatttctgtcaagaaagatccttcctcacaccctcacctcatcataaggggaacccaggctcaacccacctccccagctccatccactgccaggtgcatctctttgaatggatgtacctccatcatcctgtttgctgataggcccaaacttttgtggattatgactcctgatcctggaagctgagaacttgtgcaatggatcatctctgaaatgaggcttttggctcgctggggtgcaggcttagcctccctgcaggtcctcagcagcaccagcaggattaatgatgagcagtgtggcagagaggtaagcttggagacattatgtgaaaaggttctgtctttcctggacagttgcagcgaccctaggatttctcagttctagtctttcttcccacacacctctagtaatccttccaaaagaaatgcaacttacaactcatttgctaagaaacctccagagttcccagcccttttaaaacatgaccgtcaattcttctggtctaggccgtcacacctttcgaagaattagattccagtagaccttagtaagcatgcagtttagtggtttttcagactttggatttttctggactagaaaaagttccaattgcacttcttagcaggacctgtgaggccagcgccttggggactgttttctgccagctgcaccagcccccacctgccctggctctccttgtgctcagccataccccttgtcattccttgctccatacagagcacaaagcccactccgtgatggcccaagtgctgagtcgctacccacatgcccttcctcgcctcatccactcactaaccctactcatctgtccaagcacaagtccaccgcggcctcctctctctcggtttccataaactcctttccattttcttgcctggaataaatggtatttcatttctctctcttcttatggtagttggtaagtaattctatcacttgatagatacctacctatctatcgtacaactcac

SEQ ID NO: 145652 - DNA, 324 bp, Homo sapiens
ctcggcctcccaaagtgctgggattacaggcatgagccaccacggccggccttgtaatcgatttatattgataaaagaattagtcacacatcccgaaggcaccccaaactcagtatgaccaaattgaaagcattaccattctcttcaaatcaacacatccttcagtatactatactccatctttctgttactgtcaggcacccagtcactcaagtggaaaacctaaagttaacctagacctctcttcaacctccatgttgaaacggtcattcaattcggtcaattctagatctctgatctttctctaggtccagcatttctcta

SEQ ID NO: 145653 - DNA, 300 bp, Homo sapiens
gagatattgtgattccagttgcaaaaatacatcacatgagaaggaacttaataaggaacttttgcattcacccatcttctcccaagcaacgcatttttgttcttttacatccttttttcttaggatattcaggtggtttttaaaaataagctccactaaggagtttatttgaaaagggagaagatattttttggacccaacataatgctaatgttgcctttctttggtgagaagaatgccatcttgtcattcacacagtgtggcccacaggactgccttcttaccaggatcaaagacaaa

SEQ ID NO: 145654 - DNA, 810 bp, Homo sapiens
cactggtgttagaggggtccaggcagattggttctttttttattcagacaagatctcactctgactcaagctggggtatagtggtgcaatcatggctcactgcagcctcaacctcccaggctcaaatagtcctctcacctcagcctcctgaatagccatcactacaggcgtgagccatcacacccagctaattaaaaattatttttgtacagatggggtcttgccatgttgcctatgctggtcttgaactcccgggctcaagtgctcctctcacctctatcagggaacctgccccgatattcacgtaggttcttttctattttccttaagtatcagccagcttgagaaataaagggacaaagtacaaaagagagaaattttaaagctgggcatccgggggagacatcacatgtcggtaggttccatgatgccccacaagccacaaaacccagcaagtttttattagggagtttcaaaaggggagggagtgtgcgaacaggtgtgggtcacagacatcaagtactttacaaggtaatagaatatcacaaggcaagtggaggcagggcaagatcacaggaccacaggaccgaggtgaaattaaaattgctaatgaagtttcaggcaccactgtcattgataacatcttatcaggagacagggttttgagatcagctggtctgaccagaaattattaggtgggaatttcctcttccttataagcctgggagcactatgggagactggagtctatttcacctctgcagtctcaaccataagagatgaccacgcccggggggccaggtcagagac

SEQ ID NO: 145655 - DNA, 181 bp, Homo sapiens
ggttgagtgcccagggctggtggggggaggtggggactgtcctgctgccaactcccctcttgagggccagaacacctagagtggccaagcacctgccctggctcctgagcccacagaggctggcctgtgtcctctctggggcaacaggctggcagagtgagtggaaggagcgaggaggtct

SEQ ID NO: 145656 - DNA, 426 bp, Homo sapiens
gaaagaataataagaaagctacttaatttgcaacaagcaagcgcaattatataaactcttctttcttacctatggactgtattgaaattttggtttcatttaaaatatctgtattagttcaggctgctccaaccaaatgctgacctctgggctataatcttatcaagaacagaaatttctcacagtttcggaggctgggaagtccaagatcaaggcactgacagatttggtggctagtgagggcttgcttcctggttcataaacagccatcttcttgttgtagtctcacatggcagaagaggcaagagagctgtctggggtctttcttacaagggcactaattagattaatgaggttccaccctcgtgaccccatcacttcccaaagatccaccaccaaataccatcacattagggacctgtatgc

SEQ ID NO: 145657 - DNA, 179 bp, Homo sapiens
ttctattgataagtaagctaggcccagagatgtactagctcaaaggcaccctagtacttagtagttgactggatggtccccttgactcccagttcagccttgaacttctggggcctcatcttgctgtggttcaagtctttggaggtatgagaatagagggagccatgatgtcactccaa

SEQ ID NO: 145658 - DNA, 644 bp, Homo sapiens
agaatgaaagaggagtgatttgcatgtgtaaatgactttcgtctacagaacagctatataacatgtcgtcaaaaatgttaaagattcatagggaagataacaaatatctacgtacctcgttgatagactgccaggtgccaaggcattattactagagaaagattttcattttcattagattaagcatgcatagcaagtagacttaaacaattgattgaaatcagaaaatgtcaaagctgtatttagaaaattgagttcttttaaagcagtattaagtcaaggaaaaatcacagacaaaatggagtggtagtatatctctacatttaattggaaattttacatatggtaacagctactgttaaattatccatggctaattcatcttaaactgaagtagacaattaagcatgttctggactattaactggttcatattttaggtgcttgcctaattagacatttcctaaactaatcatttgcactggctaattttttagaacattttattgagaatttgtagctttttttgcatttactgtttttgaagttatttttttaagaacattgacttgaagatacataatctactgtaaacgttgcagtgaacttttattctaaccctataaataaatagatcataccat

SEQ ID NO: 145659 - DNA, 419 bp, Homo sapiens
gttggtgctgagggtcccggcgcctccgcggcgtgcactgtcccgcacgccctggcgggtgagcggctgggggtgcgtccttgcatctcttcccaccgggaatgagactccggtgctgctgcccggtggccgggactgagtctggcttggcgtggaccgggcctccacggcagcctggacgtcgccgcgccctccggtgcctcggaccaggagaggggttgggtgcacgcggttgagtgggtttatgcatctttgttggtcttatctgcccggggagagtgtgcacagtgtataatgccctgccagtatttgctattttcacagaacctggatctttctcacttctctcttgaccaggaacttgtgtacccagtacctgtgctgcgtgcatttcgccagcctttctggctaagacgttt

SEQ ID NO: 145660 - DNA, 491 bp, Homo sapiens
ggcgatccgtagttagctctcctccattaccaacccctaagtgtttagagttcctcagaacttgcttctaggcattttcctcactctttactcatccacacaatgatctcatacacttgtttttttctttagagagagtctcactccgtcatcaggcagtgcagtggcatgatcatatctcaccgtagcctctaactcctgggttcaagtgaaccttcccacctcagcctcccaagcagctgggattacaggcaccctccatcatgcctagctaatttttatatttttagtagagacaaagggaaacaccggtgtttccctttgtctcctgtggcccaatctcagatgttcatcttctcacatgtcatatcagtgcttctcaaatgtcaacctgcatcataattaccaaggggcctgccagttcctgagcatcaaccacaaagtggtgactcagttgattctgatgaagacggttcacagatatactgctc

SEQ ID NO: 145661 - DNA, 448 bp, Homo sapiens
tgtacctgcttactgggcgtatggggctacgggctcgcacacaacacagctaattttgtatttttagtagagacggggtttcaccatagtggctaggctggtctcgaactcctgacctcaagtgatcctcctgccttgacctcctaaagtgctggaattacaggcatgagccaccgtgcctggcagctgcatttttctttttcttttcttttttaagatggagtctttctctgtcacccaggctggagtgcagtggctcgatctcgtctcactgcaacttccacctcccgggttcaagcgattctcctgagtagctgggctgcagcaggcatgtagccatttggagactcagtttccttatctttaaaatggggggagcctacagctccctaaaatttaggaggagagggctaggcccaatcatttcacacacttgctttgtatctct

SEQ ID NO: 145662 - DNA, 543 bp, Homo sapiens
tttattctgcccagtctctgaggaaatgctgataaatggtgtgggataaacacatgataaatgctgataaatagatatgtaagtctttgctgacttgtattattcagaattgtgtggtgtggatgtggcctcatcagtgacacaagtgctgttccagtggcgccctctgtgctgatggacacattttatagctgttctatccagtgtagtagcctgtggccacctacgtctattgagcatgtgacatgtgactgaggaatcggatttttaattatctaattttattgtattggacagggcagaacagagtaagttccctttgtggtggtgttttctttctccttctagaagtgttttatgcatttattgttttctattttttttaagttgttgtggtacattggagatgtatatatttttagggtacatgagatgttttggtacaggcatgcaatatgaaataagcacatcatggggaatggagtatccatcccttcaagtatgtatcttttgagtttacaaacaatccagttacactcttta

SEQ ID NO: 145663 - DNA, 428 bp, Homo sapiens
acaaggacctgctgagccaggccctccagtgctggcctcctgacctgctagccagactctgtccatactctggacctaccgagccaggggtgttctgactagaaatatgtgttacctccgatagttgcttcagggtcagttgtttcaaactggggctgtatgttttaaatggtttttggctcttccattgaccctgcagacattgggagcagcatgtgattctgtagcactaagaattgtaatacagaaatgaaatgcaattcatatttttgtttctggagaagatgtctcatatatcatcttggaatattttctgtaacctatcccacatacctccaacccacctccagcgcatatacacatgcacatacagcatgtactctccacacccagccccctgcctttccccgtagtcagccgggtaccga

SEQ ID NO: 145664 - DNA, 481 bp, Homo sapiens
acaaggacctgctgagccaggccctccagtgctggcctcctgacctgctagccagactctgtccatactctggacctaccgagccaggggtgttctgactagaaatatgtgttacctccgatagttgcttcagggtcagttgtttcaaactggggctgtatgttttaaatggtttttggctcttccattgaccctgcagacattgggagcagcatgtgattctgtagcactaagaattgtaatacagaaatgaaatgcaattcatatttttgtttctggagaagatgtctcatatatcatcttggaatattttctgtaacctatcccacatacctccaacccacctccagcgcatatacacatgcacatacagcatgtactctccacacccagccccctgcctacagtgcatcccacctccttacactcccttaacctcacaacaccaccacacaccccaggccctaccccacacacttcc

SEQ ID NO: 145665 - DNA, 313 bp, Homo sapiens
ctctagcggatccctggcactgttcggatgctccacctcctgggtttaaatgattctcctgcctcaccctcccaagtagctggcactacatgcgggcaccaccatgcccggctaatttttgtatttttagtagagatggggtttcaccatgtcggccaagctggtctcgaactcctgacctcaggtgatccgcacacctcggcctcccagagtgctgggattacaggtgtgagccactgcgcctggcctgtcctcaacttttaactattacatttattacttattttgccttgtatccctcactaatacaccc

SEQ ID NO: 145666 - DNA, 441 bp, Homo sapiens
gaaaatgtttaattttagaaactgcagaagtatctgaccacttaactttttaactttttaattttgtttttactttttaattttttgagatggagtctcactttgtcacccaggctgcaaggctagagtgcagtgatgcgatttcggctcactgcaacctccacctcctgggtttaaatgattctcctgcctcaccctcccaagtagctggcactacatgcgggcaccaccatgcccggctaatttttgtatttttagtagagatggggtttcaccatgtcggccaagctggtctcgaactcctgacctcaggtgatccgcacacctcggcctcccagagtgctgggattacaggtgtgagccactgcgcctggcctgtcctcaacttttaactattacatttattacttattttgccttgtatccctcactaatacaccc

SEQ ID NO: 145667 - DNA, 561 bp, Homo sapiens
cggccaaccctgtctcacaaaaaaataaaataaaataaaaataaagtaaaaagggaaggtacagagagggagaagatatttgcagcatgtacaaaggatcatgtttagaatatataaagagcctctacaaatcaataagagaaaggcagacaacccagtttttaaaatgagcaaaatacttgaataggcagattacaaaagatagtatccaaatagccagtaatcatatgggaaggtgctcaggctcaatagatataaagaaaatgctagttaaaatctcattgcattaccactaccaaaatggctaaaataaagaaacccacaagaaaacctgactatactgttttctaagtgttaggaagaatgtagagcaattagaactctcatacactgctggtggaagtctaaattggaaactactctacaaaactgtttgagagtgtctattaaaggtgaacctgttcatactgtgtaactcagtagttcagctcccaggtacacccccaacagaaatgcatacatatgttcactaaaagatacatactagaacattggttgcac

SEQ ID NO: 145668 - DNA, 293 bp, Homo sapiens
aattctcagtaaaactctataaggtagatttattatcattctcattttacagatgagaaagcagggtcttggatgagttaagagagttgcccaaggtcatacacgtaagaagaggaagagcttggattagatttacccaattctagaaactatgctgaccctaaggcctaggtagtctgcttccatggaggtgactcttgaaatttgtccattccttatctacatttggagttttggtctttgtttccaacagtcagtgagactttggtgcttttatgcctacaagcattcac

SEQ ID NO: 145669 - DNA, 378 bp, Homo sapiens
gtgcaaccatcaccagcgtcctaccctcttcatcattttgattactcctccagcgtaataatcttggcttcagaattcactggtattgactgtagcattgttagtgttagtgcaccattttggggggggtactgttttgtttctaataattttattggcctgtctgagtgtggaagcgcactgggtaaagttgagattttcactttatattgggtcttgggttgtttgataataattcagagttcttcattcaatgagtatggcttattaacattaattttaattttccctaaacttgttattttgtcctgtcaagattgttgcttatctgccacttcatgcttatcacatggggcctcatgtgctttttatatagtt

SEQ ID NO: 145670 - DNA, 135 bp, Homo sapiens
tttccttatgcacacacaagcagacacctgtatagatttgtatcctcccacttttataccaaaggtgatataatatacacacaattctttaccttcatcatttcacttagcagtatgtcttggagacccaagtag

SEQ ID NO: 145671 - DNA, 407 bp, Homo sapiens
cagccgtgtatggggtagcttgcagctcagcccactgagcatttgggagcctcttatctgcgtactgagaacaatgaaaggattcccatgtccacccccagttccacccactgtgggttcttgtgggccttttgagtatcagagatctccgtggccagggagctgccgactccagcaacctggacccattcacaccaggctggtgggagcccctcgcgcactctccaagccctgcgctccccacctggatggaactgatgggcccctgagctgggtgggcaatgatcttcatgttctgactcttagcagctccaccaagccattgccttgcgtttagagagctcgctgaatattttctcagaaattaaatacacagatttcccgggtatggtcattttgcccaggaa

SEQ ID NO: 145672 - DNA, 741 bp, Homo sapiens
attgcctctatttcattcattgcctacactaaattatccaatttgtgctccataatgaaaagaaatgtattattccaagaaaccttcataaaagttttcttgcttgattacagtggcttttgagctggagctttaaattatgatatagtatctcacagaaaatggaaaagaagcacagaaaaactttgctaaacataatcaggaggaattagcccctgtaattttgtcccctcatatgagcagggaatagtagtcttacttcccttctttttatatggaaaacatattttctagtacatagtgatatgttattagctggaaggcaagtcttgctttctcagtgaaaaaaagtgaaaaatttggggcagtctcatgatttttgcaaaactttaatggtgctggaaaaagagtttgaagtttttaattttttattgatatagaatagttgtacatattttgggggtacatgtgatattttgatacctgtatataatgtgtaatgaccaaatcagggtaattgggctacccatcacctcaaacatacatcttttctttgtgttgggaacttataaatcttctcttctattttgaaatatacaataaattattgttaactgtaattttcctactgtactgttgaattctataacttattccttctatctaactgtattttataccccttagccaacttcttttcatccccccttcctctcttctaaacctctagtaaccaccatt

SEQ ID NO: 145673 - DNA, 278 bp, Homo sapiens
ggcttcatggtctacaggggaggctgatatctcctgggaacctagctgagatcacttcctccacacagagctttgcacatgggtctgctaccttcacccaacaaaggttaatcccaacttagtaagattttctgtaccccattatcaaccccaagagctcccagcttctctatgagatttttttttttttgaggcaagggctcactctgttgcccaggctggagtgcagtggcgcaatctcgggtcactgcaatctctgcctcccaatctcttgctca

SEQ ID NO: 145674 - DNA, 386 bp, Homo sapiens
atctggcttcagagtctccgactcctgcccataattacttcctcactgaattcctgactcttctatcctcattctcttcaactgtactactcagcattctccctgtccctcaagattcttcctgcctctgcttcctgggcccatccttgactccttccagttcctgaacagttcctctcctgcctcctttctgctttcctttctaaagcagaagcaactctcagtgctgactctctctcctctctcttttcacttacacagtcagtgattgcatccactctcctttcactgctgagccacctcaaaccctaacttctctcctcactgacttggcaggtgtcgtgtgtcagacaggcaccgtactacacacgggagactcagcagga

SEQ ID NO: 145675 - DNA, 380 bp, Homo sapiens
cctctcccacagttgcagtatttttgctgggcccacagggtggacaggctttggggcccctccaccagcaggttaagccttttgctttgcacgagaaaagggcccagcagagtgcttgatgattcatggctgtcagtcagttgcttctgcctgctatgagacatctctcctgtttttcctgaccatctttcttgaagcacccatgggaggcaggtaccctgtggaagtcagaaggttgtctgggaatgtgagctccctgtgtcgggcacatctggctttgtttgagccaccccatgctcctgccagccaccatctggccctgggcagctgactgcaattcgagctgatttctccctgccatgttaggtgctagcaggtgt

SEQ ID NO: 145676 - DNA, 738 bp, Homo sapiens
cactagttcctgctgtaccatttcctaattcaaatttttgaataaattattttgaattatgagttaatacatctctgtgactgaaaataagctgttttctttctcttcaaattatatgaaggtatgaaaaggtggtttgaggcatcttttgctgtgatgatgaagtgctagaaataaagtgaatttcaggcacccctggtggtcctcaatgcttaggtttcttctgaatctgattcaggggtcctctttttattttgaataaaatagtggcttacatatattcctgaagctgcagtaatctacatgacttaggccctgtttgtttttagaaagttgtttctgtttttttgttttaaacaacaatattgtctcctataaccatgtgttcaaaactttgagatcaggagaggccactgttgactgtttgaggctctgctagcaggcttgagctaagtgcagtagaagtgtcttccagcacaccctttctgtcacacagtcagtggcttactaacaacagtaatgccttgtatttgagggagcttttggtttttagagtgcggttgaaacactgtttccttctaggtccctgaaacaccaaccctgagaggtaggaactactcatgaggaagctgacaaaggttaaagtaacctggctgaagactcagactagtgagcgtgaagacccctgctgaaaaaccaggcccttctccctccacggcagcaacactctccgtcacc

SEQ ID NO: 145677 - DNA, 746 bp, Homo sapiens
tcctttagaattaagtagcttagataaattttcatcaaaatctttatatagtagggaatagaaaaaagtcaattctgttttatttgaggatgtatgaatatgttaccatttttcagactctgatttaccttccaattattgtttattggggtcattgtaaattagttatcattttttgaatacacattcactgctgacaaagtggtgaagccagaagttatgtttgaccagggaagattatgaccctcaaaggagaaaaattcacagggggtagttgattattggtggaatggagtgagagtgaattccttaaaagtttaaacgaaagcagaactatattcatatcatggagggaacttagtttctaatatgatgaactattgccccaagtcatgacaataccttgctctctggaagagaatgagtgagtttttcatccgccaagatacacactctatatttccaaccatcacatctgccttgcaggctgactgaacccagagcaaatcaatcacaaaagttaatccaaaagacttcccttcagctgctggaaatcagtcatcacatctgtgaaaagagtgctagttataacaaatgagatcacaaatttgaccattttattagacaccctctattagtgttaacagacaaagatgaaggttaagttgaaatcaaattgaaatcttcttccctctgtacagattgcaatatctgataataccctcaactttcttggtgcaaattaa

SEQ ID NO: 145678 - DNA, 181 bp, Homo sapiens
ttccaccgcctttactaaaaatacaaaaaaattagctgggcgtggtggtgggcacctgtagtcccagctactcgggaggctgagactacagacgcactcgaccacacccgacacccggctccaaccccatttaaaacagagaaactgaggatcacaaaggttaagcccctcgcttaaatca

SEQ ID NO: 145679 - DNA, 828 bp, Homo sapiens
gcatggtggcacacttgtagtctcagctactcaggaggctgatgagggaggatcgcttgagaccggaagtttaaggttgcaatgagctgtgatcacaccactgtactctagcctggatgacagggtaagaccttgtgtcaaaaacaaaacaaaacaaaaacacacacacaaaggggtgtgtgttggggggagattatttcacaggtaaaactaatcaatggtgaggaaaaaagaaattacagtagtggtttggggaaggggcatgaaggaactttgtagagtgacagttaatggtctatatcttttctttatttaagagacaagatcttgttctgttgcccaggttgggttgtagtggcgcggtcagcagctcactgcagcctccaactcctgggcttaatcagtcctcttgccttagcctcctgagtagctaggactacaggcacgtaccaccacacctggcttaattttttgtagagatggggtctctccatcttgcccaggctggtttcatactcctgggctcaaatgatcctcctgccttggcctcccaaggtgctgatctatatcctgatagggctctgggtcacatgagtttgtcaaaactcacattaagatttgcgtgttttaccttaaaaaacaaaactgtaaacaaatattgatctctacttaattgtgtgtgtgctgagatgtttaggtatctgcagctgactttgaaatttattaaaacagtaagacggactgatgaatgaacagaaggatgagcagatagataaagatgggcagatgtgatctcacaaaatattaattgtgggtttgggcatacag

SEQ ID NO: 145680 - DNA, 759 bp, Homo sapiens
cgtgatgctccagaattcctctctggccccacagctgaaagacatctcttctgtgattttctgactgctaatctgacactgcaaaccccaggggcaagagttctgcctcttctctactgcagcctatctgaaggaagtgatcagctcaattgggaactgttgatttgctacagtgattctcactgtgcattggtgattgggggctactgtcagaatatcatgggggaagggcatgtgcggcaattctaaacagtgtgaaaaaagcctcctaggaggctctggtaggtctgaaccttgaaaatctctgccctgggggtatttggatgggtttttgggagtccacatcccatgaaacagaatgtatatttttgggatcacaaatcctttgaaaatttaataaaagctatggatcttcttctaagaaacagacaggttcccatgaactttgtatataatcttcagggctttgtggaccctctgcagcccatccacgtacccttactttctgttctcctatattagagatacagattgatcattgccactccctatgaattgcccattgtccatcaatgctggggatgttactgctcatggctgatatgagctccttggagactggaaagcacaggtacatgcaacccacagggacaaagagaagaggttaaaccccagtgctcaggctgccctgagcagagctaggtcaccaatttaaaagttctggaatccacatttcaggaagatatctccccccatccc

SEQ ID NO: 145681 - DNA, 467 bp, Homo sapiens
gttgcccacaacacagtggatgcaaagtgctgtattgaattagatatggagtacaagcaaaagagctaggaaacaaaagcgggacagagaaaacattacaaaacaaagtagtagtcatggaagggaaaacattacaaaacaaagtagtagtcatagaaggcagaaaaggttccagcatagggacacatggagagcctcaagaaaactaaacaaaataaaacactggaaaataatcaatatttaattcatgcaaactcctgttagcagcagcgaatcgtaatggctctgtgacaacctcaattcttgcagaaggaagtagagtagaaggaagaatttgaccaaggggcataaggcagactgagagactgaggcaagtttcagagcaggagtgaaagtttattaaaaatcttaaaaaggccaggcggggtggctcatgcctgtaatcccagaactttgggaggccaagg

SEQ ID NO: 145682 - DNA, 132 bp, Homo sapiens
gacccggcaatcccattactgtgtaaatactcaaaggaaaagaaatcattctaccaaaagacgcatgcatgcgcttgttcctcgttgtgctgttcacaacagccaagacatgcagtcaacccaggtgcctgc

SEQ ID NO: 145683 - DNA, 208 bp, Homo sapiens
caactcccaattatcctgtttggaaaggagttctaggaggacttctcttcctcctaagggcagctgcataggttcattaatttttttgctgagcttctattatgtgccagacactcttcttatttttctgcttccccttttaaaacaacctcttacttattcttgataggaaaacactgtccttttacaaagattcacattaccaatt

SEQ ID NO: 145684 - DNA, 251 bp, Homo sapiens
caggcgcccgccaccacgcccggctaatttttgtatttgtatttttagtagaaactgggttttaccgtgttagccaggatggtctcgatctcctgacctcgtgatccgcccgcctcggcctcccaaagtgctgggattacaggtgtgagccactgcgttcagccgcccagccgctgattcttttaacactgctttttatggaattaatgacattcaggtttaataaaatatctaaatttcagaaatcagtc

SEQ ID NO: 145685 - DNA, 288 bp, Homo sapiens
gtcagctggcagagaagcaaatatgaatagggcagggtgctgccaacaaggaagctgaataatgaagagtgttacttgaaattggccctggaaactggcttgctgcaggtggagaaaggaatgggggtgcgggagaagggcatcctaggcaaaggaaggacacgagccaagcctgagaggcggggcctgctgtgtatggtggggtgggccttgtatttggagaacaacacgctttgtagtttgaccggagcctagggtacatgtagggtcctgggagggataaaactt

SEQ ID NO: 145686 - DNA, 654 bp, Homo sapiens
ttctttgttattctttttgcttctctgaactttaagtcagagcagcttcctacggtttgattcagtgctcatgcaactttacgtgatgtcaaagccctttggtttatcttctttaattttgttagtttgcggattgtctcgaggattttaatttgcctatttccttaccaattatgcattctttttctgcctcaacagcagaattaggggtattatagtttatgaataactggctctgacattcattcattcattaaatattggttgagggcctaagtggtacctatgatgccaggttctgggattatagaggtccctgcccttgaggaatttatgatcccctgggagcaagatttaaacaagcaatacaatcatgcatgctaagtgtgatgccagagcgattgctgggtgccactgggatgtgtgaaaaatatctaagatgtggaacccagtctcacaagactagagaagcaagatgtaaaggtttaaccaagactgaaggatgactagcagttagctcatggtagcaagagtcttttagatcctcagtatatacttatttttatcataatgatacatgaatatgtataaacataaactagatgaactccttaggcttttgacgctagcaaattaatattttaaaaaaaaaaa

SEQ ID NO: 145687 - DNA, 281 bp, Homo sapiens
gcctcccaggttcaagtgattttcctgcctcagcctccctagtagctgggattacaggcgcccgccaccacgcccagctaatttttgtatttttagtacagacagggtttcaccatgttggccaggctggtctcgaactcctgacctcaggtgatctgaccacctcggcctcccaaactgctgggattacgggcacgagccactgtgctcggctggattggttttaaagacagagttgaccagatttctgggttggatataggatgagaaagaaaggaagg

SEQ ID NO: 145688 - DNA, 371 bp, Homo sapiens
gttttaaccatcatttcaaaatgatgcagagtatcttttcatttgcttacttgccatctgtatatcttcggtggtgaggtgtctcttaaggtttttgtcctgtttaatagggttgtagtttgagaattctttgtatattttggatagcagtcctttatcagacgtcttttgcaaagattttctcccaggctgtgactttttattttcttggcagtatctttcacagagcagaaatttttaattgtaatgaaatctagcttatcacctctttttttctaaaaagtcatcaccacatccaaggtcatctagcttttctcttatgttatcttttaggagttttatagttttgccttttacatttagatctgtaa

SEQ ID NO: 145689 - DNA, 158 bp, Homo sapiens
  misc_feature (128)..(128): n is a, c, g, or t
actcagcagaaaaggatagtggctgaatagaaaccttaccctgggttcatttcgaggcctggcaaagctgagtccctaaaggctagtgcttctattcagccaacctgtgtgactagtgtgggatcctnctatgatgtctgacctgcatgtgcatgcaa

SEQ ID NO: 145690 - DNA, 370 bp, Homo sapiens
aaaataatctgagatcaaaatttgagtattctttttatgcactgcattctttccaaagagtgacatagattaagtgatctatacttaacaatactctagcaactttttaaaactaacattgcctggaaagaattttttttcaagagtcaaggacttgctctgtgacccaggctggagtgctgtggtgagatcatagctaactgcagccttgaactcttggggctcaagcaatcctgctgcctagcctcttgagtagctaggactacagctactccaccacacccagctaattttttgtagagaaggtgtctgtctcctttggttgtccaggctggtctcgaactcctgggctcaattgtcccaccctggc

SEQ ID NO: 145691 - DNA, 356 bp, Homo sapiens
aagagccgctggtttctcatctgtaataattgggtgatagcagctatcctgtggcatgtcatggcactcaaatggagtcatctgtgtgagacacctggtatggtacagtgcctggcacatggtaggtgatggagaaaagtctcctccattcttgtgtgcacatgtggacaccatatcctccctgtcagcattgttttacagagactgtgttcctacaggctcataaaaaaaggcctggatgaaactgccatatacaaattgagagcatttgctgagattattttcgttctcaaaatattaactttttttaaaggactagccacagaattggtatttttaaataaagaccctataac

SEQ ID NO: 145692 - DNA, 252 bp, Homo sapiens
cgcgctgcagctcacttgagcatctgtctcagagaagcagctcaggctgacaggaaggcctgggtttcccagttcaggccttatccgtcgccacacgtgccacacaccacaaaacgttactaatactaacatctcaacaaggactcctgattgactgagtgttcaattcatcagagaggcaaaaattttaagactcaacctctctgccaactttgttatccaaaaccatttatttgaccttccacctcttcc

SEQ ID NO: 145693 - DNA, 396 bp, Homo sapiens
ctcccaaagtgctgggattacaggtgtgagccactgtgccggccttatttaattatttttataacagttttaatataactacccttgtttaaagggtacttttttttttggagacggattctcgctctgtcgcccagattggggcgcgatctcggctcactgcaagctccacctcccaggtacgagtgattctcctgccttagcctcctgagtagctgggattacaggcacctgccaccacacctggctgatttttgtatttttagtatagatggagttttgccatgttggccaggctggtcttgacctcctgacttcaggtgatccacccgcctcggctcctcaaggtgctgggattacaggcgtaagccaccatgcctggccaaatatttttta

SEQ ID NO: 145694 - DNA, 323 bp, Homo sapiens
ggggaaaatcaatcagtctgacaaattgtgagacgagacaggcgttgaggggttaggaagggttaggagaaacccaaagaatgacttctccccacgcaccttcagagcttaattgtctgtcaataaagacagatgcgggagtgtgtttctgtatgtgttgggggaggggtggattagagctggtggaaataatgaaccttggaggatttgtttttcaagtgtatcttggaggcatctttgtgggacacctccccacccccaaccgtggcagacaacaacccaagcaaactaccaatcaggaaagacaatcacctacaagtgtt

SEQ ID NO: 145695 - DNA, 282 bp, Homo sapiens
gtgaggtagtttccatagcaaccaggattaagtcttacagcagtgtgcactgttcaccctggcgctgcccattaccagatttcaaagcattaacctttaatttcaaattaccaaaccatttacactccctctcctgcatccaggtcctgccattttctactattagtctgaccaaatggactcccccacagggctggagttctggtgagtagcacagtagcttgtcaacattactactaagtggctgctgggaaatgcccacaggttgacaagatagtgttg

SEQ ID NO: 145696 - DNA, 381 bp, Homo sapiens
acacgaagtgtgacgaaacgacccgaagacggtgtgtgacacagacaaattatatcatgagtaggggtaatcaaaagacagaaaggaaaaacaaatgtggaaggaggaggtggcttcacagacaggctaagcagggtgggtgagaggacacacacaaccgagaggcagtgaggagcccaagcttgggccgcagggagacaagctgcccactaaagggaggactggaggcgaggccaggcaggctggggtggcctgggcagcaaaggcagcgtctgacggagtgagtgttactgcactttctttttttctgagcaaaaatacattcaggtttcatgaggccgtttccagataacctcattatttctagtcttcgggtcgttg

SEQ ID NO: 145697 - DNA, 591 bp, Homo sapiens
tgatagagacatagcatctcccatataagagaatataacctaaaagggggaattttattttattttattttattttattttattttattttatagacagagtctcactgtgtcacccaggctggagtgcaatggcacagtcttggctcactgcaacctccatgtcccaggttcaagcaattctcttgcctcagcctcccaagtagctgagattacaggtgcccgtcaccatgcccagctaatttttatatttttagttgagacagggtttcgccatgttggctgggctggtatcaaactcctgacctgaggtgatccacccacctcagcctcccaaagtgctgggattacaggtgtgagtcaccgcaccctgcctggaatttcattttaaataggaagtaacctatttcttctaatgatttatctcagattaatcgcttcagtgtataatctctcaaagtatttttgctacatggctacaacgaaagtattaactaaaattagtattttacccaataatttagcaccttataaatgctagttactggaaatgaaatgcaaaagtcaaaagatgctgcccttaaggcaccag

SEQ ID NO: 145698 - DNA, 221 bp, Homo sapiens
gccatttgtacattctaaactcttagttgacttagatgagaatggattctaaaatctggtttttcagattgaatcctaatgtaagttaaattggtattctgttgtttttgttttgttttttgagacaggatctcactcttgtcacccaggctgaagtgcagtggcgtgatcttggctcactgcaacctctgcctcctgggctcaggcgagatcctcctgct

SEQ ID NO: 145699 - DNA, 159 bp, Homo sapiens
agttagacagtgaatccttggctgtaacagttaccaaaactcatggcaggtcttgcttttcctataacccaccctcttgtttcacccaaccctgtactggatttttttgaagcaaatcccagacatcatactatttcatttataaacacttcattatgt

SEQ ID NO: 145700 - DNA, 459 bp, Homo sapiens
ttaaggaacactttgagacagaaatggtaaaaaattaaaaaatcaaaattaaaccaaatataaaacacaatgaagatgcatatgtcaatgagcttgtctactttgttgaccagcttcgcttcacatgtaccctagccagagacctctgccaagttcttggcactcactccatctaagaataggctgtcacatacgctgcaccagatattccaaactacagcaacctgatgtgctaaaatgccccaccaagtataagagttacatatgaaaatattgcagtataagaacatttgaccacagaaaactaattaacacaaacatttcccaaatgtagaaatgattagtctttttcaatagagaagttattttagaaccgaatcaactattttatgctgtttcttataaataggcagctgtgttgagtttttgatactagttcttctacaagtggttccttgt

SEQ ID NO: 145701 - DNA, 215 bp, Homo sapiens
aattttatgttccttcatgtttttatttaaagaaactgaatcaagtaccaaacatggaataaaggcaaacattcatttttggggtgattgttcccttcttggcaatccctgttttattgagggtatcactagttattcattccaaggattttttttttttccacaggaggtgggcgtttctttgtcttcttagagtcaggattccagatctgctg

SEQ ID NO: 145702 - DNA, 318 bp, Homo sapiens
gcttgggaggctgttgcagtactgcaggagtggaagagtgaggactagattagaatatagaaggagggatccatataaaacatatttcaaaggtcttgatgactcattgatacagaggatgaaggaaatgaaggaaaagatggttaaagataattccaatgtttcaagattaacataatttccactgtactaggaacctcaaaaagcaatgagaataacaaacaataaagtataaaaagggctctgatgatgttgaacagtcaataaataaaactgctaaatggcttgtttgatatcctagtagttcatttacactta

SEQ ID NO: 145703 - DNA, 171 bp, Homo sapiens
tgtgccggctcagagtagaaacgcgcctcacctctgcagccttgggcccctagggaccagaagaggtttccagagtccaggagcatgactgatggcggggaagcttctggagccagccagaggccccaagcctggaaagcaacagcctgtagccagcttgacctgctctcc

SEQ ID NO: 145704 - DNA, 223 bp, Homo sapiens
tgcaccaccatgcctggctaatttttgaattttttttagagccagcttcttactatatttgcccaggctggtcttgaactcctggcctcaaggagttcccttgaggatgttccacccatgtcagcctcccacagtgctgggattgcaggcttgagccattgtattaatagttggcctacactgtcttttgtttcttcatttacaagaggtaaaaatcagtaag

SEQ ID NO: 145705 - DNA, 242 bp, Homo sapiens
agctgcagagctcaggagtcgttctgatatcaggcccattggtgggtttagctttggtgcaagtttcttggccatggagcttaactaggaggaagtgaattgcaatcattttggcctgtgctccttagagtcccagggatcaatgggagacgagtgactgggtgggcgggtagagcaaggagaacagggtgcaggagacactgccacttatttatttgtttttcctacaaatatttattgag

SEQ ID NO: 145706 - DNA, 1091 bp, Homo sapiens
tattttgcacagggcaaaggtgatcacttgcctttaaatcaagttaatcaaagtggaatttagtttaatgtctttcgtagctcatagcttagggggaagatgctgtgtgtttgagacattcacatagctgcatatatcatctccttgcagacatagctgggaattattttgctgcacacattagtgaaatataccaacttgaaatgtttgtgctaaccgagtgacctgttttctgtgtcatcatgtgtgtaattctcttatgtctgagtaaaaggctgagatgaaggtctgtgtctctggatacccgtggggttgctaggaaatgattttcgaagtgctctgtggtgatgcagcaggttgaactttttttgtgaagtgttgtcatggaaaccaagtgcatcattgccttgtctgactaatttatcttttaatgataaaaatttgtaatccagggttaacaaatataaataatacaaatgcaataaaaaaccaataactgtaaagggaatactgctgtaagtagcgaatcctttgaattggaagatgtcacaggagtattgtgtgattcatgttggtaagggcttggcagtgtggggagctaatcagtttgttttccttcttgtcattggagtagggaaaccatgatttcactctgtggcttagtgctgtgggcttttattactgacctcggctcctgagcttataagtaaagaggaaggcgctgcacaccctgtgaggctcagcaagcttgccagggttttgttttctgggtggttgcttagttgtacttctcctttatgacctctcactctgctctctccacctaagagaaggctgggtgacacaatgcaagccctaccattgatgaaggccagtcatatggaaatggtgccacaggcttgctttctgggctaagcagtcctacatcccccttccccaggagcaggtcctggagcacagaatctgccttgacttccttttcgtggttaaagggccctcaaggagagaaaacctgctcttttgtttattgaggacaaagtcttatagcattgtaagatatcaatggatgctgcttatatctggatgagtag

SEQ ID NO: 145707 - DNA, 385 bp, Homo sapiens
aactgggttggggggaggggatgtgtagtgttatttttataaaattcctaaatgttgtactaaacaaaattgagaaagaagtatttttttgaatagaatagaagttgtaaatgaaataactaatcacaaccagaatctttggttttaatgttgaaaggagagggggttggttgcacactgaggatggttctccaatacgatgcctagggaaaggcactggcttcagctggacgctcactccagcaggattctttgcacaatgctagcaaagatcagtgagaggaaggctggagccaggcactgcttcatgacagcttgaatttggcaagacgggggataagagttaatgatctccagccacagagtggcttaccatttcctttat

SEQ ID NO: 145708 - DNA, 224 bp, Homo sapiens
ttctcaggaattgtcagtggatgtgtggatggacaggtgagaagatggatggatggaagaatgagtgaatggaattgtcagtggatgtgtggatggacaggtgagaagatggatggatggaggaatgagtggatggaattctcaggaattttcggtggatgtgtagatggacaggtgagaagatggatggatggaagaatgagcagatggcattctcaggaatt

SEQ ID NO: 145709 - DNA, 669 bp, Homo sapiens
ttgaggaccccctgcgcctggtttctctgttccttaatcgtctctgcaacccacactttatatttcaaactagctgttttcttgagaacagatttatataagacagcccctgatgctgctaccactgtatttgagcaactgcgtcaaacaacctatcttaccagaaatacagtagaaaaagaaaagcacttacacccattcccccacccgagcaatgactaaaaaaggaagtgtctaaattaccgacgtttaaatcaagggacatgcccattatcatgtttggagaactttggggaggggtgttgtgtccacaaaatgaatgtagacatgaactgcttttacttttgtacacctgatgcagaatttctgagtgagttaatttaatccaacaggtaagtactgactacctgctaaatgtgagggaagagatgaagacagaagataaagaaaaccagccaggtgcagtggctcatgcctgtaactctagcactttgggaggcagaagcaggcggatcacttggggtcagaagttcgagaccagtgtgaccaacatggtgaaaccccgtcactactaaaaatacaaaaaattacccaggcatggtgacacatgcctgtaatcccagctgctccagaggctgaggcaggagaatcacttgaacctgggaggtg

SEQ ID NO: 145710 - DNA, 173 bp, Homo sapiens
ttattcctaagaagttctcatgatactgtggactccaaacatttatcccatgacttggtcatcacacctcttactttctgtctatactcacgtcctcccacaaaccaaccctttttttgttaagagagagggtctttggccagtcgcggtggctcacgcctgtaatcccagca

SEQ ID NO: 145711 - DNA, 164 bp, Homo sapiens
tcatgatagaagcactggttgccctcagagagcagagaagagcaaggcaagacagctgcccacccaagtttggcacagagccaggggaggctacttaccatggggaaagggtgagtgactaagagcccctgaagacccacacttctgccatggacctttgcaat

SEQ ID NO: 145712 - DNA, 556 bp, Homo sapiens
aggtgagaagcctgaggctgggaaaggggttccgatatgaactcatctgagacaggttccttgtgtcttcccgcaccaccctccttagcatggagctctcatcctcacttccccaagttgcagcagaaagacgggcagaggcatgctccagaagagtcttgtcttgtcttgtctttttttttcttttcttttctctcttcttttcttttcttttctctctctgtctctctctcgtctctttctttcttttgagatggagtctcactcagtggcacaatctcagctcactgcaacctccgcttcccagggttcaagtgaaaccccatctctactaaaaacacaaaaaatcagccaggcatgctagcaggtgcctatagtcccagctactcaggaggctgaggcaggagaatcgcttgaacccaggaggcagaggttgcagtgagccgaaatcatgccacttgctctccagcctggacaacaagagcaaaactccatctcaaaaaatagtaataataacaaaataggaattttgttaataaggcaggggggagaatga

SEQ ID NO: 145713 - DNA, 164 bp, Homo sapiens
tctcctgagtagctgggaccacaggtgtgcaccactgtaacccaactaattaaaaaaaaattttttttatagagacagggtctccctatgtaaagaagaaggcttttcttttaaacaatgggaactagataggctaatgagaatatttaatagagaaggtgaga

SEQ ID NO: 145714 - DNA, 203 bp, Homo sapiens
agccgaaagccagccatgtcggaaaatgcttcctgctggttggaggggagggtgcgcatctgaaatcaacatcttttttggggtccagcttctaacctctgaggtccagtagtctgacagcttgagatattcacatgacagctatttcgttcccaagttcaaatgcaacagtagacagtaaattgtgctacagtcccctacca

SEQ ID NO: 145715 - DNA, 120 bp, Homo sapiens
aaagaggagtatccactagtgcagtttaactgaagcaatgtattcacataaatagaatgaaatgctatagagtctctagtgccaggctaatgtaatttagactttattccatagacagtg

SEQ ID NO: 145716 - DNA, 402 bp, Homo sapiens
agactgtccattggctcattatgccctatatatagttttaaaaacaattgttcttttttgttgttgtagttttttgttgttgttgttgttgttgttgttgtttggtttttttgacacagagtcctgctttgttgcctaggctggagtgcagtggcacgatctcggctcactgcaagctctgcctctctgggttcacgccattctcctccctcagcctccttagtagctgggactacaggtgcctccaccatcccagtaatgtgactctttagtagagacggggtttcacagtgttagccaggatggtctcaatctcctgaccttgtgacccgcccacgtcagcctcccaaagtgctgggattacgcgtgagccaccgatccagccctcgttgcccttttatc

SEQ ID NO: 145717 - DNA, 351 bp, Homo sapiens
tgattgtacttctaggtgaacagtattcccacagctcatagacaaggtacctaaatgaagttcttggttggagagagaacagcaaactagaaatatgaataaataaagatgtgtgtgaggtgagaatggcatggtttggatagtaataacttctcttagtcctcagctcctaaaacatgaagattttatttcttgaatataaacttgtcaagagctaacttaaagtacaggttgaatgagttaaacattgccacttctcatcataacttcttttgatgaataatttattctttattttttctgtagagtttaagaaatagatgtatgtaatgattacagtcatttatagta

SEQ ID NO: 145718 - DNA, 409 bp, Homo sapiens
  misc_feature (11)..(11): n is a, c, g, or t
  misc_feature (13)..(13): n is a, c, g, or t
  misc_feature (23)..(23): n is a, c, g, or t
  misc_feature (28)..(28): n is a, c, g, or t
  misc_feature (30)..(30): n is a, c, g, or t
  misc_feature (35)..(35): n is a, c, g, or t
  misc_feature (39)..(39): n is a, c, g, or t
  misc_feature (42)..(43): n is a, c, g, or t
  misc_feature (45)..(45): n is a, c, g, or t
gagagggagantntatgtcagangatangntaaantaantanntnaataaaatcacagaatgctgcaatgaagggaagtaagaaacttcaggtgaggtttccaatattgatatggcattcccagattaaaagaagaaatctatgggtttaatgcatcctgcaaacatttttttttcctgaatttcctctcattcaaaaactgtggatcccaaatgatgccggccaagggcgtggtgaaggcaaattggtttttctttaacccttgaaagcctgctggaggcacctgagctatgagtggtcacccgatatggaagaggaccaagaggatgggtttactgtggtgctggggaggggatagtagcagagaacgtaggagttgctggtcattctagtggtgatggaagggatg

SEQ ID NO: 145719 - DNA, 118 bp, Homo sapiens
tttctccttctgaccttatttcttctgaaaaagagcaaaaagaacttctagaactggaaaataaaactgtccaaattaagaactcaggtttaatagcagctcagacagaagtgaagac

SEQ ID NO: 145720 - DNA, 454 bp, Homo sapiens
ttgatttagtctagaatctgaccccatcttgacataaacaccactggctcagataaatattaagtgcaacagtttacctaatttagttatttatttgtattcttttatttttattttatttattgagaggggttttgtcatgttgcccatgctggtcttgaactcctggactcaagcgatcctctcactttggcctcccaaagtggtaggattacagacatgagccaccacacacggcccagtttaaatgaattttaaaggtggtctagatcaattttattattttgcatgttaagatgcaaggactgttcaacacacaaatcaataaatgtgctacctcacatcaatagaatcaaggtcaaaaactatatgatcttttcaatagatgctaaaaagcatttaataaattcagcatcccttcatgataaaaaccttcaacaaattgggtatataa

SEQ ID NO: 145721 - DNA, 436 bp, Homo sapiens
ctgtgcacccgcggctgggagaggggtgtgagttcttcctgtttcccctgtggggctggaggggcaagaggctgaaggcttagggtcccacttgaggaggcatttctcacagccaggaaaaatgcctgacagagacttctatgttagcccacgtaacagggtacagcagaggcccagagggatcagtgatgtccccaaggccacgtggctcagtggcagcgccggcaccccacagcccatactctggcacttccagttctcgactccatgtgccagtgcctcgattagtcctttcaacgcctctgggaggcaagtgagccagagaggctcggtgaccagcctgatgccatgtggcttcatcattcagcagcctggcatttcaagctccgcagagccaccaagggtgcccactagccctctgcacgtggcccggggc

SEQ ID NO: 145722 - DNA, 675 bp, Homo sapiens
attgcagtgagccaaaatcatgccactgcactccagcctgggtgacagaatgagactgtctcaaaaaaataaaataaatacaataaaataaataaatacataagtactgcatctttacatttgtttacatttctctcaactgtgaacacagtctgtgtgtgtgtgtaagttttgatacattttaactttttatagtagatttgtatgtattttatggtggtaaatgataaaacagatgagtatctacatatattttatgcatttgtcgcatatctaactttttcttaatttttaaaaatatttctgggctacgtggtttgcagttttttcaaattgtcacaaatctccaaaaaattttccaatatgtttattggaaaaaatctgcatgtaagtggactcatataattcaaacctgtgtttttcaagagtcaactgtaatgtctttcaaagtaaaatctaaatgagtttatacttgatatatataagtttaatagaaggagtgcgttggctcatgcctgtaatcccatttctctgcgaggctgagatgggcggatcacttgagctcaggagttcaagaccagcctgggcaacatagagagaacccctttttattaaaaattaaaaaaaaaatcaatcaggcgtggtggtgcacgtctgtggtcccagctacttggg

SEQ ID NO: 145723 - DNA, 213 bp, Homo sapiens
ccccattatccatgagggatacattctaagacctccagtgcctgaaattgtgggcagtactgaattctgtatgtactacacaataagagattaacagtaataactaataatagaacaattataataatatgctataaaatttatgtgaatgtggcctctcaaaatatctttaaaaaaaattttttttagagatagggcctcgttctattgccc

SEQ ID NO: 145724 - DNA, 373 bp, Homo sapiens
ctgctacactcctcaccctcatgctgtctctcctcagtctctcccttcctgcgagtgtctctgcttccctgtctctacctccagatggcttaaaatatttttggtctgtgcgtcccaactcatataaagctatacctgaggcagctggaggtaactagcacacagttttaagtttttaccagtgatccatgaatgaagtctgcataaatcttcaatatatttggatttttaaataaatgtagattattgcatatcaaagtagaaaatctacatcttcatttaaaactgcaatacaatacttataaaatctccagccactaaaaatacaattattatcttaatgtggtgggggaagggttgtccataaaacact

SEQ ID NO: 145725 - DNA, 155 bp, Homo sapiens
gaagcttagcaccagctgcctggggcctggcccttgcagacttgtgatgtgtgacctgtagacctcaatttaccaaaatccaggaatattattatggcacactgaacaacagactcctatccccacagaggcttcctggatgcacattgggcccc

SEQ ID NO: 145726 - DNA, 293 bp, Homo sapiens
aggtagccagggactagattacaatgacagtattgcatatagtggcaatttatttaaaagtaattatctaccttgcaaataccaccttccagtatgtaatacagtgctgagaaaagagcaggtgctcaatgtattattttcaaatacatgagtgaataaattagtgaattaataacttcccaaatttgagtccgattatatctgaccatttcccaaactccaattcatccttgaaggacaaaccaaacagcaatttgaaggactaataatatataggataaatttaaaggcct

SEQ ID NO: 145727 - DNA, 170 bp, Homo sapiens
cacagaatccatgatatggtctgaggagaaagctggtgtgaacgtacggagagtctctatatatacagcagatcctctaataatattgtctcattcactattgtttagtttttttttttttttttccctgagatggagtctctctcagtctcccaggctggagtgcagtg

SEQ ID NO: 145728 - DNA, 299 bp, Homo sapiens
tttctgcttcgggtcctttctgcacagtgggcagtttataacctcagccagctctgcagagggcagaatgccatggtccaaatgtttgtgtccctcacaaaattcctatgttgaaattctcgcctccaagctaatggttctaggaggtggagcctctgggaggtgatcagtcatgaaggtggagcctcgtggatggggtcagtgcccttagaaaagaggcccaagggagcccctttgtccctcccaccgtgtaacacacagcaaggtgcctgcgtctatgtgggaaggacccttggcag

SEQ ID NO: 145729 - DNA, 300 bp, Homo sapiens
ggagacagagcaagacctcgtctcaaaaaaagataatagtaacataattcacagcaatgtccgtggaatattcttgaaagaaaaatgatggagtacattattgtatgctctacatacaacatcttcacttgctaatatatattttttctttaccttccctcattcctgacattactgctgaggctgacatacaggatatgatgaaaagtaagcgcgatcgcatgcgcatacacacacatattgtgcactttaaacttaggctcatctgtcatttgtcattataccctctcgcaaattctc

SEQ ID NO: 145730 - DNA, 782 bp, Homo sapiens
gtcaagagcattgaactgctttgcacatgaagaatagaatgaagttgttcctctgcatgtgaggaaagatagataaaagactttggaaggcctaaaacagtttatgtcaaaatgctaatcaagtcacttaccacttaccatctctctggaatgctgtgtggttccattttatctgaatttaaaacaatatctatcttgtatggtaccgtctttcataatatgaagcttatgttttcaaatgtctaaaaatcttgtattttcatccaggaccttttttgtatgctatttctgttccctctgcccctccctcaaagtgtttgtgtctggcttctggcctgaggctgtgcttcccagcctgtcagaatggccaccctacaggctgcaacccttcatgagaaacaaaggaaatgcaaatataacagggcagtattcctgactttacaaatcatttcatcaacttgttttacttgattttcaggcaaactgcttttttcataagttggcaagagtttttggatttttctcccctctcctgttgatgatcgtacaccaaaaaactaagcaatgaaataaaatgattgtttgagcttagatgaaactttttccttaagggggtatttcctgaatcttataccctcttactcttatttttttaattaatcgttgttcactcatttcacaatcacttttgagtttctactttgtgcttagaacatagaagacctgaaagtattccatgaaaataatttatttctgtgtattgaattgatgggcaaatcttc

SEQ ID NO: 145731 - DNA, 493 bp, Homo sapiens
cttagccgcagggatgcctaggtgcttggagctgcggctgaggccccatattacttggccttggcaaaagtaaggcagatatcccataatgtagtctgcttggggcataggctggggcctggcccatgggtcttgcagagccgccgtcaatatggtgctgggatgttggaccagcgggggggcaggagcatgggctttgcctgccgctggggtgtactatgggagggacgatgcagacctgttgcggtggatcccttgatgttactagcccagcaaaagcgacctggtgaattaggagcttggagtttttccggggagggggacttaggctgggcctgaggggaagggttgggtgtattaggagggggactaggggtattaggtggaggatggtctaggggatcccatgtgctgttctctttgccaggatccccccttctctcactggttctacagtaggggcaggtgcataagggaaaagggaggacaggtc

SEQ ID NO: 145732 - DNA, 251 bp, Homo sapiens
aattgttttttatatggagacttaagtatcaaatatagtctaaggaacattacagggacccctctctgtggccattatttttagttagtaaaggggaaaaagaggccttctctgatagtcagtattaacttagtttagtagtgtctgttgtaagataatttaacttgatcaaattcaaatattaggcttagaatgagctcaggagttcaaggtcagccagagtaacatagcaagaccctgtctgtatcaag

SEQ ID NO: 145733 - DNA, 327 bp, Homo sapiens
cccagtgctttgtcatcacatcccccaagtcagttccgccacagagaagacacacacagcagaagcccattcccagagcagacgccagtgtggcgctcatgcactgactctgtcagggacggatgctggccatctgggcacccatcgtggtgaaagcacctcctgggggctgtcctttcggatgttttgaaaccatctttattgacacgtcagtcttcctaatgagaagccttcgctgcggtggccgcgtggcagggagggcctctggggaaggatccctcccaccacccctgcctctcctggcctttgtcagttcctctgccgaca

SEQ ID NO: 145734 - DNA, 316 bp, Homo sapiens
agggtcccgcaccggtggctgtgcacacgtgtgcaggaacgtgccaggggtgggtgactgcatgtgcgccttcgcttagatgtgttacgagccaagtagaaattcagcgtggcgaccgttttgtcccataatgcttttgttactttattttatattttattttaatttttttgagatggagtttcactcttgttgcccaggctagagtgcagcctggctgcctcccagaatcacttgaattcaggaggcggaggttgcagtgagccaagatcataccactgcactgcagcctgagtgacacagtaagactgtctcc

SEQ ID NO: 145735 - DNA, 135 bp, Homo sapiens
tgttaagtgacgataataagctgcacatatttagagggaatgacttaaatagttttcacataggtatgtacccattaagactgtggctactattaagacagtaaatatatccaccaccctcatcgcacttagaca

SEQ ID NO: 145736 - DNA, 1747 bp, Homo sapiens
tgtgcaaataaggtttctgtggtgagacaccagataaactcaacttcctctttcaacaacaaatgtgtcagttatcagcaggatccatgccgccagagtaaagctttctaccctttactccctgcaaagaaacaagagtgcttatcccagctaagctccagggttaaaactctatgctggtcattcccttcaggatttggcactcaccaacatacccttctttcaagtgaaaaggcatctcttttaatggtcctgacctttggaataggaagcatgtaccctggacagagcacttcaaactagaggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaaatctttcatataaagaccttaaattctgagtgagag

SEQ ID NO: 145737 - DNA, 1604 bp, Homo sapiens
tgtgcaaataaggtttctgtggtgagacaccagataaactcaacttcctctttcaacaacaaatgtgtcagttatcagcaggatccatgccgccagagtaaagctttctaccctttactccctgcaaagaaacaagagtgcttatcccagctaagctccagggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaaatctttcatataaagaccttaaattctgagtgagag

SEQ ID NO: 145738 - DNA, 1796 bp, Homo sapiens
tgtgcaaataaggtttctgtggtgagacaccagataaactcaacttcctctttcaacaacaaatgtgtcagttatcagcaggatccatgccgccagagtaaagctttctaccctttactccctgcaaagaaacaagagtgcttatcccagctaagctccagggtaatgttatcatgacagcttcaacttttagaccacaggcaaatgctttgttaaaactctatgctggtcattcccttcaggatttggcactcaccaacatacccttctttcaagtgaaaaggcatctcttttaatggtcctgacctttggaataggaagcatgtaccctggacagagcacttcaaactagaggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaaatctttcatataaagaccttaaattctgagtgagag

SEQ ID NO: 145739 - DNA, 740 bp, Homo sapiens
cgaggcacaaagtctcccttgaggtggcagtgaagttcatgtataatgaatgttgtgttccttggcactcttttggctgcaaatgaccaaagacctaagtaatgctgttaaccagctcagcctcatcgacttttgtagagcactacatccagggagaatacacattcttttcaagtacatgtggaatatacaccaagttataccatatgctggaccgtaaaacaaatttataatcattgatccaaagaggaattctgggaaatggagagtggcagcaggataattcttcactctctctgaattcccacatgaaatagaacaactagataacataacaaaaaattcatgaacagcttgtataacaaagctagttattcatttcctaagggaatagcaaatcaccaccaaccaggtcgcttaaaacaacagaaatgtatcctctcatagttctggagactggaagtccaaaactaaggtgttggcaagtccatctccctctgaaggctttagggagggatccttccttacctcttcctagcttccggtggttgtcggcaatcctagcattctttggctgtagcagcatcactccaatctctgcctctatctttatgtgtctgttgtcttcatgtgtctccaaatctctctctcctcataaggagacctgtcattggatttagagcccactctaattcagtatgaccccatcttgactatatccgtaaagatcctatttccaa

SEQ ID NO: 145740 - DNA, 1068 bp, Homo sapiens
tagattgtcggggttgggttgaggagttttcagattaaacaaggccctgaatatcatgctgggggcttgacttcaattctgaaggcaatggggagccactgaaggtttctgagtagtcaagtgacattttgggggtgtaattttagacaaggtttgaaaatagagtattgaaaattttatatagacaatgggctctcagacaaatcttcttttcctgaaaatgtccatgtcgtatctcttgattgatttgagtgtgtctcatttatgagtggagggtgctcccaaaatttgtcccaaattcaaagcagaacttcttaatgtgtggccccattgaggtgatgttccaaagggcagccagacgttggcctgcagccctaacactccctgtgccctactctgtctgcattgaaactccctttggagcacccccctcacaccatatcctcaccccacagcatccccagctggtttctgctctccctcaccagggacacctggtctcctctctaacaatcgagctggctacttttcccatggttgtgggacttgcgtcacatgtccctctctccaagcttacttcctgccccaccctcagctcctccagcagtcctcagaccacgctactcctgccaacctgctcaggtcggtggtgatgcctcatcctccacacttggcttctcatcttattcctggcttggctcctcctctggcttttgtccaggagagccctgggaatgtccttgggaatgcctgttcctgacctccatccgtgagtgcctacagcaccccatctagttgcatggtgaatgagtcccttctcgtctctgccttaaaaccccttccttagggaagtcttccttccctcattatctcatttaagcagatgcccactcgcttggttgctgtaattattctttgtttcttccacgctctgcctcaccattttctttatctgtttatgtcctcgtttaatgtctgcctttcagccttaactgtccatcccatgaggagagagacttatcttttttattcaccactttttcctagagttgaccacagaagcttctg

SEQ ID NO: 145741 - DNA, 327 bp, Homo sapiens
cagcggcagacgatgacactgggtacctggcaccatcactgtgttctctggcagcagctccagttcattccattctttaagtattgcctcttacgcaagtcctttacctgttggaagaagaatgtgagattacaggggctgcatcgactccagaaattcctagagaatatctgctcttggctgtgccccactttggagctgggctactccatattagcaggcttctgcaggagctacactctgtgtcctggctaccccaggaactggatcggtgctatgagctgctggacctgcagacggctctagccgaggagaagcataaggctc

SEQ ID NO: 145742 - DNA, 169 bp, Homo sapiens
tggatggatggatgaaatggggtaagaaagaaaatccttaggatcattcctcaaaaaaacaaacagcagcctaaagcagaaaatggatgaaattacacacctcctgtgctgtaagtaagttttctccttccttcatgctcttttaatgcttcctcaaattttacctttt

SEQ ID NO: 145743 - DNA, 385 bp, Homo sapiens
cagaaatattagcaattgtttcattacagatctgtcacatgtttcaatctccggctcaaaagagactattaaattattgagggaggaactaatcaatatttaaaaagctttctatatcatcagtgcttagtgtagtgctagatacataataggtgcacgagtgtttgttcatgaatgcattattgttctgaagttttagaacagttaattttctctaacaaattaatttaactcttatattctattcaggaaactaagctttagtactttagacaaattattcgtatggagaatttcagtgaagtttcaacataatggtggctaatatttccaggaaatattataggattttgtagacattattacaccggcagcatgactcact

SEQ ID NO: 145744 - DNA, 473 bp, Homo sapiens
cttaaccatgacgatatgtgaagtcctggacagaccttcttcttctccttcttccttcttcttccttcttcttccttcttccttcttcttcttcctcttcctcttcctctcctccttctccttcttcttattcctctgctattctccatttctttgtactgttagtttctgaaaggttccctcagaattttcttgcaccctactaatgaaggaaggtaggtgttctaccctggcttccagactctccccagcaggtcgggttcaagttgcccctggtggtaactggcttgaagatgcgcccattcctggtgacttcctttccccgtctcactttcccgcatccctgtgggagttctcttcaccttttgaataagctagttgtacttgaagcctcaccttgatgaggccccaaaccaagatactgtgtactaagtcactttcactgagccttttctttcccgttttcaaaattg

SEQ ID NO: 145745 - DNA, 512 bp, Homo sapiens
agtgtgagccaccacgcctggccattttacaatgaagttactcaagttttaaatctgtcatcaaaacatttaaaataaaagttcttgggacctacttccactctcccacccaaatcggctttgtcccctcccagctgaaaccctgggtgacacatcccgggccttctgtggctcctctccctgtgcactgttttctcaccgccgagctcacggagagactggttcaggggtgccacctccttggtctcacttaacattgtcccctgagccctccccagcagcagcatgggttgagcatcaatactggagtctgctgaactgagtatgaattctctgagcaagtctatgcctcctgtggctttcatcttttgtaaaattaagacagcaaggcctacctctgatgaccacggggaactcatctgaaaggcttagcagtgagtgatctttccttcctctgcccccctccaccagctcctggcctcactccccaccccaaatccaacccaacattt

SEQ ID NO: 145746 - DNA, 340 bp, Homo sapiens
catggttaccgatcacgagtcctggaaggggacaagcagggctgtttcaggacctgtgcactcattcaccatccacccatttgtccacccgtctatgaatccattgaatgtagtccgagacctggctctgtgccagttcacacctagaatgagatccagcccctgcctccgggagctcagggcctggttggggactcaggcaaggaagcctctgtcacacatgggtctgggcagggcttatggctgacccattcattcatttactcactcactcaatcaaagaaggtaattcttcagtcccgtttatatcctgggcaccgtgtggtgccggcggtatgat

SEQ ID NO: 145747 - DNA, 687 bp, Homo sapiens
ctcttttaaaattagggtctgtgaggacactcgggaccctcacagggcaaccagagcaaggaaggggcggccagtgtggagctgtgcaaggtgggggctgccctgggtggaagttgagagagtttaggtcaggcctggctgggttgaagcggggacccttgagggactttgctgtgtcagcttcagcttcccggtctttaacagagggaggcctcctccctggcaggataggtgaggacttggtcattcacaaccaagtcactgctcctacaggcagacaattccagggacacgtggggtcccctgtgttagtgtaggtgaccttactgtgggcacctgtggagtcccacctactcattgtaacacaggccaggacataggagcctgtaccagccccgaaaccccaagagttcaggcgactttgctcacccccagggacgtggcctggaccgtgcctcactccctgcctggagtggcctcccacagccatcccaagagtcctgggttagtcctcgcctctggctggctggattgtcacttacaattgtacctgggtgtggccgggtgcagtcactcatgcctgcaatcccagtactttgggaggccaaggcaggcagatcacaaggtcaggagattgagaccatcctggccaacatggcgaaaccccgtctctactaaaaatacaaa

SEQ ID NO: 145748 - DNA, 626 bp, Homo sapiens
ttgcatcatcagcggcttttactgaacttacaaccaacttgccgctcaatatgcagctcagatgtgagaggcgcgtctctgtacaggagcccgtactgtcttcaatcctttgcatgcaggtgtttaccacaggcaaacagtttactccacattttctagtaatgtaatcttcctattagcaaaaagcagtaaccagtccctgtagactgaagggactcaagtcacaggatgcggatttcctcttcatggtttttattttgatatttgaactgctgatgcaacatataagcagggtgttcaggacctgctgtgcctaagggactgataaagggaaaagttctatttattctttgtgatttgatgcacagatgaaaaacttaacacacaataatagaagttggtcgttagtaaatcacaccctagtctttcagagcttccgtaagcagacgacattgtcagttttctagctcttgttttaacactgcaacaacaatgatgcatatgtccggaatcagctaaaaaggccgtcagattctttttctcttagattatctatttttcactgttcccaagtatatctgaataattaccttccggcattctctgctattgctcgttgggatgct

SEQ ID NO: 145749 - DNA, 497 bp, Homo sapiens
atctgcagaatggcactgacaaggcctgcctcgtacggttacgtgagggaggggtgagttagtgcccagcacgggcaccctccagtgcttgcctgtcaccacccacaagcactggagcactgccatggtgcagagctggggtctaggtctcaggtggatctgggcgaaagcctcacctacaccccggattgacaagccacgctgtgccgactcacggccacttctgagcctcagtctcctcatgtgtaccacggcaccagcttcaggtttgaataagagaggacacaccctgcgacacactccatgtttcctggagtcaaagccaaattccataccatggcctgacctgactggccctgtctgagcttctgccactggctgtgcccccataggcctccttgccatctctggctcacgctcctgcctggggcattggcactgactagtccctctgcccggaattcttctcccagacatctgcttggctcgctccctca

SEQ ID NO: 145750 - DNA, 213 bp, Homo sapiens
aggctggccacaaagtacagttcaacattattttacccatgacagttctccatattacccgaggtaatagccaagaaagaaaaagatgaatgatctaaaaggaaagatgtaggacttctctagatttctttctagaaacatgcttcatgtctgtttcaaacagaactcaactccaacaatataaaggatatagtgaaaggtttttcacaaatc

SEQ ID NO: 145751 - DNA, 321 bp, Homo sapiens
gccatctcttgataatggaaacagctgtttaactgaactgatctagtcttaggactaggaaaactgactaaaaagataaggatgagtatatttaaatttcctctttcctgtctaccccaatctgtctgtctaacaacctctgacccaaatctctctctgctagtaaccccatgtctgattggttcttggagctatttacctgggtccctcagagcttaggatcaattctacaaaagcttctgaagccaggactttcactctttatcctaggactcatttgttaaaactatagatgagaatactaatgcctttgtcatgcag

SEQ ID NO: 145752 - DNA, 473 bp, Homo sapiens
  misc_feature (235)..(235): n is a, c, g, or t
tcaatttaggtcagttgctgcggagtttgaaacgagttaaaatttcagcagttcacaaaatggatgattcatagtttagtcgagccatcatctgttgatggacagtcatgtggtttcttgttttttctttctctgtgtttcactaatgaaacaggattacagtaaattgactcgtgtatgtgtatacatccatctttgctggtactatagaaaagtgtattgctggctgggcatnggtggctcatgcctgtaatcccggcaatttgggaggctgaagtgggtggatcacctgaggtgaggagtttgagaccagcctgaccaacatggcaaaaccctgtctctactaaaaatacaaaaattagctgggcgtggtggcagtggaggctgaggcaggagaattgcttgaacccaggaggcggaggttgcagtgagcctacatcgtgccactgcactccagcctgaatgacagagca

SEQ ID NO: 145753 - DNA, 564 bp, Homo sapiens
gctccggccctgcacaccgtctccacacctgctgtgccctgtcgtcccccattgtcacctccaagccgcccttcataccagcgtggtcaggaaagctcttagcaggctcagattgtccgaccgctaatcacgcaggacgggtcacctggtgcctctcgcacctttgccttccaaaccctcgcgcccaggccttgtgaccgttccgcaaccgtccctgccctcccagtctctcctcctttgtcctccatccttagagaacgcgaggtctctcccccccatgctactgcaggctctcgcagagactggggtcacaagttgaatatacccccgtggacgtgttcgccctggcctaagaggtattggtggccagtggggacgggctccctctctgatacccctagaggcagctggagggttggagtggcctccctgtgcactcaggcactcccaacttgcagccctgggctcaggctcacacactttcccagctcctttgtgcattccgcacttctaggtccctggactcatcccaaagtccctgacattcacgttaaatgttcctgg

SEQ ID NO: 145754 - DNA, 445 bp, Homo sapiens
acatccagaagggccacctgatataaaacaaatagcaaaggggcagccatcagcaggcctgccactgcctctccagacgacctggaccggcaactatccaaagtcttccacttcccccagatattctgccaatactctgcccaaatgcagggccactcacacaaacaggaggaaagaacagggtgtcttatagtccaggagatctcttgacgaagctgccagagaaacgtgtccatcttgggcaggcagaaggcccaggcatggcaaacacaggctccagaatccagccagagtgcctgcctaccgctcaggaggcggaaaaaaaaaacaactaaagaacagggaattgatttgatgtgggcagtgagaattcaccaggttttcagaccagcaatcatataaactagtggggatcagatatgtcagaacagaggggagaactcct

SEQ ID NO: 145755 - DNA, 371 bp, Homo sapiens
attcacagttctgcatggctgaggaggcctcagaaaacttacaatcatggtggaaggcatctcttcacagggtggcaggagagagaatgagagctgagcaaaggggaaaaagccccttattaaaccatcatcccccatgattcaattacctcccactgcatccctcccacaacatgtggggattatgggaactacaattcaagatgagatttgggtggggacacagccaaatgatatcagttactttgttgattttctgtttagataatttgtctaatgctatgagtggggtgttgaagcccctcactattattgtattgcagtctacctctgtctttagacatagaaattttttttaatgaatctggttg

SEQ ID NO: 145756 - DNA, 724 bp, Homo sapiens
agtggggagaagaaaaaagttgggggtaaaaacagcaagcaagcaaggttccagtctctaagcccaccttcaattttagcagccatgctttttttcccccgtaagttttaggtttagggtctgaacaagattgttcttgaagaaaaagcacgacaacttgaaaaagactgataactaagagtaatgaactaaaaactaagtacaaaatttcttggttcttttctgtttccatgtgactctgtaagacagtcacatgtggaaatctcccaaccctcgaaaggttcacaagctaaaactcacctaccagctaaaactcaagtaatcaaattataaagaccaactgaattacaggctgtcaatacagccatgtccagtccccagtgctaacatgcagtaacaactagccaggtgaggtaaggttaaggcaaatgggagagcagctctgtctatgaggagcccagggatcctgaatgcctacacaagacttcctctttccattctctcaatagggatgttcaaaactctatcaagagtctcatcaaggacatgcttatttaaaaatataacaagactacttatgcatgcatttttcctaatgttttatcttttgctggaacacactactatcagttcattctaaactttattctgctttctttttactatagttattggtagatttactatctaccccccaagcttgcaggtactcagctcgagtcgt

SEQ ID NO: 145757 - DNA, 197 bp, Homo sapiens
catggatttgctggtgcagtacaactaggcttaatagggctcgaattcgagcattgtttaaggtagaaaaaggttataggttgagtgtagtggctacgcctgtaatcccagcactttgggagactgaggtgggaggatcacttgagcctaggagtttgagatcagcctggacaatgtagtgagaccctatctctaca

SEQ ID NO: 145758 - DNA, 468 bp, Homo sapiens
ggccttccaaagtgctgggattacaggtgtgagccaccatgcccagctccggtgggggatatttctatatccacatgtgtatagtttactttataaaaatggtatgttactctgtgcttggctctccagcttgctgttgcctttcaccagtgtatcccagacatcctttcttccttgtcagtaacgcaggtctactttattctttgagcagtggcataattttccctgatgtgtatatatcataagttagagaatgctaaaattcattttggggccttgtttaggttcttgagggattaaattcctaaatttaacaagtgtatcctggaaacaatttttgttcctgattcagcccttaaaagaggactatcatgttaccttgaatggagataaacaggctcacgtaagagaaaagggtaagagggatgaactcccacttatcttaaacttctactggcccgtttttgg

SEQ ID NO: 145759 - DNA, 328 bp, Homo sapiens
cccaacttgatgccagaaccatcagagatgcttgtgctgaataaaattccccaagacaattgccaagggattgcaacacaccaaacatgattcctgtaatacaaaactgcatgagttagaccatactaaatgaagatttttttccctgggggaaaaaataacttgctttgggtgcatttgtatttcattaaaactgatgaaaaccctctaaacgcgacatcacgtcgtaagactgcattccccatcatcctttgcctggttcagaatggcatttttgccaaaggtccttcccacttgcacatgcagctaacactgtctaggaggtctc

SEQ ID NO: 145760 - DNA, 159 bp, Homo sapiens
atgaatagccaacagagtacttttcaaataaactgaccttttcctcaccaatgtccttctttgtgttttggtgaaacaaggcttttgtggttctccttcagggccataatgagggaatgtgtgaataactttataatttccactttcgcagtacttagg

SEQ ID NO: 145761 - DNA, 220 bp, Homo sapiens
aaaatatgctttgaactattcagtctaaatgctgctttctaaaaagctactagtttaaagaatgggaaatggtgttaatggagttaatcttgtgtaatttcagtgtgggttgtcaagaatacctctaagtaaagaaaatgactctaatcttcttaagcaattcattttctcagcaactttgaggcaggagttaatttactctgcctgtgtacataggcca

SEQ ID NO: 145762 - DNA, 834 bp, Homo sapiens
catccttccatgcccttcttgacactgatagaaacataggtttacatttatgaggttttttccctaatttgatatatgtgaatgtctattattcttaatctgttgctagatattcagattttttctggttctcctccaccgcaaaccatgtagtaactctctttgtacatgtatctttaataccagaatgggcctttaatagatatttgctgaatagagcaaactgaggcacagaatggcatgaatgcccagtcacattgttagtttacccaacttttttttcttttttaaccactgtttttttgcagtagtctaaaggcttctctagcttttacttgaaaatcatatgaaaaattagaaagcgcccagactttgaaacctgatgtgggttttaattaggtttctggcacatactagctgcactttatgtagaggacataaaaaactttggtaaatacggttgatttttgtattgtgatgataatactggctaatagttggtggacccttaaagtgtgctgagcactgaattaaattatcttctacattatctcattaattcctccaaacagctctgtgagtgtgaggaatgtagagtttaaatggctgtattgctagtaaatgtaggagccagcattcaaactctggcagtttggagcccgagctcttaaccactacacgattactactgtacgctagagcagagtttctcaaccttggcactgttgatattttgggccaggtattactttgttgtcaggggttgtcctgtgcaacgtaggatatctatcagcatccctggcctctaccaaatagttgctagtagcctctccc

SEQ ID NO: 145763 - DNA, 779 bp, Homo sapiens
gcggccgcgaggggagggggagtcccgtctgactgagacggcaggcctgggcgggcgggcgggggtgccgcgaagggcggagcgccgggctggggatgagctaagcgggctcagagcgccgcggcattcagcccctcgtgttccgctaccgcgcgtgcgggattccggcgccgctctccgagctcgatccgctgctcgcacgggagccagctgggtgttatttctcaaactctgaggctgcggagttcacacattgaaatctgtcatctttttcagagagaaactttcggtaatgtatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaa

SEQ ID NO: 145764 - DNA, 336 bp, Homo sapiens
gatttccagtaactttttctaacagctgtgtaatataggttgcctgtcttgaaccctgtttcttagaaaattgtgaaaggtttcacagtacaatagtctagaggcataaagcctctagatgcattagtttatgcattctttctttcattcaaagaatatttgttggattcttctgtgtcatatacttagccaaatgctgagtacagtggtgacatagttcttggctttgtggtgcttaataatcctagagatggacaataaataattgtaacaattgcaataaatgctataatagttaaggtaaacaattgagataagtgctgtaagagtgcacca

SEQ ID NO: 145765 - DNA, 367 bp, Homo sapiens
accaaatagaacttttgatagtgaaaaaaatatatagtcattaaaattaaaaactcagtgaatcaaggcgggcagatcacctgaggtcggaagttcgagaccagcctgaccaacatggagaaactccgtctctactaaaaatacaaaattagctggacgtggtggcacatgcctgtaatcccagctactccggaggctgaggcaggagaattgcttgaacccaggaggcggaggttgcagtgagccaagatcatgccattgcactccagcctgggcaacgagcgaaactccatctcaaaaaataaataaataaataactcagtgaataaattgtctgtggactggacaaaactaaagagaaaacaaa

SEQ ID NO: 145766 - DNA, 187 bp, Homo sapiens
cgtaggaaacattcgtccaataacgtttccccgccaccttctaccttcctccagctgccgtaagaaacactcacccaatcacgtttccccatcgagctgcctgccgtaagaaacactcgggttctgtggtgccttcaggtgttcacttcttcatggagcttccgtgtgacgtaacacatgctaaata

SEQ ID NO: 145767 - DNA, 375 bp, Homo sapiens
gtggcttccacacggcacccctgcttcctatgctctttccacctgttaaatgcctttagtcttaacctttggtctgaaagaatccttcctgctagttcaaaggtatctgaggttaaagcaaaggaaagaaacacacatacacacagaccctttcatattcaaccctggtcagaccaaccctccagacaaaggttcccattgttgtctaaaaacatacttttacacagggagcctagggggcctttaaacagccacaagcgccaaagtctccagactcctctagttctcattcccattctgcccctaaccttggcacattctcttctccttctcagggcctcacgcatcctcatctataaatgagggtttcagact

SEQ ID NO: 145768 - DNA, 713 bp, Homo sapiens
tcactcctccccagccaaatttaaacaaagaaaaactttatgaaaaaaaacaataagaaacttgttttctccatgtgggtttcataattctattcctgatatcattttccttttattcttcaatgacttgaaactttgatgtttgactcaaccccctcttcatctgccagcatcttccaaactatcttttgcctcttgctaccttccctgttgccagaataatattccctaaactctgcttttatcaagctctactcaaaaatgcctaatgatttcctagtactttcaggaagaaatccagatttctttacctggcatatttcgtatacaatttaggttctttaattttagtctatgtactccaaaaagaaaaaaaattgttaacagagaaggatagattgttacttagggagtgtggcattttgttagtattttcccatcgtacaaaatagcaagcactatgtctgaatagctactaaagaacagaagtctagaaaataaaaatgaagagatctatagaaagttgataattgctttttttctcatttttgctgtcagtctactttttgtgatttacctttactggtgtaaattacttttataaatttataacttacttttataatttacttctgttaatctttctcactcttaatcactatcttttttatcaattttcttcttttttccttttctgcattccctcttactca

SEQ ID NO: 145769 - DNA, 568 bp, Homo sapiens
gagctatccttcatgccccagggacagagacaaagcctactagaagtgcctcctgacctcagggctcgcactttcgcacattaatctggaacaaacgatagggctcaagcggataggataggataggataggaaaggggaaggaagatgtttggggaaatgggcttagttatgagtttgttaggagccactgtgcttaagcacttgccgtgtgtcaggtgctgtgctacgggactgcgcacagggctaaatgcgtcctcgtcacagtccttactgcacggggttgttactgccttcagctcaaagatcaggaaactgtacaggagtcaaatgtcctgccctagttccacatgagaacaggatgagtgcctgggtctgaagccaaagcccacagacctcaagagctgagcacatcagcccagtcgtgcgtgggtgttcaagtctaaacagagggcataggtgacactgacaatgacaagccacgatgcacaatgctttttttttgttttgttttttgagacagagtctcactttgtcgcccaggctggagtgcagtggtgtgatctcgg

SEQ ID NO: 145770 - DNA, 254 bp, Homo sapiens
agcaataataataatgtctcattaggtgtaaaatatatgtgaaattaaaatgagtaataataatatacatgcaagagtagaatggaggtaaatagagattgagtattgtgagatcatagcattgtctgggaaacaataaaaagtaaaatttgtattagattataataatgtacagaagttgtaatctgtggaggaaaccactgaagaaattataaaagaatgtgtaagtagaaccaatggtagggggggaaacg

SEQ ID NO: 145771 - DNA, 346 bp, Homo sapiens
tctgtaaactccacatggctctatgacaacaacacagtgttcaatggtatcacggtggtgaaaagagcacagattcttaaatcagatataacagaattagaatctgcacttcccccttacaacctcatcatctagggcaagttgagttaattaacctctcaaatttctaattcatcatctggaaagtgtacagaataatctgcacattgcaggatgcggtgaatattgctaggcgctcaccaacatctgctctcccttgctcccagggcacaggcctgaactacgtttcccaggtcctcccccaacccctggaatcaggcacagctacgtgactaagttcgctcca

SEQ ID NO: 145772 - DNA, 142 bp, Homo sapiens
cagctcttatacctagaggggttcggacttggtggaagggtaagaaagagttggggttagtctaaaagaacacagcataaaatggaatattaactatccccgctctggggacttcctggtctctctgttcagcagccttgga

SEQ ID NO: 145773 - DNA, 199 bp, Homo sapiens
ggattgcttgatgccaggagctagagatcagcttgggcaacatagcaagaccttgtctctacgtgcacctgtagtcctggctacttgggaggttgagatgggaggattgcttgaacccatgggtttgaggctgctatgaggtatgatcacaccactgcattttagcctgagagacaggagacagtatctcttagcaaaa

SEQ ID NO: 145774 - DNA, 587 bp, Homo sapiens
ttggaattactgttctcattgcacagaagagaagcatgcacagacagtttagcaatttgtctgaggacacggtgagtgagtggggagctgggaccctggagctcatgctgactgtccataccacaaagtcattcaatgaggataaggaaaggctaactaaagacatgtttatatgaatactaagactgcattttttgagtgcttcagatacggaacagaaagtgctatctgtgaaaaatagtgacactaactcattacatctttaattattacctaattgccccgtaagtccatggcctagtgttacaatgcagttttccagatacatgtaacttttgcaatcaatgattataaccagaacattttttcactccactgtggaagttcaagctgaaagtgaactaaaatttagatggacagttaatgactttttcctgcagtcatttagtcaaatatttactgagcacccataatgtgttctagacatgggagatagagggtctgtacctgcagggagcttacgttctagtgaagcaagacaaacattaagaacttcaggaacagataggctccttgaaggacaaaaa

SEQ ID NO: 145775 - DNA, 213 bp, Homo sapiens
ctccagtctcagcttcccaaagtgctgagattacaggaatgagccaccgtgcctagtccaattgcctatttgatatattaatgtggacctgtaatggttgaacttaacatgttcaaaatggagcttagattcatgcctttccagtctttcccatctcagtaaatgacaccaacatccatctagttgctcaggtcgaaatttagaagtctccat

SEQ ID NO: 145776 - DNA, 462 bp, Homo sapiens
gaaaccctgtataatcctcgaaccctctctctcccacacgtcacgtgtccaattcatcagcaaacatggccggaacctgacacctcctcaccacaagcccctattaccaccattcctccccgggtccctgcagcagcctcccgacaggcttcgctgcttggccttgcacccttcactccattctcggcaccacagccagggattctgcacagcctcctctgctcagggccctccactggcttcctcttttgctcaggataaatacccagctccgggaagtcatcagcagggccctctcccctctctgccctcacctcccactcctcttgctcactccacctgctccacatggtcccccttcactgttctcagtcgtgctgggagccccaggcaggcctctgcccctgcatctccctttaggtttttaaatcaaatgtcacgacctcagtggggactggccca

SEQ ID NO: 145777 - DNA, 456 bp, Homo sapiens
caaaataagtaaaattcaaatctaaataatagtattacagcaacaaaatagaatttaaatgtttcatgtccttaaaagaaatataaggtagtatgtaataatctgtctgtaacaacaaactgtaaacaacataacgatccatgattaagcctgcttcaatatatcacaacagacctacatgtgcttacataactacctttcccaggtaagtttttaagtaaaataaaaaggtataggcaaatataatatgatgctatttaagtataaatacatagaatttttctaaattttaaaccataaactattattagtggctattatgagtggtttctatgagaaggctttttaaccatgttcaaattttatattctttaaaccttaaagacaaaaattaatgtaaaataaatgaacatgttatttactctcacagtaataaaggaaaaaaatggcaaaaat

SEQ ID NO: 145778 - DNA, 278 bp, Homo sapiens
ccaaggagagtccggtcttcctccacgcaggggagggggagcaggggaaggaaggagagacattaacaagatggaatctgtaggctttggtgcaggacgcttacggggaacacggctcagggagttggattccagattgcttttgaagccttccccaggtcacatcacaccgctgttcccagccgttccaggtcttcctgttgactgtaggatcaagtccattcccccaatctgacctcagtctacgtttttgggctctttgcccactagtctcctaa

SEQ ID NO: 145779 - DNA, 573 bp, Homo sapiens
ttcagctcggtaccgcacgagttcggagttgtattatctgacattccccaacatggccctgaggaaaacagagcctatcaaagtataaactgagttagctcagaacctgtttggatgaagccaacagaaacacaaacaagcatttcttctacagtaaactgctgttgctaataaaccatgctagcgagtattcaactgtctaaaataaatctaactcaaaagaactaatcttggctgggtatggtggctcacacctgtaatcccagaaatctgaaaggctgaggcgggtggatagcttaagctcaggagttcaagatcagcctgggcaacatggcgaaaccccgtctctacaaaaaatacaaaaattagccaggcatgttggtgcacatctatggtcccagctacctgggaggctgaaatgggaggattgctggagcccaggaagtcgaggctgcagtgaattgtgatcacaccactgcactccagtctgggtgacagaaggagaccttgtctcgaaaaaaagaattaatatttgcaaacagaatttaaacgaaaaaacaaacttaactgtgg

SEQ ID NO: 145780 - DNA, 513 bp, Homo sapiens
acaaaaaaacaacttgctaaacaacatatgtttattatttggtaaattataaacaataaattcaaaactttaaaaagaaaacattttattgatagctcactgaatacaaatttataaaatattatttatgcattaagtttcagttacacattttcacccatcattacagatgtcatatggagttgctagagtatgagaagagcttcttcatcccaacagctttcaaagtgaagaggcgactcatgcctgtaatcccagcactttgggaggctgaggcgggtggttcacttgaggtcaggagtttgagaccagcctggccaacatggtgaaacctcgtctctactaaaaatacaaaaattagctgggcgtggtggcgcacacctgtaatcccagctactcaggaggctgaggcaggagaatcacttgagcccgtgaggtggaggttgaagtgagccaagatcatgccactgcactccagcctgggtaacaaagcaagattctgtctcaaaaaaa

SEQ ID NO: 145781 - DNA, 396 bp, Homo sapiens
acaaaaagaagcagttaaaagatttggcaattaggtcactagcgacctcagaagagatttgttatagtgttgacagtgcagatcagacagtggatttctttctaaaagtatagggaaaagaagaaatcgttagaaaaagatgcagagattctggaggataaagcatttttatctcgatggaggataaagcactgcagactaatgaaaaagccagaagagggaagtcggtgaagagaaacatagaaattcttctagtcattaccagataagcacacactaagtttaccataccaggtggtggcagcaaattcattatgtttggtccatataaacagacagtttaagaattgcagctgctattaactgagcacctactattggccagctgcataccct

SEQ ID NO: 145782 - DNA, 281 bp, Homo sapiens
tgctgctgcaacctgatatagtggggccatttcgggtgaggtcccttttgggctggatgtcctgcccagtgccacaattcttaggccttttctcaaacaggaaattcaccactttcttggcctcctgcttcttcacaacagcaggggttggagccaccttcttcccctaggccttctttccttttggcatcttgggtcgggggaggagagcttctttgtcagtttcttaactggattactagtttcagcgtggagcccagggccaggaaagcatgtcgttt

SEQ ID NO: 145783 - DNA, 221 bp, Homo sapiens
ctgatgaacaggtttacacccaaataatttgcggtgtgtttttacggtggtggtggtgttaatctttcaatggacattctacagagtgcttctgtgtagctctgttttccagtgtggaatatccaacaatgaaacagcgaaatgaactctagcggaaatgattctagggctgcccaggacctgtgtggccttcatggaatgttagaatgttgttgttatct

SEQ ID NO: 145784 - DNA, 564 bp, Homo sapiens
ccctctgaaagttttttgatcagttgtttaatgggagatctgaaatgttaaactcagaccagaaagaagagaacctgttttctagaaattaggtttttaatccaagtaagatgcaagcttttgcttttttaataacttgtatagctaaaaacttgacggtgaaaagctctcagatcaaagctgatccttctgtcagtaatgattctaaaaataagcaagattttaatggggaatatattttatttcattcttatctcaaacctaggtactgtggtcgttttgagttcatttcgaggcattttcaatgtgcctcaggccacatccaacctcttcccagggccagatttaatgttcagcctcataaaggttatcatagttttaacatttaagtactattttgcagtgggtatataccaaaatttgctaatagtaagataaccttagttatatatcattcacgttaattctatcttggaggcaataaacatttcttgttcaagaaattcatgttctatcttggaggcaataaacaaacattttttgttcaaaattagggctacccta

SEQ ID NO: 145785 - DNA, 317 bp, Homo sapiens
caggctctcaccccgattgtccttcaggtcctctacccaccacactccctatttcttccaatgaaattgtccctgcttctttttctccatatcctcgctctccttgcttcccctatgacatttctcctctctccacctcccaaaagtcccctcggtcttttctctgtttcttcctgttgccttcattcccctccttttaataaagtgagtctggaaccttggtttcccttttctctctccatgtgactggtgctgcatgcagtttgccctctccccatcgcgctaagtggtttcactttctccctctgaccctcggg

SEQ ID NO: 145786 - DNA, 350 bp, Homo sapiens
tgatgaaatcggggttgggggagaactccactgagctatcatgagtgacagcacacaccacctgacaggcaccagagggtgacgtgttgcctctgtcacagggaacccgggcactcgcggccttctgccttccaacccaggccaagcatggctttgcagagcagtgtgcagcagatgtattttcttccttcccatctgccctgacaaaatcctccatcctacctacctcttgcctatattccagttcaccttcttctctgcagcatccttggagcctcggtactctgagatttcagatatagtgaaatctgcaacccaaggaacacggcaaagccaaaaactaaaaagcc

SEQ ID NO: 145787 - DNA, 378 bp, Homo sapiens
tcctgcctcggcctcccgagtagctgggactacaggcgcccgccaccaagcccggctaatttttttgtatttttagtagagacagggtttcatcgtgttagccagggtggtctcaatctcttgacctcgtgatctgcctgccttggcctcccaaagtgctgggattacagatttggacaagattcttaattggtctaactctgcctagatcctcatttgtcagtgctttacatgtgatttcagcagttctccagtatgctttatgtgacttcatgaagtttttttttttgagacggggtctcactctgtcgcccaggctggagtgcagtggcacgatcttggctcactgcaacctccgcctgccgggttcaaacaatt

SEQ ID NO: 145788 - DNA, 453 bp, Homo sapiens
actcagtgctcaagtgtcttattgggggctggtcatgtaggaacttctgcctgccatgtacccagattctggactcccagtagaaagcaggtgttcagcataagccactttatttgtacaggctcagtaccagagctgcttatatcaccagaagaaaagttttacatcagcctagagaactgtttactgttcgggttcctagacgccattcggtagggtcaaccttgcaagcaggcctttctaaggatatagaagtctcaggtcagctgtgttaactgttctgcacaatacttagtaaatagttgtgactgagtgaatctaaatgaatcagcccagtgtgactgcagggcctggagaattggacctcaagactctcaaaagctttagggtaaccccctccccccaaccgccttgtcatcagtctcaccctcagatagacaaaagtgagagtgg

SEQ ID NO: 145789 - DNA, 502 bp, Homo sapiens
tcgagtctttaccaccaacaatttgcaggacacttcaacgaaaaaaaaataaataaaagattttagatttctaaatctagattaaagcttttagaaaagatgaattctggacatgactgaaatctagtaaatgaaaaggagtttaaattagaaacagtaaagagaaaggattcctccacctttcagaccctggactttaaaatgcatttgatccaattattttcagaatggaaaaaggccacctaattatagttcagatgaataaaaatctactggggagaagagccttgaagtatacatggaagataaatttagagctcacaaaacagaaccccttcatgtttctcatactgtaatatcaggtcagtttctactatttatactgcactgctgttagagctagaccttgcatatactacatactactcctctttaatcacttaaaattataaatggcataatggcatttagttctgccacctcctgcaaaaactgcttcact

SEQ ID NO: 145790 - DNA, 496 bp, Homo sapiens
aagcgattcttctgctttagcctcctgagtagctggggttacaggcacgtgccaccacgcccggctaattttttgtacttttagtagaaacggggtttcaccatgttagcaggctggtcttgaactcctgatgtcagatgatcctcccaccttggcctcccagagtgctgggattataggcatgagccacctggcctgtgtactcttttattttagtttacattatctgaacattagtggaaagtggtgggaatagttaagtgttttgcccttcacttgttgcctattaaggggagcacagttagtatatataaagtcttaggagaaaagagatagctgttgagttaagctttgaaggataaatatgggattgtaaaaggcctcttagacagggaaaagcataaataaaggtacaggaatcagaaacctggagacctttacaagtgtgactagaatgtattgtccttggaagggaatctgggaggcagagctagaa

SEQ ID NO: 145791 - DNA, 234 bp, Homo sapiens
catcttcttgggtaggcacctatctggtattctcagaatggaggaaagagagggagagaataagtatgtaaatacatgcattttctcctattgaaaaatgcttaatgtcaaatactgttgacatggcaggagagcttggctatcacaagctactcagagttctgttctgctatcagtcaaaaattatgctgtacccaaagagcttgagtttatcacccttaggggtggtcttca

SEQ ID NO: 145792 - DNA, 357 bp, Homo sapiens
ttagcatgaaagagctggatggtcaataaaactaaatgatactagaggtaaagaaaggaagattggactgctgggtgtgaaactaggaagcctgttaatctgatggagaggcctcaacagggtgccagaggaagaagtcacgccaaggttgattaagaaacaactcaactagctaacaactcactgcacgtacccctaccttgattaagaaacaactcaagctagcagctcacgccagcagctcacgccaaaaatctaaatatcatcgattcctctcttccacttactgccacctcaactcatccaatccatcagttggtcctgttgtttttgtctccaaaatataacatttctatc

SEQ ID NO: 145793 - DNA, 460 bp, Homo sapiens
tccacacagctctcagggctcttggagctggctgctctatccttcctggactccacaaccagaaacacttttgagcctgtttcatctttaaagtgctgccagggtaaacctcacaagagttcctctcagcacacccactctctgctaacacagattccttccagaggtatttttctcatctttgattccttttaaggcaattctttcctctcacaccctgtggcattacatggtttacttcgtggccatctgagtttccaaaccagtgtttttgtctgaaagactcccatgcacctacatgtgcagcttatgtggagctttaatgggacacaagtccccaactctgcctctgctccaccagccttggtcaggcccctgcctttgggcacaggtgccagcaatgcacttggcacttagagatgctgccatctggcagcctcccacatccaccacacaagcc

SEQ ID NO: 145794 - DNA, 318 bp, Homo sapiens
tgtaggggacaaagtctggggatgaaatgtcagtaacatcatcttccattagctgattaaagatgagagtaaaaaagctagctcctgggattgaaagccaattaattttattcttttctagagttaagactagcacctcagatgatttgtaatttgtaaatgaatttgcgtcctatttgtaagcaaatgcttctggtgataaggacctacaaatgacagaacacactagaccaggggtccccaacccccaggccacgaacagttaacagtcctgtggccggttaggaacccagccacatagcaggaggtgagtggcgg

SEQ ID NO: 145795 - DNA, 415 bp, Homo sapiens
tagctcccatcttactgccaatcacccaccttaagtccaaggaggctttacaactattagatctctaggcatctccttagctagtaacatatttatattgatccacctaagttggaaatatgagttgttaagacagccccatgtttcttctgggttttttcttttttctttttttcttttttttggagatgagtttcactcttgttgcccagtctgcattgcaacggcatgatctcggctcactgcaacccctgcctcccgggttcaagtgattctcagggctcagactctcaagtagctgagattacaggtgcatgccaccacgcctggctaatttttgtgtttttagtagagacagggtttagtcatattggtcagtctggtctcgaactcctgaccccaggtgacgtgcctg

SEQ ID NO: 145796 - DNA, 393 bp, Homo sapiens
cctcatttcttgttctgctttcagcaggggctcagtgtggggcaagcccctccatggccctgtaacacctaaagccctttgtctcctgaacttgcataaagatgatgggtaggcagtaaaaagctggccttggccagccctgtcttatccgctgaatcaaggtcaaactctgaaaggctacaaatgctcgggaaccccgtagcagagggtcagttttttagtttctgttgagtttttcaggatgggaaacttcttcctgctgagagctggatgggagtcctggcaggtttaaagaaggaaggtagaaacatatgttccaaacagtgggagctaaaagcacaaaagccaaagtgtgcagaataggtgtgggggcctggagcaatggaatgaggg

SEQ ID NO: 145797 - DNA, 196 bp, Homo sapiens
tggcatcacaggggcacatcctcggtgtgactcctgccccatctagacgggccgtgcccctctggggctcagaaggcacctcacagaggcttcctcaactagcttctggttccattattgacgcctgagtttcttccagacataaccacatactacaatgtttctttagcctaccataattatttcacgtaaccca

SEQ ID NO: 145798 - DNA, 391 bp, Homo sapiens
aaaacagccagaatgaatgtgtcaggaaacctacaaccagaatgttgtgaggaaaagtaacctacagtcctggtgtttgctaccttagcatttgctagaatgagcctgctgctacgaccaaattgcatacagtccaatctcaaatgaaccagataattcagaacagcttggaatttttctctctggtttaagagtatgctgttatgtttatattatggttatgcctaatattctggaatttggaaatcaaggggaaagttttattttgtttgaagacataatttggaagtggtttaggaaatcaactatcccctcttctctatgctgaaatctcccctactgctacccccagggttcaccaacttctcatacaaaacatcacccccaaaat

SEQ ID NO: 145799 - DNA, 416 bp, Homo sapiens
tgatgttctcctcctcaggttgagaagcacaatgttagataatggaaacagattcctttgggagaataaagaacaagttacctaacaacatatcaggaccttagcttcctcatctggaaagtgaaggggattggattaggttaggtacttccatgttttgtgattttgtgtggtctcttccagtcagaaagttctctgatggtttcctataaacactttagtgtttatctagtgtttatagcattagaaacagaatttagtactcggttttgttccctgaccttttaatgattttattcagtaaatgctggccttctcagagagccgaatctgggcctattgtaacttaacatgagatttaggttccctttgtatcttcagagatagtcttggccactcaaatctctggacatttt

SEQ ID NO: 145800 - DNA, 726 bp, Homo sapiens
tcccatgctcatgggtcagaagaattaacatcattaaaatgaccatgttgctcaaagtaatctacagattgaatgcaatccctattaaaataccagtcatttttcacagaaataaaacaatcctaaaatttccacagaaccaacaaggagcccaaatacccaaagtaatcctgagcaaaccgaacaaagctagaagcatcacactacctgtcttcgaaataaggctatagtaaccacatacaaggttatagtaaccacaaataaggctatagtaaccacaataatatggtattggtatagaaagacacatagaccaatggaacaaaaataggtaatgcagaaataaatccacatatttacagccaactgatttttttacaaaagcaccaagaacgtgcattgggaaaaggacactttcttcaataaacgatgctgggaaaattggatatccacatgcagaagaatgaaatctgacccttgtctcaccatatgcaaattcaacttgagatggattaaagacttaagacctgaaattataaaagtactagaagaaaatgtaggggaaacacttcaggacatcgatctacacacaaggataccactggcctcacgaccctcaaagcacagcgcctccacaaacccagattagcacatatgggccctactattacacccaaaacgccgtctgcacagctacggacacaaccgaatgaatagacaacctat

SEQ ID NO: 145801 - DNA, 221 bp, Homo sapiens
gaaaccttgagaaccagaagggagtagaatggaacattcagagtgctgaaagaaaaaaaatgcccaccaagaatgtgatatctggcagaacttcttctgaaatatggagatactttcccaaacaaaaactgaaaacttatcaccacaagaactgccttagcgtaaatgctaaagagagttattcaagttcaaacaaaaatacaaagcagcaacgtaattgc

SEQ ID NO: 145802 - DNA, 482 bp, Homo sapiens
aaaattaaaacaaacaaaaattaaggtagtaacacaggaaatgagaaaagacatatctacaagaaacacataaaatagtaacaatgaggtgatttctgcagatcagcagacttagtctttccccctgctggctgaggaatctgggcagtccagatgtatggaatttctcccagtgaagcacacccccttcaccaagaagcagccagagtgccttgttaaatggttcctgaatcctgtgcatcctgactgagtgaggaccaccccaccaacaggcattgtaagacaacttataaagaagtattcccactgtcatcagctcagtgcccatctgggataaagcttacagatgaaggagcaggcagttctctctgctgttctacacactccactggtgacacctccaggtgtgggagaaacccaggcaaataggatctgaagtggatcccaagcaaatcacagcggccctacagaagacgggcctg

SEQ ID NO: 145803 - DNA, 277 bp, Homo sapiens
tttacaaggtggagtggtgccctctgcacggaagggagaggtgggcaggtacggcagggccctgctccctcgggagtctcctctgaacctgtggttagggcacagctggacaatgctgaaatggtctccagctgggagatgaggtaaacctcagctgcatgccgaagaaataacctagaaatcagagaaccgttttattttgtttttctcagaggatctcatttctccctctcctcctgagcacagagaccctcaaaactggtattcacagaaggaa

SEQ ID NO: 145804 - DNA, 331 bp, Homo sapiens
tgttgggattacaggcatgagccaccatgcctggcccgggagtctgttttgtgtgtatgtgcttatatgtgctttctgaagagagggcccggagccttcattacattcttaaaggggtttgcaacctcccccaccaccaaaaaaaaacaacttgagaatccctggctgatagatggtgtgtcccgaattctcatatccctttcattctaatttgtggtaaatcttttctcctttggtgggaatcattcagattttgttggatttttattgcttgttaatattagatttgaggagactgaattctttgaaacatctctttcctaaatcctag

SEQ ID NO: 145805 - DNA, 439 bp, Homo sapiens
taaattaagagtacagaagtaatatcactgtaggtgagctaacaaaaatttacatcacgctttagaggactaccaaataacagtatcataagtcactcatctgaatcactaaataaatatttattacacacctagaataaaggcttatgctgggccctgtggacaatgtgagataatgagacccaaccctcccctccccggtttgttgtaggagtgcagagataatacatataaacaaataactgtccagtcaggtagaaagaggcaagtgccgtaagacaagcagagaagttctccttaattgaatagtgtctcctgagcacacctaaaatgttctgtgttggggtgagagggaagattaacgagccacattcccacaggtggctcataagccagtggggaattcacagaaggagaaattaaaattccaaggagggag

SEQ ID NO: 145806 - DNA, 358 bp, Homo sapiens
tgaacttatgagaaaatcaattgcatttgaataactaagggaagcaaccaatggctcttggtattaagactaattttagtttttatgctaaaaaattaaacaagcttttgaccatattcctttacaaatcatcttttattatataagttttaaataattcaaaagctactacttttcagaaagaaacagctatggttatatcttcatttaacagattaaggagaacctagtttgttaaaactaagaaatttgaaaactgattcaggaactgagtcatatttcctgctttgagacccaaccacagcgtgcacaaactggtgtaatagcattttctttcttccgtcgaaatggctctcct

SEQ ID NO: 145807 - DNA, 521 bp, Homo sapiens
acaccaccaggtccgtctaattttttaatttttgcagaaatgggggtctcactatgttgaccaggctgtctcaaactcctggcctcaaacaatccccccacctctgccttccaaagtgctgggattactggggtgagttacctctcttggctccaatttgctttttttttttttttgagatggagtctctctctatcgcccaggctggagtgcagtggcacgatctcggttcactgcaacctccgcttcctggttcaagcggttctcccacctcagcctcccagatagctgggactacaggcgcccgccaccatgtctggttaatttttgtgtttttacaaaaagacagggtttcaccatgttggccagggtggtctcgaactcctaacctcaggtgatcttcccgccttggcctcccaaattacaggcgtgagccactgcacctggctccactttgctttttttgttttttttttttttttgagacagagtctggctctgttgcccaggctggagtgcag

SEQ ID NO: 145808 - DNA, 318 bp, Homo sapiens
ttctcacctcagccttctgtgtattataaaagggtatagggcaggctgctgccacaagtactctgcagtccactggcttcagtgccagaggttagttctcatgccgcagctgcagtgggcactgccacctggaagaacagctctgtgccactcaggggttcaggctccttccagattgttgctctgccatccctcagttgccgtcctggcctcaccagaccaagtgacttgtctccaagttaaacacacctggaacttgcgtacctcaggtacactcacattccgttcacacctgggaggggggatcctcgagagtct

SEQ ID NO: 145809 - DNA, 553 bp, Homo sapiens
ggtagggttgggtgatcatgtgttcagaggtcagtggtttctcttcaagatcttaccatttccaggctgcttgggatgctcagacctcaactctctccaagactttattttctcccatgcttcttaaaggcacaccacataccatgatctcccttggaaccaccatgtataatctcttcaatggtttttcaagtcttcttggctggaacattggtctgccacaagctataacattttagcaggaaacagaaatatctgtattacctttgaaaatgattcctctggggcctactgacctagtcatgacttgcaattttgagctcataattcagtaacagttactaaatctatgttgtgtgttttttgtttttggttttttactgattctctcaaatgatttatattaaacatcttaaactagcattgattaaaatcattttgggctaagttcttccccaaagagtaattcattgaaaataaatggattcagaccctactttataatgtgaaagactttgtgcagatttgaatataagatgacctgttttctgag

SEQ ID NO: 145810 - DNA, 493 bp, Homo sapiens
ggtggacataggccacatacacttattccaaaatagacacatagttggaggtaagcactcgtcagcaatgtaaaagaatggaaatcacaacaaacaagcctgacccaggccatgaaattgtactctcattggtttatgaacaccagaaagagggcttggtacagcagcagccagagccaacagactcaatggggcagataaaaattcaaaattcagccaaaatgctgaaaagagaagaaacataggttcctcttcgtttaatgcacgagccactctggctactaggccacaactgagcagacaaaaagatttggggacttttccagtgaaccgagaaatgtgagcaggaggggcaggcatgaagagctccacccacacccctgaagggaggcgctgtcaggagtcggcagaaaggcagacactgacacaccgcatcgcccagggctggaagggtttctcccaaacgactgtaaaaaaagaaatgaaaagggaa

SEQ ID NO: 145811 - DNA, 144 bp, Homo sapiens
tcggcgggtgggggtatcaggcagcagaatatattgcagtaatgacactttaaagggagttcaaggttaaattgcagatttgctattcaaattaacataatctacattcatttactggaaggcaagtgtagcaatatgctagac

SEQ ID NO: 145812 - DNA, 453 bp, Homo sapiens
tgaaaagtgtcatccatgaactagagtgtgggagagggagaaggtaaggagtacagcctgactcacacctggaaaggctgttctgcgtttccagagtttgaaaggcagaggacatgtgagtttcccatctgccaggtgagggcctcacagaaaacagatgagttgaattgtcctgagaggggctctgtccatgcaactacctggagggtggctgatcccagcatgaggataagctgtcaggaacctggggccaatgagagtggccaggtagaggagttattatccctagaatcatccgtgagaggtgagagaccttaggattaggaggattctcaaaacacactaggctttggacctgccacacccagatgacactgataccagaatcactcatacaaaaatatatttacggagttccgtcactgttctagaccctgggaatagagtaatgaa

SEQ ID NO: 145813 - DNA, 371 bp, Homo sapiens
gatggagccccaacactgagttttgagcactccaacacatagaggcaagacagagaagaaataagcaaagaaaattgaaaaggaggggccgtgcgcggtggctcacgtctgtaatcctggcactttgggaggccgaggcggggggatcacttgagctcaggagttcgagaccagcctgagcaatatagtgaaaccccatctctactaaaaatacaagaattagaattagctgggcgtgatggcacgtgcctgtagtcccagttactcgggaggctgaggctggagaattgcttcagtcaggaagatggaggttgcagtgagccgagattgtgccactgcactccagcctgggcgactgaacaagacttcgt

SEQ ID NO: 145814 - DNA, 274 bp, Homo sapiens
ctgagatgagatgagctctctcccttatgtggagaagtccttttaggaatctgccatgtttaaatgtgtggcatgggggaaaggaatatggctaataatcactatgcaaaataagaaatgcatttaaaagttgatacagtatggaggaaaggtgtgaccctttctgcagatgtgaggactttggacttgggccggaactacacatcagctctcctgggcctctagcttgccaactacggacactgtgacttttcagccatcacaattgtgtaag

SEQ ID NO: 145815 - DNA, 273 bp, Homo sapiens
gcatcaacatcaacacacaccttaagtctgataagaaacatttacaatctgttctctgaaatttacctcttggaggcttcatctccacgatcaaatttggtatccacaacctcttattgcaacccagacattcgtttctattgattttaggtctttagataataaccagttgccaatcagaaaatctttaaatctacctatgacctggaagccacccctcacccgcttctcgttgtctgcctttccagatccaaccaatcttacatgtattga

SEQ ID NO: 145816 - DNA, 650 bp, Homo sapiens
gccaccacgcctgactaagttttgtagttttagtagagacgggttttcaccatgtttcccaggctggtctcgaactcctggcctcaagtgatctgcccgcctccgttggaattacaggcgtgagccactgtgcctggccgtttttagtttaggtaacctctgaatcctgtccaactctaaacttctgccattttaaggagggacagtggttcctacgcatccctgagtcctgtgtagctaggtattttatgtcgtgtgatgtcctataaagagcattatacatgaagactcacccaacaggagggacatctagaaacaagcaactcacattgtgctgtgagaataaatgacttacccaagtgaatgaacttagccctgaaaagacaaacgtgacttgcagcccacgtcatggagactttgtgtgggtttttagtcctgtgttgtttagatgatgttctttttaagtaacagcatgtgcctagtggctcccctgagatccttgagaaaattaaataatcatcttgtgacacggtcctcatgctcacgtttctagaatgcaggagaactcggatgctctgaaatgggcattaaaacaatttgttaagagagctttagaagcaccaatgaaggggaaatatcctacatttacc

SEQ ID NO: 145817 - DNA, 288 bp, Homo sapiens
agcactggcatcatccagaccctggaaggggagagggctcagggcccgcgatgcggcagctgctgaggacccttctcttgtgtctcctttgcaggcttcctccctctccctccagttttagaggctcccaccagggacccctttggcagcagggacttctccccatcccagtgatgtcatcaagtcctcttattttccaagaagcatgcaggccccagtaagttggaacccactgcaaaacagctgcgttactctcagaaagaaacagatggacttgagggaaacggg

SEQ ID NO: 145818 - DNA, 307 bp, Homo sapiens
tgaactccagcctgggcagaaagagcaaaactccatctcagaaaaaaacaaacaaacaaaaagtagtgttacgtacattcacattgccacgcaaaatcatcatcaccattcatcttagaactcttcatcttgcaaaactgaaactctataccccttaaacaactctgtacccattccctgctacacctaaccccaggcaaccaccattctataatactttctgtctctgtgtgtttgactgctctaggtgtaaggagtagctttaaaaccactggtttgtatcagaatcccttggggatcttttgta

SEQ ID NO: 145819 - DNA, 498 bp, Homo sapiens
  misc_feature (23)..(23): n is a, c, g, or t
taccatcgagctcggcacccgcncacggagatttcccacggagatttctttgcagttcgggtaagtgaggaggcaccgcaccaaccactgtgtgatttccgcccgacaagagcggcccaggagagcttcctacctccagccacactggttactcctctaaacctggaaggtacttttactgataaggaaggtggtgatcttttctctatcacatgtgggactggaatgttattataactgcactgaaaaaggcaaaggagctcagctctctgagagagagaattcaggcatgggaggtcagatggattgctgaaaatgctggttaagagcctcttacaaatctacctctttgcaagtctcttatctacctactaatcatcgaaaatccagaaagctcagggtttaggaccataatttgcaaaatctccgcaatcctgttggttgaaaagcacaggtgaaatatgaaatctcactcaagctcactgttaagtgaaccaa

SEQ ID NO: 145820 - DNA, 240 bp, Homo sapiens
tggtggtagtggcagcataatttgaggttttcccaagtccccacataaaaacagagcaactagttggtcaaaaccctaaggacaacacatacatcaaacccggagatgatgtatctcacaaactccaaattataagcaagtgaggacaagctaccaagaagagcaggaatcagtgtttgtgcaagagaaagcagagagaagcaagcaggcatctgatggatgcgggaacaggagaacctc

SEQ ID NO: 145821 - DNA, 198 bp, Homo sapiens
gtcaccttttgattaactatgacaattaaaaaccccaggctatccttaccgatcgttatcacacatattgctaaacctagagtatgtgtattggggggcaaactaattaaaatttatcttcaacaaaatccaattttagaggcaggtgtctgtgcacacacatgcacgtgggtgtgtgtttgtgtgtctgtgtgcatt

SEQ ID NO: 145822 - DNA, 799 bp, Homo sapiens
gtcacacctgtaatcccagcactttgggaagctgaggtgggtggatcacctaaggtcaggagttcgagaccagcctgaccaagatggtgaaactccgtctctactaaaaatataaaattagccaagcatggtggcccatgcctgtgatcccagctacttgggaggctgaggcaggagaatctcttgaacccgggaggcggaggttgcagtgagctgagatgacgccattgcactccagcctgggcaacaagtgcaaaactctgtctcaaataaataagaacctgcctaatatgttcttttagctttagttgctataaagacagatatattgcctaatttttgtaatttgctcatccaaattacccatgagtagctttgcttctgatttcctttaggcaacctctccgtatgctgttctctttgaatcttaatgccctgaactagtctacacagcatttaagaagccagctccacttctctgaaggctttgccccggaggaaacagcccatgggactgaggccctcaccagttagaccactggtctctgtccactgcactgtttgcttcaggtgccacagaaagtggacatgcccaatgcgtgttgatcatgtaaatcactgggttgttttttctaatacctgggtgattttgattttatgactatttcctaattcctggtgcttgcacttaatcaattgtgttaagggtggcatctgcctctcatatacagactgggagttatgtagatggacattggttgtcttatttcataaacagtgtccccaggtctggtttgac

SEQ ID NO: 145823 - DNA, 860 bp, Homo sapiens
gggagactccatctcaaaaaaaaaagaaaacaaaaggtatgttgactcttgtggtctgtctctgtctctatctctgaggcttgccaatgaccttgacttagttttagaagtggctgccctccttttacacaacagtaaattatttcattatatttttgaattgacaaattttacagtaatatataggaacaaaatatatgcgttcctttcagttacctgaagaatatatatcaaaattgaatagagacaattttattgttagcttctagtaaagggtaatgttttcagtgaaataaatatttatatgaaagtttcctgggaagaaaaaaattcctatgtattattacaggcaaacataataatagagttagaatgctcagtctccttgaagctttgctcctgtctgttcgtaaaatcagataggctgacaacaagctgcaacacatccaccaaagttataattaacattaacttgagaaagagtcctacctccgcttcatgttaaattccgtttgatcttaattgaaaggaggcacagagttacaggaaacagacccctgcattgaaaatgctatggtaatatgtttagaatttcccaaggaacagaagatctttagagcacagacatttggaagcagagaaattaagcccttaacacctcacagcagcaaaactcttctatcatgctttgaaggccttcgttttgggatttattttcgccttatctaggacaggtctagaaactgaatttcgcttttgaagcttgtaattctttatagcactttgtcaatttgttttcaattaccttccttctaatgcttacttacctcgcataggctacccatctctttggctttttc

SEQ ID NO: 145824 - DNA, 336 bp, Homo sapiens
aatccttaacctcctgcattttagaaatactccagagcttgtcttattcttaccaaaattcctgtaggcctttgactcctgactcaccctgtctgcagtgtcccccagcctgcaggggtgggtgagtcacagcaaccctcagccaccagctgttttccatctgccggccttcctgggggagagtcccttccagctgtagcccctgtctatgggaaaagtctcatgtccttttcatctctccccactgcacactgtctctcaccctagactataattcaagtgaatttgacctccatttattggacaagccaggcactgtgctaggaataatgaaaa

SEQ ID NO: 145825 - DNA, 406 bp, Homo sapiens
tgatgaaaacattagttaagttaatatataattgatatttagcactctcacttttaataacttgagtgaaggatagaaatgtgaagtgtcatttgtgacttttgaggtgggggattctgtatgaagtttgatagtagagatgggatttgacgggattgagacatccaatgagaagagtcaagaggatcactacaaatgtgtggcctcgaacctttcagtaccttcttcatatattttacacagtagaaagccaagtgctttctattcacagcttcattttacacaattatgtgtatgacaatgtacaaatacattttcatcaatatttggtttgtatttctttgttggcattgcaattaagttttgacttccttcccctctccactcctttgatttgatatatcaa

SEQ ID NO: 145826 - DNA, 312 bp, Homo sapiens
ttaagggaatctaggtttaattgtatatctcctagaacattttgcaccaccaagtaggttgtagagaatctttgttagcattctgctagccttattgatacgtgatcacctcactgaaattgtgcagtatcatgtattctttgattgtattttttagaaatgggagtcttgctatgttgcctaggctggtcttgaattcctggcgtcaagcgatcctccggtcttggtctcccaaagtgctgggattactggcgtgagctacctcatttggccaaattttaaataagaaatgctaacgtttactgttactgc

SEQ ID NO: 145827 - DNA, 283 bp, Homo sapiens
aggtctttcctttcggagaccaaatgtgatcaccttattggagaaagggaaagcaccctggatggtagagccagtaagaagacgccgggctcctgactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaat

SEQ ID NO: 145828 - DNA, 592 bp, Homo sapiens
caagattagatggacagattagctacagggaaaaagagaaggaagaggaatccttgcttcagcaccttgaaggaagaacaaagacacagatgtaaaccttcagtagactttgggggtgctttcagagagttagagagtagtgtaccctccagtttggggtaagcagggcgttcctattgactgacttgctttctctttgaagagggcacagggcaggagttatctgctgagggtaaagggaaggaaggagcattcattagggggataaggagaggattttgagcgtaaaagagagaaaagtgaaggtctacctagaatagtcagacaagagaaagaaagaaaggtcatccaaactggaaaataagtcaaattatccttgtttgcagatgatatgatcttttatttggaaaaacctaatggctccaccaaaaaactattagaactgataaacaaattcagtaaagttgcaagatacaaaatcaacatacagaaaatcagtagcatttctgtatgtcagcagcagacaatgtgaagaagaaatcaagaaagtaatcccatttacgatagtttaaaataaaatacctaggaatta

SEQ ID NO: 145829 - DNA, 120 bp, Homo sapiens
ctagaccagccttcgtccactgcgataagtgatcccccaaacagcaggtgaaggggaaggtgcctgtgaaatgcagagccaggcggaagcccgcagagaggccaggaggaggcacccaag

SEQ ID NO: 145830 - DNA, 417 bp, Homo sapiens
cagctctgcctcctgggttcatgccattctcctgcctcagcctcccgaatagctgggactacaggcgcccaccaccacgcctggctaattttttatatttttagtagagatggggttttgccatgttggctaggctggtctcaaactcctaacctcaggtgatccgcctgcatggcctcccaaagtgttgggattacaggtgcatgccacaacgcccagctaatttttgaatttttagtagagacagggttttgccatgttggccaggctagtcttgaactcctggcctcaagtgatccacccgcctcggcctcccaaagtgctgggattacagacgtgagccaccacgcctggccatagcatatgattttcattctcagggtcaactcatagtacataatagcttttggaaatgca

SEQ ID NO: 145831 - DNA, 411 bp, Homo sapiens
aggaggagggctttcatctgagactgaaggatgagagttactcactcagggagcagagcccatgagcattccaggcagtggccctgggatggtaaagagtttgggacataaagaaagtaaaagaaggccagtgtggctggagcatggatggaaagagatagagaatggcacagggtggaattggagagatgagcaggggtcaaatcatgcagagccttgtaggctgatgtaaggaatttagtttttttcctaactccaacaacaggccagtggaatgtcattccattcaaatgatggaatgacattatctgatttaggacttaaagatgactctagggaactcccaacaaaggatggaagattagattctttcttcaaccttgggacatcactaagaataatcaaacaaaa

SEQ ID NO: 145832 - DNA, 166 bp, Homo sapiens
cccgcagacaaatgcaaataagaacggaagtgaggagagcccagaaccctgttgaaagttaataaagacttttcccgctgcacctcacaccccagaatctcaagtagtttatcgtagcccactacaggtcttggattacctccatttcaaaacccgcagcccctcc

SEQ ID NO: 145833 - DNA, 358 bp, Homo sapiens
aactattggcatagatattagttgtcctgacagccagggcctcggagcagctgattctttccaacacgtattcagcacctcctccctggacagcgctgtggctgcagctatggataaaacagtgaagaaggctgcaagaggctggagatacttgtctctaatgctggatctggctgagggcaggactgccctcactcgttctgttgtgcgctcacctgctccccagccctcactcctggatccagcatccacggtttagggtaacagatccatctacttcatggcatcaaacacttctgacacagcccctttctagccaaagcattctgattgcctctctattttccgagggcctctg

SEQ ID NO: 145834 - DNA, 388 bp, Homo sapiens
cctgcttctaaggaagaaactcacttccaaatgaaggaaatgagacaaaaggttgatgcctaaagggatttactgtccttatccatgccttatggaccataactatgctaaacctaaaaaataaataaataaataaagtgagcaagctatttactgaaaagtgttatggcataagctggggaacaccactttctgagtctacaatgctttcttatgggatttgggatatgctctgaaccatagatggtacttgcctataccgagtaccagatagaatgcatgcatttgggaacaaacaagctttttaagaagtttttgctttcaacctttgtgactatgagtgttgttagatggaagatcttagaaataagaaagggacaattctacc

SEQ ID NO: 145835 - DNA, 677 bp, Homo sapiens
cagtactgggccccactcccagctaatttttgtatttaggtgaatggaaatcactatgttgaccagactggtctcgaactcttgacttcaagttatccacccgcctcggctcccaaattgtgggattactggcataagccaccatgcccggccattgtaatggctttatctggttttggttaggtaatgctgacctcatataatgaattaggaagaatttcctgtgcctctatattctgtaagagattgatgacatatctgcagtgtttggtcttgtgagcgctgtctcttctctcataggcaggcatgtttctctattctcacctgaagaaattatctatagttgtgttcctctttagaatttaagagaaaagtgcaggtacaattcacagaatttcacgtgggtattccgtgacaaatgagccagacgttggtagccttttggaataaaataggcaattttggaaaacctgactctgattaggtccttgtgcctttataaaaattactttttaggtaggaagctgagaagtttctggccagtatcttttgccatttggcccaattctgtctagaaataagaggtatctggagtggtaactaggaggaccatactatataactttaatatgtccctaataaagatacgagaatactttatatcaacctttcctaca

SEQ ID NO: 145836 - DNA, 441 bp, Homo sapiens
gactccaacattgcaggaataacaatgacttcagaattcacactgggccattacaaaatatcccaatatgacttctaaaccacagttcagtgatataatcttctgaacaaaattttcttataaagaaaacgctgttcctaagacaaagagagttaacaaacttataatggtaaatagttaaatttttagaataatagcaatagaagctgttcattttgtttttaccgtaaattgctaggctcttaatcacttatcatatagattagtaacatgtactaccatgtaatgctattttatcaacactctggttttaacataagcactttctcaagttcctaaaataagaaaatagcaccatccagtgctcatattgaggataacataatatttaatatctgaactaagacacagtgatttaatgtggtataccttatgtgacaa

SEQ ID NO: 145837 - DNA, 294 bp, Homo sapiens
cacaatttgcatttacttcaatttttgcctaaggaccagtaactcttgcaagaaaaaaaataagagaggtatgcatcacaaagactgatcttatttagtttctatcaagaaaatccatgaccagttccataacttgccacaaaactgaaaaactgtgtggttttgagtatgtacattttggggatttttctttctgagaagggggtcaagagcattggtcagatgctcagagaggacccttgagccaggactgcagtctcctgtgcaccgtggagcctgggagcattgggaaga

SEQ ID NO: 145838 - DNA, 491 bp, Homo sapiens
ggaggccgaggagggaggatggcttgagcccaggagttgtagaccagcctagttctagaccaacatagtgaaaccttctttctataaaaaatagaaaaaattaactgggtgtggtgggtgcctgtagtcccagctacttgggaggttgaggtgggagaatcacttaagtccagaagatacaggctgcagtgaactgtgatcgagacactgcactccaggctgggtgacagagcgagatcctgtctcaaaaataaaccaaaataaaataaatttgaaagcatctcaaaaaaaaaatgcatagggagaatgccctcaggttgggaggacagactgtaccaattcattcattcactcactcattaaaatatatatcggccattcctaggctacggtatgaaaacagagataaaggacagcttctgtctttaaggacctgctaatcttaaaaacagatgagtaaattaatgaagtatcgtatgttgcctgctatg

SEQ ID NO: 145839 - DNA, 395 bp, Homo sapiens
cacagctataaattcacttagtctgcctccccgccaccatgaaaccaggcccttgtctgcttggctcactattctgccattagtgcctagaatagtgcctgacatgcaatgggtcttcataagtgttgcatggatgaatgaattctaccctatatgtatttctatcgtggcatacctttatcttccttccctacaactgtattgcaatttgttatattaatgtttattcacctgttagagcagtggttctcaactcaaagtgcagaagaaaagaatcacctgcaggtgatttattaagagtaccgcttcctgggtcaagagatgctgcctgactcagtagtctgggtgggacccaggaatccaatttttacacacacccattaggtggttctgca

SEQ ID NO: 145840 - DNA, 107 bp, Homo sapiens
tacatgctagacattgtttcaggtcctgggacacacagtgaacagaaaaaacaaagacttctacctgcctcaaggagcaaactttctggaatggagaggttaagggg

SEQ ID NO: 145841 - DNA, 295 bp, Homo sapiens
ggacaataagtgtcatccaggactatctcaggcaaatgagggtgtttggctattctaattatagctagaacaaacaagtttatgagcttgggtccaagacttctgggatgttttggttgaacccaaacactcacctttaatttttgttacatgagtattgattttgccatagtaaattaattgactttatatctgaatgattgaacagtatggtctaatggttattaactttacagtatggtctaatggttattaagtagtagccgtagtacatatgttcattttatattttact

SEQ ID NO: 145842 - DNA, 251 bp, Homo sapiens
cttgtagcatatctttatgcagatgtggcctctaggtacaagaagtaagactgtacttctgaatgacttaaagaagaacaaatagaattaacttgtctgcatccaacgctctgcagaggatttttccccatatatttgtgaaagatgttaaacctggtatctctttggtgaaagtcattgggtatcggctcatcagaaataacctggctgtagacaagtttcttatatgacctgaaatgctttctgcttat

SEQ ID NO: 145843 - DNA, 181 bp, Homo sapiens
ttaggtatggcattcattagtcaagagcataaatctcaagtatatagctgatgaatttttacatatgtataaactgatataaaaccacccagatcataatatagatcatttgttgtaccctttgggctcctcttatgccccctcctacttatgtccccaaaagttaactactgtgaatttt

SEQ ID NO: 145844 - DNA, 448 bp, Homo sapiens
tgcggagctcccagacatccagacaggctgtcccaggggcctggagtggcaggcctggctcagggcagcttccgtagctgtaggctctcctctggttactgcccacagccttcactaattggtgttcaattcctattttgaaaaatgaagtttttcaaatagcaactagtaaataaaaagatacactaataaatcatagcaagagttctagaaacctttgtccaaaagagtaggattagtttaggggcagccctgagtggaaaccaaagaacatacaaaataatattcaaaccctatcatttcaattccccgcaatcattatcaacctttctctcctgagataaaacctgagtagggccaaagaggtagccacagaaaatggaggtaaaacacacacagctgaaaagactgagctcacaactcagacaatcatcacagcctccactga

SEQ ID NO: 145845 - DNA, 324 bp, Homo sapiens
tgttctcctccaatccacctcaagaacccaatttctgatggccttgcacagccttcaacacagctgctgttcagttttgtttccttcttttcattggcctccaaaactgacggcatctgagtctattcttgcctctctctgatctatcagactctagtccttagactgagcaggcgccacactcacagatgacttgcagaaatcatgctctaggccacaaaacttcatcagagcaaattcagaatgcagacatccagaggctgttctcctccaatccacctcaagaacccaatttctgatgaagttttgtggcatcgataaaca

SEQ ID NO: 145846 - DNA, 365 bp, Homo sapiens
ccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtcacgaaatctattgcagcagtcaaggatctccagcagcagaaaaacagcacagcaaactgttaatatcactggtctcatccaggcaacacagctgtcagaggaagcagagcacccatcaggaagctttggaagatcttcacctggtggttgatgtagatatagaagcatg

SEQ ID NO: 145847 - DNA, 474 bp, Homo sapiens
aaccctctggagcagcatcctgagctgtacctgggccacttggagccatggctagagctgcaacagatgagatgcatgtagtagtgtcccattcttccttcgttgtcctctgagcctgtgatgggaggagctgccacaaaggtctctgaaatgccctggagggtatccctcattttcttggctatcagcatgtgccttccttttagttaagcaagtttctgcagcttgcttgaatttctctcctgaaaatgggctttttgttctaccacatggccaggctgcaaatttttcaagtttctacactctgcttcccttctaaatataagtttcagtttgaggtcatttctttgctcacacacatcaaaatagtttgtcagaagtagtgagcttacctcctgaatgctttgctgcttagaaattttttccaccagatacccaccagaacttgagatactctcaagttcaaaattccac

SEQ ID NO: 145848 - DNA, 326 bp, Homo sapiens
atcctagacagtcccgacgtggactgagaactccaactggactgaatataggaggtgtttacatcggagagcctctacagcacgactgcgctggagattgtctagcggcgagacgccggcatacaagccagacactgaccgacgatactcactgtgcggactggcaaaccagattctaatctgtcatctggccaccagaatttcattaaagtatcagcaagtttctccttcctccaatctatggcaattccctgttattgcactactgtcaggggtgaaagcagtcagctggcaaatgccttaaatagtgttttctatcacttcat

SEQ ID NO: 145849 - DNA, 124 bp, Homo sapiens
ctatcgcaagctgaagcctagacactgggatttgtgcacgttcacagagcagcccagctcattgcccagactcactgtcagtgttgacagggtcattcaccccaagtgagcattcaccaacttt

SEQ ID NO: 145850 - DNA, 628 bp, Homo sapiens
tccttttcacagggcaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagctcctactctatgtcaggcactgcctgagaaagagaaacaaagctttctcacctgcagcttatattccaaaactaagttaataaatacataatacgtcatggggtgataagcacaatggagagaaagaagggataaggattacggatagaggtt

SEQ ID NO: 145851 - DNA, 581 bp, Homo sapiens
tccttttcacagggcaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagttagttttggaatataagctgaaggatgagaaagctatgtatctctttctcaggcagagcctgaacatagagtaggagcttaaataaatatggaatgaaggggcaga

SEQ ID NO: 145852 - DNA, 203 bp, Homo sapiens
aaatcatggaggattaggaagtgggacctatggtgtttccttggctcttcattcagattgaagacaggaaacaaccacatagacatattctgtatctggctgcctttcccatgatcttacgcttccgtggctcaatggctgcctttcccacgatcttatgcttttgatcatccatggagaaaaacgcaaacggacgcaggaat

SEQ ID NO: 145853 - DNA, 558 bp, Homo sapiens
cttacccctttatgggttgcatgtacagagaaaaggcagtattagcatgatccaagggtggagtttttgagcctctggcctcaaaaggtgaagcagaggacatgaaaagcctcactgcgcatcctctgtagactggccagaaccactccgtggttggtgtgtctcctattaggaaggaatgctggttggtggttgtgaggaaaccacaagagggaggggcaatgtcaggaggttggtttatattagcagtggagcaagtaaaaaggctggtttctgtttaacccttaggaaagaagcctaatgctgggcagcaagggatgggtataatgaggtgtgtctgacctttcacttggtcatggctgggaactcagatttcagggcttctctggggtctccttggccaagagatggtcacttcagtcagttggggggcttagaattttatttctcaggaggaacaacattcctttttatgaagaatagcatataataagctgacatgaaaatggagggtaaaggctacctgatgtgtttagaaatcttaaaataatccaggat

SEQ ID NO: 145854 - DNA, 335 bp, Homo sapiens
tcctatgggtgagagattcagcttttggtagggggagcgggatttatcccattacatttggactggcctccttttaggaattgctgctgaacatttgggaggctcttttggaataaattcaaggtgaggttcttgtactagacaagtgcacatgcctgggggaagcatttctagctttgttgatgaaacgtacttagctttgggctaatccataaggatactagaataatgcattctgtttctcaggttgatatatgagggcccgctagtttttttcctttgaggctactcttcactattctataagtgtgcttttttgtttgtttgtttgtttg

SEQ ID NO: 145855 - DNA, 990 bp, Homo sapiens
gtgaggcggcccgaaatcgtaggacttccgaaagcagcggcggtgtttgcttcactgcttggaagtgtgagtgcgcgaagatgcgaaaggtggttttgatcaccggggctagcaggtcaacttgacacagttttctgaaccagagagaaatgcctgtacctgatgccatcccagataacccacatcttgtgtctgaattgtcctcccagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggatgatcaagaaatggttgtatgtgatctgtgttgaagaccatgtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtcgagaccaatgtctttggccatttaatcctgattcggggaactggagcctctcctctgtcacagtgacatccatctcagtcatctggactcatcttcgcagtggcaggaatctatttcagcctcgaggattccagcaaagaaaggcacgaacctaagtctccaaatatgccaatggaccttgcaggcgcggtgacaacggaaattaaccaggagggcttaatcacaagggcgagtacagtacggatgtacattgcaattggaaaggcacgaatatagtaccgataaccggcaatgatactcgcatgcgaaccatctgtaccaatcgatcagacccgtcgtgtcacaacacaagctatc

SEQ ID NO: 145856 - DNA, 285 bp, Homo sapiens
ttctagggttcagttctttgaactgtgagatgcttgtgtaactttttggtggtgaacattgtgctttgatgcactttgtctatagcaatgtttgcctctcctccaaatccccactcacatggagaggagcttcacggcttctccaaatatttggtcacaactgagaaggctgattgataatcaggaaaatatctaaagcaatcaagtaaaagcaagttttataccagtctgctcaagtggtaagcggtggtctttctttttgtgacttaaacactgcttaggcca

SEQ ID NO: 145857 - DNA, 184 bp, Homo sapiens
cttgaggacttgatgaaaactgtggccctgttccctagaaaaatgaacaaaattctgcattgctttgagaggaataaggcctttcccactttgggttgtaggttggagaaccctttctctggaagtgcgtgggcagtaagtgttacagagtcccactcttggcagatgtctttcctaaggttgc

SEQ ID NO: 145858 - DNA, 248 bp, Homo sapiens
agtacaggcacctgaagaagtgaaaagccatagtatggccctgagagggactgtcacagaaagtaggagcctctgaattgtgagccaaaagacagaagattgagcttctctcccatcagtaccatcagcacttacattactcttgtggcagatagaactgagaatatgactgagacccctgctctgtcctctgccttcaagagagcctggctgtatcctaaacactgagaagtaggctgttaggtaga

SEQ ID NO: 145859 - DNA, 570 bp, Homo sapiens
gttccattactagaccacctcaattacacacgatagatacattttaaaatatccacatcataagttcgtggatagtacagttatattgcattgtatttgtctgttttgagtattaatttgttaaatgtaaatgtttaagttataccagaatttccccattttgagtttctctgttttttatgtagagtaagaacccatccaaataaaactaccctggcattcgttaacctccgagaaaccctgaactctccagtccactctgtgtgaagtttaaaaatgtatgattttggctcagcgcagtggctcacgcctgtaatcccagcactttgggaggctgagatgggtggatcacgaggtcaggagatcaagaccatcctggctaacacggtgaaaccccgtctctattaaaaatataaaaaaatgagccgggcgtagtggcaggtgcctgtagtcccagctactctggaggctgaggcaggagaatggcgtgaacctgggaggcagagcttgcagtgagctgagattgcaccactgcactccagcctgggcgacagagcgagactccatctc

SEQ ID NO: 145860 - DNA, 413 bp, Homo sapiens
gcagaagttcaaggcagagggagcaacctgagcaaaggtcctgaggcagaaacagaaagaacccagtgtggctggggtataaggaggagaaaggaaagagctggtgatatgtgatgatcatagcaggggagggtgtattgagaggaatattggtggaaagtgggtggtttagatggtttgattttggcgagggtgatggattcaccgctccgcacgttggtctcacagtgtacatttactggatgaatacctctttttaacatggggctaacttctcatttctctggctctaattaagatgttaatgtcatacttttttttttttttttctaggatagactccccttagcttcttccagaaaacatcctggcagtgaaagaaaggtctttaaggccctggacgtgtcaccttg

SEQ ID NO: 145861 - DNA, 450 bp, Homo sapiens
tgctcttctttttctagttactctttaaaattgttatgtaggttttattttataataatgaacttaactctgcaatccagctagacatggaagggaataaggaaaatatggaacccaaagagcttcagtgagtgcacaaagattataggatattgagagcaaatggaattgaggggtgctctcttgagctacagaggaaatagtctggtggttaagataaaacaggtcaaatttattagagttgtccatatttggcaatggtgatcttcttgctggtcttgccattcctggacccaaagtgctccatggcttctgtggcattcatggcctctttgaccttgccaaagaccacatacctgccattcaaccactcagtcttggcagtggagatgaaaaactgggaaccatttgtattcggtctaccatttgctgtgggcaagatgccaggac

SEQ ID NO: 145862 - DNA, 540 bp, Homo sapiens
aatgtgccctgagggtgaagagcctgtgacacagtaggtgtgtgctacctgtgccatctgagtcttgcctcaaaactggatcatgaagacacactgccttcttcactggcttcatctctcttgcccaaattctagatcgtgaggagaggccacacatagattcttctgcaaggtgccttccggagatatttgcaactgcatcttacattctattattgttttacatggcttaataatttacatttgcaatctgcatcttatattctgtgatcatattatatggctcaagaattttcagggctttcctatgaacattccccggatatttacatccgtctttagataaaggtctaaatacatgacacaggatcctgcaacagtggcaggatacctatctcttacatctaaaaagcctttcttctttttgactcaatcagaagcagatattatatagatcagggaaaattttcttacaggtaggaaactcttcataatactcattgtgggatttaatccacttgtttgatccaagcacaaaag

SEQ ID NO: 145863 - DNA, 181 bp, Homo sapiens
ctgtcatcacctcccaaagtgctggggttataggtgtgagccaccatgcctggcaggccaggactttctgtgaatgtttttggccttcgatgtctttgcgtgtttccttttgcctttgcagatacatcaaatcaattcatgggaatgttaccactatagagtatttgctcaagaatattgt

SEQ ID NO: 145864 - DNA, 191 bp, Homo sapiens
aataactattaggagtaaactgttttcctttactcacattctgcttttaataccgctgtggtttttttccttcacaacctggttttgaccactccttggtttctttagcatgatctttttcctgtacacctgactgagacttatccacagttgtcattctgtactgtctcacagactgaccttattcatcc

SEQ ID NO: 145865 - DNA, 421 bp, Homo sapiens
tttgtcatttctttgcccaaagagattttgaagtcaagctacaaagcagttcatgggctctcttggtgttttctggcccttctgaaactcaaggccctggggagggtgaggaagttggcagtcttcacgaactgtctttcttaactaatcaactcagcaaacaatatgggtggattcactggaccttcaagaaagttccctagtttagaggttagggaaatgtatcagagcaatcagaatcaaggaaacagtacaaatgtcagagaacaaaaccacagtaggaactcctcgagggcccctgtactttgcagtggagcctgaaacccaggaggcatcagtgatgtttgatattcaaggaatgaaaaagggatcactaagaaggtgaaccccactgtctccctctcaaacaagccaaagccgc

SEQ ID NO: 145866 - DNA, 170 bp, Homo sapiens
gaagattctgtaaggagagagaaggggtggaggctggaagatgggcagagggccagggtttaagacctggcgtgggcctgaactcacctgaattattttacttgtagaaagaggctacaggttgggtgcagtggttcatgcctggaatctcaacactttgggaggccaag

SEQ ID NO: 145867 - DNA, 439 bp, Homo sapiens
aatatatttcacaatgtagaatcctctttaaaatcatgtaataaaatataattggttatcatgtattattctaatttagtgtttcaatgcaagtaattttatctatagtttgtgtatttactttcataaattaaacgggtctgtggttcttacctttgggttatctttgtcagatttctctatgacactagtgctagctgcacaaaatgatgacgcttactttcctattctctgcaagagtttagatattagaaaaatcattcattctttgaagagttgaaacattgcacctatgagactgtctggctgttttttttcctaagagttagttatatgatgggtttttatttttattttttttgtgtgctaaacaccttatatgctttatttcacctaattttgtcagtcttttttttttttatatactttaagttttagg

SEQ ID NO: 145868 - DNA, 356 bp, Homo sapiens
gccaaggaggaaggatcacgaggtcaagagattgagtccgtcctggccaacgtggtgaaaccccgtctctactaaaaatacaaaaattagttgggcatggtggcgtgtgccacaggggaattgagagggctgttggcggagatgttaaaaaagctgacatgctttcagttccaatctttgctaccatatccatatgggcacaactgaccttggctctagaggggaaaaaaactctggaatgagacacaagagatctggattcgggtgtgaacctgaacctgaacaggtgacttcacctcttgggcctcagttttttctttcctcttctaaataattctctgtgtgctgaatctatt

SEQ ID NO: 145869 - DNA, 356 bp, Homo sapiens
gtgctattctaagagcatctggatcctgtaccagccaaagcaaatcaaacaggagtgcttatggagcgcttgtttctaaaacaagtacgggctgtgttattgacacgtgccacaggggaattgagagggctgttggcggagatgttaaaaaagctgacatgctttcagttccaatctttgctaccatatccatatgggcacaactgaccttggctctagaggggaaaaaaactctggaatgagacacaagagatctggattcgggtgtgaacctgaacctgaacaggtgacttcacctcttgggcctcagttttttctttcctcttctaaataattctctgtgtgctgaatctatt

SEQ ID NO: 145870 - DNA, 221 bp, Homo sapiens
aggatggggaagaagaaaaacccaccacgctgcaggagagtgaactctcagagaggcagatagatgagcaatgagtctgctgacccactggtaaccaacagtaggaactttctgaggaagacacagttaatggcgccacccttgactcatatatcagagaagaggagatggagggagttgaagggaagaaacagtggaataggaaggcttggtagcacctt

SEQ ID NO: 145871 - DNA, 101 bp, Homo sapiens
ataaacacactagtaattcattttaccatgaggtcttcataaactccaagaggataaaattccccaggaggggctaggcacagtggctctcgcctgtaatc

SEQ ID NO: 145872 - DNA, 536 bp, Homo sapiens
catgtgtgagtgagtctgttacagctgcccaggagaggatgcaaaaggctgagggaatccaagcactgttagcacttggcattcctttctctgtgcatatgtaattagacatcccaccttcacaccaaaaattagagcattccaccatgctggttaaaaactccttgtgtggctcaaatgcatattattccattctgcggctgtactggatgtagctcatctcctaatcttgacattggcaggtatttccagcatattgcttaaaagcagtaggcagtgaggatgatggggaggcagcaaggggactgggctctggagacgctgtaagccttcacagcgcagcccccgcaacttattagctgtgtgactgttaagttacttaaccagtctgtgcctgggtttcatcatccgtaaaaaagggaaatgacagcagctggctgccagggaggctgtggggtgaaatctatgtgtgtggggttgttacaaaggcgtaagggccacagccagccctgcgagagtgctcacaaacactcccc

SEQ ID NO: 145873 - DNA, 295 bp, Homo sapiens
actcaactttcttccagtgcaccaaaaccgctaccttactgtcttacctgtaacatgtgtgtcagaggggtcctctttatgtcccaagtattggcctgtcctgttattggaatgcaagggttatctgggcttacctacagagcccaccctgaatacatgtgttttcttttttttctttttttagacggagtcttgctctgttgcccaggatggagtgcagtggtgcgatcttggctcaccacaacctcagcctcccgggttcaagcgaatctcctgcctcagcctcccgagtagc

SEQ ID NO: 145874 - DNA, 1064 bp, Homo sapiens
gagaccctgtctcaaacaaaacaaaacaaaaacaaacaaacaaaaacaaaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggacaagagaaagagaatttggaagcagggattagtagaagagaaaacgagggaaaggaagcctttccaccagattagtgttcaagtctttgcagaggagaccaactttttttgttttcttttgttttgagacagtctctcgatcgcgccattgcaatccagcctggacaacagagtgagactccatctcaaaa

SEQ ID NO: 145875 - DNA, 1217 bp, Homo sapiens
gagaccctgtctcaaacaaaacaaaacaaaaacaaacaaacaaaaacaaaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggacaagagaaagagaatttggaagcagggattagtagaagagaaaacgagggaaaggaagcctttccaccagattagtgttcaagtctttgcagaggagaccaactttttttgttttcttttgttttgagacagtctctcgtccagcctgggtgacagagtgagactccatctcgaaaaaaaaaatacaaaaattagctgggtgtggtggtgcacacctgtaatcccagctactcgggaggctgacgcaggagaattgcttgaacctgggaggtggaggttgcagtgagccgagatcgcgccattgcaatccagcctggacaacagagtgagactccatctcaaaa

SEQ ID NO: 145876 - DNA, 1020 bp, Homo sapiens
gagaccctgtctcaaacaaaacaaaacaaaaacaaacaaacaaaaacaaaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggattctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaa

SEQ ID NO: 145877 - DNA, 2285 bp, Homo sapiens
gaaagagcctggctatctgaggactcaaagagtcagcatcgggacttgtgagctcaagaagagaaaagggagtggtgaaactttgtcctaaaagttagcaccaggaacagaagaaaaaaacccgatatatagtgatacctcatcttttagagaatgggaagctatttttgtgttcacacagaaagtatagttcaaaaaacctctatatccagagttcagacaaggagaatgatttgagatataagtgccgatgaaggaggtcaattttgatctgaaaccagcagctggacctgggccacctcaggaaaaggactctgttctccaaggcagcacgactgaatggttctgagaataagccagggttcaggactcctgaccctttaggaccatggactcagaagagcctgaaggacaattgtgggctttaaacttctgagagcttgtaaagtaacacaagactgtgcctctcccttgccccagctgtagatagtctttgccccaccattgttatgaagatacacagggttttgcagtttgaataaattggatacaagtttcctctttttttttttccttttggagacaaagtctcgctctgtttccccaggctgagtgcaggggcacaatcaaggcttacttgccgcctcaacctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaa

SEQ ID NO: 145878 - DNA, 1979 bp, Homo sapiens
cactgcgcccagccacaacctcagatttctttggcaaacagaaatgtttaaaaacacaaaattttgctcaggtgaaacactgtgttactatcaaatctcacatccacataaagtttttcttttcggctttgtttcgtgaggaacagacagaacaaagtttttccaggtagcatctgtatcactattattctcctatttcctgtaccacccccacctccccaagccctactgaatgtgaggtttagaatgttttaaggagggtcaggtgcggtggctcacgcctgtaatcccagcactttgggaggccaaggcgggcggatcacctgagtttgggagttcgagaccagcctgaccaacatggagaaaccctgtctctactaaaaatacaaaattagccaggcgtggtggcacatgcctgtaatcccactaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaa

SEQ ID NO: 145879 - DNA, 1510 bp, Homo sapiens
gagaccctgtctcaaacaaaacaaaacaaaaacaaacaaacaaaaacaaaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggaagcctttccaccagattagtgttcaagtctttgcagaggagaccaactttttttgttttcttttgttttgagacagtctctcgcttgaacccgggaggcggaggttgcggtgagccgagatggcaccactgcactccagcctcggcaacaagagcgaaactctgtctaaaacaaaaacaaacaaacaaacaaaaaaacccaggcaaagtttccttgcagccaaggtgacagaactgggctgagggtggaaaagaaacagaaccagtgctccaggtgttttttaattttttaatttatttttattttttttgtatatgtatatatatgtatgtatattttagaggaccagggtctcactatgttgcctaggccagactcaaactcctgtgctcaagcaatcctgcctcagcctcccaagtagctgggattacaggcatgcacaaacaatgcccagctctccaaatgttttctgtcactacctgaagtgttgcatcggtacttcctacggagagaaaactaaatagaagtgtctctcccgtgagcccccaccactaccaccagaaaaaaaaaagagagaaaatgaactcatcagtctttagtttcctcaagttattctcccaaaaagacattcgccttg

SEQ ID NO: 145880 - DNA, 1666 bp, Homo sapiens
gaaagagcctggctatctgaggactcaaagagtcagcatcgggacttgtgagctcaagaagagaaaagggagtggtgaaactttgtcctaaaagttagcaccaggaacagaagaaaaaaacccgatatatagtgatacctcatcttttagagaatgggaagctatttttgtgttcacacagaaagtatagttcaaaaaacctctatatccagagttcagacaaggagaatgatttgagatataagtgccgatgaaggaggtcaattttgatctgaaaccagcagctggacctgggccacctcaggaaaaggactctgttctccaaggcagcacgactgaatggttctgagaataagccagggttcaggactcctgaccctttaggaccatggactcagaagagcctgaaggacaattgtgggctttaaacttctgagagcttgtaaagtaacacaagactgtgcctctcccttgccccagctgtagatagtctttgccccaccattgttatgaagatacacagggttttgcagtttgaataaattggatacaagtttcctctttttttttttccttttggagacaaagtctcgctctgtttccccaggctgagtgcaggggcacaatcaaggcttacttgccgcctcaacctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccatttaggtatacctaaatggctgttacctaaatggctgtacctcaaagctggccgccaccgctgccacctgatcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccatgcctctcatcttgtcctacctgaagtatgtcattagttcccagatacgtcctagt

SEQ ID NO: 145881 - DNA, 633 bp, Homo sapiens
tcaaggtgcatgtgtgagacccggtctctgatccttagagatggtcgggggaatcgagtgacccagttgtctcgtatagcaggcttttctttaaatcaaaagaatactgggctccaggatcatgtatcagactcctctgatccttctcgtgtagttctagacctcacgcagcatagataaggcaatgcttcccatttcttttgatttctcaggagaatgggagattttggaatgggaaggcgacttaaaggaagtgtaaacagagcaacaattattaaatagaagagtagaatgacaggatggacggggaaacagtgtgggagagtagaaatgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaa

SEQ ID NO: 145882 - DNA, 384 bp, Homo sapiens
gttactatcaaatctcacatccacataaagtttttcttttcggctttgtttcgtgaggaacagacagaacaaagtttttccaggtagcatctgtatcactattattctcctatttcctgtaccacccccacctccccaagccctactgaatgtgaggtttagaatgttttaaggagggtcaggtgcggtggctcacgcctgtaatcccagcactttgggaggccaaggcgggcggatcacctgagtttgggagttcgagaccagcctgaccaacatggagaaaccctgtctctactaaaaatacaaaattagccaggcgtggtggcacatgcctgtaatcccagctacttaggaggctgaggcaggagaatcgcttgaacccag

SEQ ID NO: 145883 - DNA, 2814 bp, Homo sapiens
  misc_feature (252)..(252): n is a, c, g, or t
  misc_feature (941)..(941): n is a, c, g, or t
  misc_feature (1161)..(1161): n is a, c, g, or t
acaaggcaggatgtgtgcgtgggaggaagattgacagtgactgagcctggacgggggagaccaggtatgaggtctgaagcacctggaacagaaaggacaggacagatgtgggcacactgcacgtgtagaatcaaaggactgacagcaggtcgaatgtgaggaatgagggagggaaagaatcaggactcaagtgccatcctggctgcctcaaaaaatgatactgtcttccagagggaaaggaaagataacaanagttactgctttgtggcgtacatgtgatgaatttcattttggacattccagtaggatatccaagtggaaatgcccagtaagccttagacataaggatctggatctcaagagaaaaattgaggttgaaccataatatgtctttcccctcgaatcatgtaggtttctcttttgccttctttcattggcctaagtggtcctaaatgctactgctgatgctgtcttagtttgcgactgttgtttgcaccccaccttttcccaaaggtaatctgtagacttgcatggattgggttaaggtggttaacctgcagctttgctgttcaaagcttggcttcccactaccagtttgccaacttaatgagtacttcaacttgagtcaaattagtattgttccaaatatcctaatagtatcctctatgtgtgactctaggtcttacaaaatcaaggtgtcctttctcattgagacttccttattaataaaatatttcttctattaaattcaacctggcaccaagcatagtaggtaataggcacacacaatgactgtttattgaatgaatgaataaaatgattatgttagggcattctgagcaattcatcctaagcagctaattttctcctacttcttttattatagtgtgtgtttgtgtgtgtgtgtgtgtgtgtctgaaatgtcccatcctacaggttcnttaatatttaatagaaatgaaagaagaaaaatacctattaagtgttttgatttcatccttttcattgaattgaaaaagtatatcatttattcctgaagagaaatctagattttgctctatattaaacatttgacatttattggtccttaatgctaatatagataccagcctgctggttgtcacattctatctgtttatacgaaggttgtagacacacagngtatgtacatatgcctagttgctctcattccttttgtttcacatctcaagcctaacccagactgaaaaggttttgaaggctgagattattcatcaccccatcattatagaaagcagggctggcccaaggttctcacagtgggagcaaggtggattttaactctgatcagtgttgtagctcaaatataaaaagaactgcagcacaaaagtcacaaggataaatgatcccctcgttcttctcccataaaaataagcagccaattgaaggtggaagtcagtacagtgcggcattcccagaggcgacagaacctaagattccatttctaaagacactgctcaacaagaagaccacctgggatgtcttacataaaaccattggcctggcagcttttggctgagttctctattctggttcaagccagcatcacagcctatctgtggttttaacaactgatggaatttgtattttgagaaccctcatccgttagcatgaagcaaactcaaagcattgttgctcatcagttgtcatctgtttgagaaagattttgatttgtttacttgtagtgaagcttgaccatacttctccaggggctttttaaaaagatgaatgtgtcagcttgtagatttgtccccatgaatgaaaccacaagcaaattctcttctctcttccagcctcccttcctccctcttgtttcttcagtggccatctgtgcattatgttcccattgccaggccctcttcaagcagcttatctatgagtgaattcagaaacttcaaattataaaggacacccagataattggcctgttctccaaagtatctgtcccctgtgctgctgccagattccttcttaatgaatacatccagtgacagtgggattcttgagcttgtccgtatctgtgagaaaatgagctctcctgctttgtaacagcttgtggctcagggaaaaaaatgacagccattgcacaagtttcctttgaatgtagttttctttcccataaatgatactttgagaatacagttaaggggttattagttttctatttcatgcttggcctgtgtgtgagaataacacaagctgtcactgcaaatcagtagctaaaaatgctttgtctggttaatgtgaacatttaatatttggctcaattaaaaattaaccgatgaaagtacatgtcattggaatttgaaaataccttttgtacggaatacttaaagggcatcacccatgactaaaccagtgcttttaaaatatggagaatatggggaaatttaatatgagttgggatacttgactctttttttaaaacctctctacctgtttggcacaacagggtattgataaagagtgggctcattgttatggcaaaggattcacttgcatctctgtgtttttaagtgggtaattgtttttttgcactcagtcacatgattaaagcagacagaacaagagatcagttattcatttataccatacttttaaaaaaatattgagccaggccctggggaagtgggaagtgagagccagagcggcgtggctgatagtctagggcagtgctatccaatcttttggcttccctgggccacattggaagaagaagaattgtcttgggccacacgtaaaatacgctaacacgaatgatagctgatgagctaa

SEQ ID NO: 145884 - DNA, 935 bp, Homo sapiens
tttaagttagccagacgtatctccagttagtcctatcttgaaacagtcatctctaccaactaagtaaaagagaaccatgttctacttaagaagtaaacttttacaaccattaaaacttttaaacattaaacttatacaggtggtggctcacacctgtaatcccagctacccgggaggctaaggcaggagaatcacttgaagccaggaggcggaggtttcagtgagctgagatcgtgccactgcagtccagcctggcgacagagtgagactttgtctcaaaaaaaacctgagtagaaccattgaccattgttaagtcaggaccatctgtagttaggagaaaggatagaggtagcattgtattcagtagtctgcctccttgaagtaggttactgtaagcaaactttgcctttctgattggcaagttatggtagccacccttccataccagaaagaatatacaatttgaactagaggttgctttcttcttttaggtgtcatgtagggtaagactccagtcctgagactttttacctgatccccaactgacccagtgcgtagtataggtggcccttggaggaggggaggaagaagagtggtgtccttttcattagagtcctgatggaaccaaatccttcggaatactagcttttttctttttcttttttttgaggtggagttttgcgccattgcactccaacctgggtgacagagagagactccgtttaattaaaaaaaaaaaaaaaaaaaaaaaaaaaagttattttatgcaaaaattagccgggcatgctggtgcacatgtgtagacccagcaacttggggtgctgaggtgggaagattgcttgagtccagtagattgaggttgcagtgagccatgattgcaccactgcactccatactccagcctgggcgttggagtgagaccctgcctcaaaaaa

SEQ ID NO: 145885 - DNA, 198 bp, Homo sapiens
tttgtaccacaggatctctaaacacagccaactactacatctggagctcagctgaagaaacaaatgtgttttccaacttggggataaaactgagctgtactggccctgggagcaaatggcatattggttctccagtgtggtatcaataagggatttttcaagagtattttttactacacccaacgtttctttatgtag

SEQ ID NO: 145886 - DNA, 518 bp, Homo sapiens
ttaggaagtttgacttattggaggcagggcatgtgtgtcagggagacagagcatgtgagtgtgtgtattaggagaagagacgaattcagaggtatacagaaaagaagaatgatgaattcaggcaatcttcagagttgaattacagaatcttttttctgagagtatggttactgcggcaaggtagtaataggacatgagcctgctaagtcacttcattatgaagctattagaatttaggtgatggagtttgatgacaggggtcttttccctgcccttctactgtattagctgctcagggaaaaaaaaacagaaaactaagaaatagccttatatagaaaattatacccatcaaatggttccaaggtttctgttgctgggtttctgaaatgagctgcccaagatagcagtttggtcatgttgctgacttcttgctgacttcctttctcctcctcctcctccatcgggtcctcaggctgggtcctgacccctctggattctttcttttcctgcaaatgtgg

SEQ ID NO: 145887 - DNA, 333 bp, Homo sapiens
ggaaagtttgcctctactgatattagcatgatatttaccgggagaaaatttgttgcagacactgaaagggctcctctaaactctaacattggtgccgatggattgttaaaactatgtgcaaccaaggataacttctctttattttctttatataagttatctcatttttttctctcaacagtctcataatagagaaacggaggcttagcaagcttaaggtcacataattagtaagtgcagggctgagactcaagaccatctctgcttgtctcctaatcctgtgctgctttggctcttcaacagtttaaaagttgggattctttaaggataagg

SEQ ID NO: 145888 - DNA, 588 bp, Homo sapiens
cagtaaacagtggctgctactctttaaacaaaacgtataaaatggacaaagcctcgcagtgcagtcgccagctgcacccacggtatcggcagggctgtgcacggccggcgtggaggggcaggctcggcgaacaggatcccagtgtggcgcccggagcagctcttccagggccggaacaggacttgggagaaaacgcggtttttctgccattgttccctcgcaatgcttcaattcaaacaatactaaggttgtctcgttcgcctcctcgccccgcccctttacccagagactcccatttaaaaacacaaaaaaccctcagtccgtgacagagactccccaccagctcccgagttccaggaaaacttttttcgccctaagcctggcgtctcactgcctagtgactgacacactttcctggcctctacggctgcagctttgcccaaagcaacgaaaacggtgcctcaggctacattttaagttcccagttcccgtgaaaggccgacgcttgcaaaacacaggattgacgctgggaacccaaggggaaggaaaggtggaaagcatgatgagggaagagcaagctttctcaga

SEQ ID NO: 145889 - DNA, 231 bp, Homo sapiens
ggggggcctccactgctgccagcccttaggtcaacctgaacctccaccagcagaatctccctcagcccattccatttcttctctcaaaatcctatgctgctcacgttccacctcttccaggaagccttcctagagttgcaggagtcactttccccggcctcctgctgggtatggttctttcacgattgcattataggaattctctgggaggctatatcttgtctcctcact

SEQ ID NO: 145890 - DNA, 1073 bp, Homo sapiens
atagccaaggctagagactgaggcttccctgagaatatcacagcaaaccccttccagggcccccttctttgtatttcctccaaatgactgatctgcaaacaaagtagttgcctgccttccaatctgatagattgcaaaaagcatgtattgaaaggtgctgcctctgttcttctcccatctgaacaaaggtttctaaacctctttaatgtaaagtttgaaaagctggttaaaccaaaaccaaaaccaagcaccaccgtggcttccagagaactgtggcagggaggtctggatagcagccccaggaacagctcttgggatgtggttgccggcttgtctctgcgtatggagaattctggcatcagggtcatcagccaggtcatttagtgccaatcccatgctaggctggagaagatgccgagctagcaaatgccttctcagcacccttggctctgagtgccctgagagagtcctcttgccccactgagcttggaagccacatgcaattcccttcacttcagccattgcctcctcaccacctccagcaggtgctcccatgttctcaggatactgcacaccccaggcctctggtctgaacatacactccccaccaaactcactcctccatcttccaccccagtgaatgacacaggctggccatccagagccaggctccgccctccttctccccagatcctctccttccacccctgaacactacttcatcctctcctctccatcacctttgccacagctgtggtgcaggcagcataatcattcacctggactgtttcacaggctcctaactggtactccctgtagtccccatgtggccttgccgggtccactgtaagccgggtccactgtaagcatgcacttactgtaagcatgcactagtggccgcctcacccccgctcccagcctctcctaaagactccatcttcctccttggcccctttgtgacctgcctgtccaatcccagagcaggcctcctggtaaattctcccaactcccctaggaagagtgagttgcttctgtcctcgtgctaccccaggactatgcacacgccgcttgtc

SEQ ID NO: 145891 - DNA, 591 bp, Homo sapiens
aacatgtttaagaaagatagatgaagtcatttgcattaaagtacagcattgaaatactacattgtgtttatttttacatttttgcattaaaaaaaaacatgcagtaaaagccaagttaaatttcatattaaagcaagttctagtatatgtattgagttcctggtagtcacataccttgttcacatctacaccatacttcatagtatgatttgtaaggggagggactgtggggtgacagttttacatttactttttcttcttaatgcagctggatctaagtaaaatgttttgaagtttatcaaaaattcaatatacttttaaaacatatagggtcagggttgggggagaaaatacaggtatagtaagtaagaagtgacctatgaagaaagcgttgtgaggttatatgttggttgactgtgattaaaatgtggggctggtttaagttgtaaatggtggctgattgctgtgtaactatgtacatgattgttaggatggctgtcctatattttgtatattggaataaaaatttctataaattattgtaactaaaaaagtaaatattctaaattaaatcccacttcttaaatcaca

SEQ ID NO: 145892 - DNA, 286 bp, Homo sapiens
aatttttatgtctttagtagagatgaggtttcaccatgttggccaggctggtcttgaactcctgagctcaggtgatccacctgcctcggcctcccaaagtgctgggattacaggtgtgagccaccgtgcccagccccacacctgttcttcaaagactctgcttagaggtcacctcctctgtgaagccctccctgataagggacttttccaatgcgttagtttattgattcacctggctcctccagcacttaatatattcctagagcacagctgcccctccacatca

SEQ ID NO: 145893 - DNA, 525 bp, Homo sapiens
actcatgttctagggaagcagtgtgatatggaagactccaggcttgggagcctggcagatgtgtgttaagatggggatcaactatgcaagatagttagctttctgaatctcagtttcttctcctgtaaggtatgaaaaatagtacctcaaagaggtacagctatgtttgataacttgcctgaggctcctagtgtctcggcacatagcaggttctcactataggcattattaaggggaataggattggcatgtagacacaaaggtccctgaagatctaaaactgcataagactgggttcttgctcctttccttcatagcctctgatgagggagactgtcttttcacacgtattgagccaggagtgctgagatgatcgcagagacagttgagagaagacaaggagaaaggtgtgaagagcctgagtgatacacagagggacccttggaaatgtaagaactatagtgtgataaatcatgtctctggtcaacagtaagggcacaagtttattcgtgcatagtgcagtct

SEQ ID NO: 145894 - DNA, 804 bp, Homo sapiens
cggcctcctagagtgctaggattacaggattgagccaccatgcctggccggatatgtaaattttaatagattctgtgaaaatgaattgtaaaagtttgtaacaactcccatgtttactcagaaccatgtgtgaatgttccctattcctacaactttggcaatgtttagtgtatgctatgaattttttatacagttactagtttaatgggtgaaaaatagtatttgttttaattttcatgtcattaatagtgaagttaatattctcttattgccttttttttttttaagagatgggtctctggacaggcacggtggctcacgcctgtaatcccagcgctctgggagaccgaggtgggcggatcacctgaggccgggagtttgagaccagctgggccaacatggagaaaccccatctctactaaaaatacagaaaaattggctgggcttggtggcacgtgcctgtagtcccagttaccaggtggctgaggcaggagaatcacttgaacccgggaggcgggggttgcagtgagcccatattgtgccattgcactccagcctgggcaacaagagcgaaactctgtctcaaaaaataaataaataaataaataaataaatagatgggtctccacgctttgttgccttaggctggtttccaactcgtgagctcaagtgatcctcccacttcagccttccaaataggtgggactattttattgctctttgaccattttaattgtttttgtaaactgtctgttcatatcctttgcccattaaaaaaaggtagatcatttgtatatttcttat

SEQ ID NO: 145895 - DNA, 385 bp, Homo sapiens
gaaaaaaagaaagaaagaaagaaatgaggaaaaaggctaggggaaaaaagaggaagaattatccaagagctcgagaagagcagaaggagaagctggaggagatgctgaggctgctgctgctgttccccctcccccctgctgaaccccagaaggaggcaaggtggttgcaaagttaaggctgggacattgtctttgtcactcagagccaggccagtgagatgcaagaggaggaggtggcggcggcagaggaggaggaggtggtggtggaggagggggaggaagaggaggagaaggaggcaaaggagaaggaggcaaaggagaaggagaaggggaagagggagatgagatgatgaataaagacctgcggagaaggcggtgcgaggag

SEQ ID NO: 145896 - DNA, 451 bp, Homo sapiens
aatggtgcaagctcggctcactgcaacctctgcctcctgggttcaagtgattctcctgcctcagcctcccaagtagctgggattacaggtacctgccacaatgcccagctaattttttgtatttttagtagagacggggtttcaccatgttggccaggctggtctcgaactcctgacctcaggtgatatacccgccttggcctctccaagtgctgggattacaggcgtgagccactgcgcccgtcctaaaatcattttccacagtctttcaaattcccttatcttttgggaataggggattaaaaatagtataataggatatatttaataatttgattgctataaacaaagaaaactgaattggggatttaaaactaaatatgtgatgaatctattttaaactgcttttctttaaataaagtctgggccaactacaatagtgcacctattt

SEQ ID NO: 145897 - DNA, 374 bp, Homo sapiens
accagggaggcagaggctgcagtgagtcgaggttgcgccactgcactccagcctgggcaacagagcaagaatttgtctcaaaaaaataaaatatcaggccaggtgtggtggctcatgcctgtaatcccaggactttgggaggccaaggcgtgagccactgcgcccgtcctaaaatcattttccacagtctttcaaattcccttatcttttgggaataggggattaaaaatagtataataggatatatttaataatttgattgctataaacaaagaaaactgaattggggatttaaaactaaatatgtgatgaatctattttaaactgcttttctttaaataaagtctgggccaactacaatagtgcacctattt

SEQ ID NO: 145898 - DNA, 266 bp, Homo sapiens
tgataaattaattataacccagatataaccacagattaagtcctaacttttagaatgttttagagaaaaaaatgtatgggatcctcgaatacaatgaatagaaaccaactcacttccattcaaaagctgaaatccagacttggcatttttatgtggaaagaaatataaaatcctagataagtagacaattgataccaggcctttgctttctggaattttgaaaaatagaccttgttttacagctttatctgcagttctatgtgaaa

SEQ ID NO: 145899 - DNA, 761 bp, Homo sapiens
gagaactcacccagctctccccttgaaacttggacacactgaaatggatcaaagtgggccatttccacatttgctccagcaaactgtggtctcaggaactaccatgccatttcctctcctggagaagttctaggtattacctccacaacatttccaactgggggactgagcccacttatcagagaagagccgccatccacactggagcaggaacagggagaaatccagacaggaacctcatgtcacttcctagggaatatgggaagaaacatcagcagactttatgatgtcagttgggcctttggaggcattctggaaggtggcctcagcatcactgatgattgacagatgctacagcaaaaggtccctctagcgttgcttgactgctggggaagggacagtgaccggcactttgacccacacaaggataggagctgcctactttgtgtggtaggtgagagcagagcctgggagcccatcctccctctacttggagcaaagttgtgctggtgatgccccattattgggccagttgattagaaaataggcatttcactttcttggaaagccatcggactaagcccagatgtgcatttagagcactcagcattcttctctttgaagcatgggatgtctgtcctccaggaagagatttgatcttaggttgttacctccctttcacttcttttccacctcaattcaatacttaggggttggcttgcctctgcaggtttgatgtgaatgccactgggtactcagaa

SEQ ID NO: 145900 - DNA, 399 bp, Homo sapiens
cattgccaatcttgaaggaaaagaggaacagcacctgccggtgttgtgcaccccagagaggtggggctaaaggatgactcactcttggcccctggtactgaggactgcaggtgtctgcaatcctggaggaggccagtaggggcgtcccacctcacactcccattttatcctcatctgctcctacttaacaggtcctctgcctgctcctgctcaccctactgacctgtctccctcacacagggagtccccagaagcagagagaggagcgtcctctcagaggacttgccaggaagctttcttctgcctggagtccaccgttttccctcaatctggctgcccaccacctttctttctctgcttctctcactctcatattcccgcagatgggagatgacagtg

SEQ ID NO: 145901 - DNA, 559 bp, Homo sapiens
ccgatgcatacttgcagattacattttaagcccttataatgggtaggaaaacatctgtctctattatttccatggtatttggtatgaagacagaatcctccaccctgcccttaaaatttcacatagaataggtatgctttctgccttcgtgcccaggtcaaactcacttgacactgcgtagttttaaactgtgtaataaattgcccgaggtgcaccaactaatgtgtgaccccggatcacactgcttgccccacaaatccatactgtgtgaaattgaccttgctggttgtttttcaagtgggtctttatagcatcatagaatggaaggagtcttaaaaacaaaaagactgagacagagcttgctgaaagaaatgactcattactggctgaaccgggaatggaatatatttccaatcttgagaatattgtccagcaggctccctcatttccctccggctgcctttatctgaggtggccaacttgaaaccaaaactaaagcttctgactctcgtggttcctggatagtcttgtgtttctgtgtgtttgcatcatactgcga

SEQ ID NO: 145902 - DNA, 361 bp, Homo sapiens
atgagatttgggtggggacacagccaaaccttgttgctgggcatcctgtattttctctggcaatcctcacttggacttgaattttcagcgcccaaaaccagaatgtcctctcctacaagcaagaatctcagagctgccagcgcccccatgaattcccccaggtcttcccccaccccagaccgtgtggcgggtgagcctctgtctaactataaagagccaagcgagagagggatgcactgaggtggctctgcaatgcatgtttgttgagggccttctgtgtgtcaggcactgagccgggtgctgtgtaggtgggatatgaaaccatgaagcctctctgtgaccaatacacagaaatctcaac

SEQ ID NO: 145903 - DNA, 277 bp, Homo sapiens
ggtctcgatctcctgacctcgtgatccgcccgcctcggccctccaaagtgctgggattacaggcgtgagccaccgcgcgtggctgattcatcagtcttttatggttatagtctgaaagccttttccactcttaagtttcaccgatattttcaaattcttataaagttacagttttttgttgtttgattgttttagagttggatcttgatctgtcacccaggctggggtgcagtggcgtgatcacagctgactgcagccttcatatcctcgctaattt

SEQ ID NO: 145904 - DNA, 515 bp, Homo sapiens
aaataaaaacctggtcatttatgctatatttaaagcatttaaatcactttcagaattaccactgggaatgttgtattaaaaattaaggccaagcgtggtggatcacgcctgtaattccagcattttgggaggctgtggtgggcagatcacttgagctcatgagttcgagacctgcctgggcaatatggcaaaaccccatctcgacgaaaatacaaaaaggccaggtgcggtggctcacacctgtaatcccagcattttggaaggccaagacaggtaaatcaccagagctcatgagttcaagacccgcctgggcatcaatggtgaagcctggtctctacaaaatatgcaaaaattagccggatatggtggtgcgcacctatagtctcagctgttcaggaggctgaggtaggaggatggctttagcgtaggaagtaggggttgcagtgagccaagatcatgccactgcacttcagcctgtatgatagagccagaccttgtccaaaaaaaaaaaaaaa

SEQ ID NO: 145905 - DNA, 206 bp, Homo sapiens
ctgccatgctcttcgcttcattgcagcattcgttattggccacccagctattcaagccacgctttgttcatcctgatgggttttctcctaccttctctacctcattgcttcgttaactggaatttcattaagtcataattactactgctagattcttgtgacttcgtctatttaatctctgacggtaagggagatgacggagagac

SEQ ID NO: 145906 - DNA, 277 bp, Homo sapiens
cgttgtctccttagacaagaaactatgttgcctcttgtcttcacctgtaaaatggtaatatttacagctcacataagattttgtgaatcttaaaccagtgccactcatcaaacattattcaagtgggaattcctattattaacttttagtagcaaaaactagaagcaataaattatcaactcatcactatttttacattcaaatgactggtactgtaagctcctggaaggcagagaccataccacacatttacatagcagctagacaaagggaaaca

SEQ ID NO: 145907 - DNA, 499 bp, Homo sapiens
ttctacagatgaggatcctgaggctcagaggagtaaacgaatttgcccatgcacacagctagaaagagtcggagccaggaggcaagctgtctggccccagcgctaggttgtgtggcatgtgtgggggctgtacgtgtggagtgcgtgtctatgtggtacgtatgatgtgtgaggtgtgtagagggtatatgtggggtgtgtgtgtggtgtgtatatgtggagtgcatgtgtggtatgtatgtgtgtgtatgtatggagcatgtgcgtatggtatatattagggatccctaaccctcaggccaccagctggtacctgttgggaaccaggccacacaacaggaggtgagcagtgggcaagtgagcgaagcttcatctgtatttacagcctctccccatcactcgcattactgcctgagctccgcctcctgtcagatcagtgacggcattagattctcataggagcacgaaccctattgtgaactgtgcattcgaggaaacc

SEQ ID NO: 145908 - DNA, 514 bp, Homo sapiens
caacctctctgcccagattcaagcaattctctcgtctcagcctcctgagtagctgggattactggtacccgtcatcatgcctggctaatttttgtatttttgtagagatggggtttcaccatgttgttcaggctggtcttgaactcctgaccttgtgatctgcccacctcggcctcgcaaagtgctgggattacaggcgtgagtcaccgtacctggcctactctgtcagttttaccatcttctccttaggtttctggcgcaggggctttgggcttggcaggccaggagtgcccttgggcggggtcaccacaagggctgcagccctgattcagtattcttaaccagctggtgggatgcttcctcctctgtcccccatggttgctgtttcccaggaggccctgtggtccttcatgcaagttgcctttggccccgctctccaagtcagtccaggctaatacagcctcatgctgaaactcttgtgtttacctaaactctgagtgctgtttggatgcta

SEQ ID NO: 145909 - DNA, 228 bp, Homo sapiens
ccctccttctgccttatgcccctcagtcaaattctttcttctgaggaggaaagaattgaggttgctgcagatttaccaccagtaacttggataccgtccaccagtaacaacttccgttaagatggcaatacacctcaaatttatttttattttgagacagggtctcactctgttccccaggctggagtacagtggcacaatctcagctcactgaaacctccacctccc

SEQ ID NO: 145910 - DNA, 357 bp, Homo sapiens
cctctgcctcccaggttcaagcaattttcctacgttagcctcctgagcagctgggattacaggcaggcgccgacagtattaaatgtatcttttatcagtaatgagtggtaaaatgtctttcctaggaattttacatttatgagatagaaacagaaagcagacatcttgaagcttttttggttgtatgtattaggccattctcatattactataaagaaatacctgagactgtataatttataagtaaaagaggtttaattggctcatggttctgcaggctatacaggaagcatgatgctggcatctgctctgcttctggggagacctcagaaagcttatacaatcatggtagaaggt

SEQ ID NO: 145911 - DNA, 1311 bp, Homo sapiens
agagtaagaaattttagccgaaataatatgtagtgacataggcttcaaatacaggtataactataaagaacaaatttaaattagaactttatacaaactatttcagtaaaaatcatttcaggtgaaccatattatgttgctgccttaaatcaatctgttgactttatatatgtatacatttgttgtataaatttatccaggaatttatacacatttatgttaaacacgtgtttaatgtaacaaacacatttacgtgtttaacaacataaacacatttatgtgtttaacatagacacatttatgtgtttaacatagacacatttatgtgtttacaatacatatgcagactctatataaacacataaatgtgtgtaatattcatactgtcaccttttcttactcttgcaaaggtgatgtaattcaagtttgacttccttgaaacaattctcgggatatgtctagttatattagaagtttagttgtgtcaaatattgttctaaaagagactaaaagcataggtgagaaatattcctggatgtagtgggaagtttttttaatttttattttttaatgagaattactaaagcagcaaaacacagccacaatatagtagaaagcactgtagatttccaatttgcatatattactgcagagtggattttgctacagacccactgtgtgatcttaattaattcatttcccatctctgatccttagttttcacatctgtaaaacaagaataaatgtctcccctacctcaaggcaggttgaaatagtatatgctaaagcccattaaaactttagaacactatatagatttaaggtggttgctgttattttatacagctgcaaatcactgtaagggtcatatttattcaagctaataataagaactccagactttgtacataaaatgctgtgtgtttgagtttactggactgaaactcatttgtttaaaatttagtttgaaaaataataaagaccagaataacaaaaatcttgtgggccctacattctttttcttactttccaatatggctttatccatttgtttcctcccagccaactaattgccattttataaaagtaatcttccctcacatttatgtaatccaattatagaacccattagaaattataaagtggaggccaggcctgataacaataactgtaatcccaatactttaggaggccaaggtggaaagaccacttgaggccaggagttcaagaccaacaggatgtctacaaaaataaaaaataaatgtggtaaaacatacccagagtcagtttgtttttccttccagtacttta

SEQ ID NO: 145912 - DNA, 216 bp, Homo sapiens
aaaatacccatccaagatgggtacttcaagccatgtttgaattcttgaggtggcagttttttatgccagaaagagctgagctttggagctagatggaccagggttcaaatctcccctctgctactttaccttctctgtgactttgagcaagttaatttaactgtagaaactcaatttcctcatctgaaaatagagataattgtatctccttgggtg

SEQ ID NO: 145913 - DNA, 689 bp, Homo sapiens
tcatcttctctctggctttctcgtccccatctccctgagtccatctcattgtctcagaattgtttttctcatagattatctcataaataaatatagcaaattcaattcctatcagccatttaatgcaattaataatagctattatggatacaaataattaacacaaaattggcaacacaaaaatcacacgtagtaaaatttgtgactaaaaaattgacagaggaatcaaatctcaacaaatttccttctgcaaaattgataggaaaacatttatagtgggagaggctattcttaataacatttgatatatgaacatgtcgtatctttagaataaattgtcaatagaaaacaattctaataaatagttttgctaaaatgcataatatgtaaaattgggaagtttagctgtgatgtatcagttaatcaggtaattaaattgaccaaatggaatcactccaggtaagtcttttcttgatgaaattgatcaatattgcaataattctgattaagctgttaatatttaaagttatcttggggtgcgagtatcagggaccagatattcttgaggttcataacaacatttaaaatattctgtaaaccttatcaggctacaaaagtaagaatctagcttttaatttatgttggctactaattatatgtggggcgctttactcttcatgggcctacag

SEQ ID NO: 145914 - DNA, 722 bp, Homo sapiens
cacaaaaatagtatttgttattatgaagggccactaacattaatactctgagctccatggctctaagcccctaattgctcagtttcagtaaatttgatgttctatagacccatgcttctcaaactgaaatgtgtaaacatatcacctggggtatgtggttaaaatgcaggctcttatccaataggtcccgagtggggcctaagctgcatgtctaacaggctttcacgtggtgctgatactgcttgtcttcatatcatagtttgagtagcaagactgtggagtagcaagacttaaatactcttgaaattcccggggtacttccagcagtctaagaatttgtagacacggacaaggatggctagctgtgctagaactctgaggcttctggtcacagctgttttacaggggttctcctctacaccagaactctgcttgtggtaccacttctatctcctgtatatgagtggatttgctatgccaaatccacatagcagagtggaaatctgctatgccaggtattactggatctgcatgctattgcagtcccttgatgttaattataagaggatgatgagcaatggcagcctagaagagggtgaatcagagaggcaagtacgataggtatctggtgcttgatagggaggagagagagggagcctggaccatgaagagttttagaaagtttaaacttccctatatacctctgtaagccagatgttgag

SEQ ID NO: 145915 - DNA, 164 bp, Homo sapiens
gggttggggagaggagagggaagagcttgccaagctggaatcctgtctggccccgtcgtccctctttctaccagcttggtgtacatgtttatgttgtggattttctcctttataattgacccatgctgggtacccctttcagatccatcatgttcttagcccac

SEQ ID NO: 145916 - DNA, 278 bp, Homo sapiens
ccagcagtacagtgtgacaaatgctaggaagaggcatcagcaaagtaccatgggagaaaaggagatttggggtgtctggggatatgtttaatttgaggtgtgttgggacattcagttggaactgaactgatctcagacttcatttggcagttggatttataggctatagcttggagcagatagtatgaatggtgatatatgataagagtatctataggttgtagttgaagttaaggagtttggagagagtcatgagggtacaattaaaatgactgaag

SEQ ID NO: 145917 - DNA, 229 bp, Homo sapiens
caggatgctggagtttgagagactcagcaaggcccagaaccctcagcaggtgtgtggctaccattcctccatggcccatggctgcctccctaaggaggcacatgggaaccctaggtggtgtcaacttccctccacaaatctcaaaagcctttttggactcaccctggggcaaaaggcatgaaaaacagtatttgactgggcgtggtggctcacacctgtgatcccagca

SEQ ID NO: 145918 - DNA, 145 bp, Homo sapiens
gatccctgccctgtcagcagctcgcctcctctcactcccacagaatccccgtgtcagagctggagaggcccatgggaaacttttaggacaacctctaaccccctactcaagcaacaccacctccatcattttttttttttttgag

SEQ ID NO: 145919 - DNA, 267 bp, Homo sapiens
ccacctcagccccccaacatgctaggattgcaggtgtgagccactgcgcccagcctggtcttgtctttgggcacaaatatccgctagtgtctcattgcgtgtccacatttcctcatcagctctactggattagagcccagcgtaatggcctcattttaacttaatcacttctttaaagtcccagtctccaaatacagtcccattctgaggtagtgaaggttaaggctccaatgtgaattctgggggaacatggttcaacccaatgag

SEQ ID NO: 145920 - DNA, 384 bp, Homo sapiens
cctcacttcaacaccagtggttttcccgtcagatagtgccgaattttttatgaactatatggcagtagaaatgtccccatcacttcagacttaacaagtgctatactagatttgagggcttagggaaataccagaaaaaaatgcatattttataatttgtaaatgtctgtgcaatagatcatgttgccttcaacctatcaatgtataataagagcataaatgctaccatacttcattataccattcacttaaaaatatatactaaatgactttaataaactaatgccatatttatttgaggttctttgattattcgaattacaattttaacacattccctatttagttttaatttttactctttatgggttcattctggttgct

SEQ ID NO: 145921 - DNA, 276 bp, Homo sapiens
gctccgcctaatgactcgatctagctcactgacaggattttccacctcagttatggcctgccactccatcccaggtcacagccaaagtcactgtgggaaggttaaaggctggaatgcctgctgtcccagatcccaccacaccaaaatcagttcatagaactgtctgttttccctggatgaagaccaaggagaaggagaccagagaagaagaccagaaaaccagaacaaagaggaaggtgatgatcagcatttcccatattttctcaaataggctcc

SEQ ID NO: 145922 - DNA, 246 bp, Homo sapiens
agtattttagtattactgtaggactcaagagggaattaaaactacaaaaatgacgcgtcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaac

SEQ ID NO: 145923 - DNA, 302 bp, Homo sapiens
agtgcatacttctcctttttccgctgccaactccattggtttgtaacatcttgttggcttgcccatgagcaatgccaagttggttctgaaaaggccttgccataggagccatgacgaagtcacatgcaggacaaagtacagaggaagatggctggcactgcctttaaacagagatgccttccctgaactttcctttgaaatataaagatataaacagaacctgatgtggatactaaaagacacatcctcagtgatctggagataggctctgtcttcagggaagcaggtgaggcgaagagatt

SEQ ID NO: 145924 - DNA, 111 bp, Homo sapiens
aatcacaggcaaaaggatgagagaggggtaaaaggcctcaggatgggtacataaagtgcaaaagtctcttacacgtctgcctttgctagctggagtacaggatggagagcg

SEQ ID NO: 145925 - DNA, 405 bp, Homo sapiens
ccagcctgggcaacaagagccaaactccgtcgaaaacgaagcaaggaagggaaggaaggaaagagaaattatttcaacagcactggcctctccatgtcgtcactcagtctcctctataaattcaagtcccaagacaccctgccctacccttgcctctgggctgcttatcattcttgttctgtcttctttatccagttggaaaccatattacaaactaacttagatttccaagccagagagcaagtaaacacctcctaaatccttcatcaaggaaaacctcttggaaggttttgaagctcaacattcagaatcaaatgtagtcttacccagtaattccactcctagaacacaaaaacttgtgttatgaacacgaatgttcatagcagcattatttctaacagccaa

SEQ ID NO: 145926 - DNA, 313 bp, Homo sapiens
tgacatctatcagtatcttgaggacccagcattctttaggacacatgctggaacgcactgccttaatccactcgctgccctaatcaggagctgacctaggtaacgatctctgcctccctctagaaatccacagaagcaacatctctaacaaatctcccaccttctggagaccttaagccactaatacactctacatgtagccaaaggttatagctcaactctgccaaaacgtgggcctgctaggagtgtgagggccacagcacctttggcctgaggctgtcctcaaaaaactgaactcaggctgccccacaat

SEQ ID NO: 145927 - DNA, 416 bp, Homo sapiens
ccccactttagtggccacctcctgctgctgaaatgcctcatctcactgtcttctgttgcattcaggctcccagacagtacacaaggaacactcagccaaatgtatgcttttattcttagagaatgtcagcccaaatccctgcctcctttcctacctggtctgctggtatagacaatctagactgagacagggacatttttaacctctctactttgaacccaaatcagcctcctgcttcattctctcctgggacccacatggcccctcgtgccacaaactaggcctccctaaagaatctccatagaaatgctcaccttctacaggcctccaacactttctcttctctctcagaggccctcattgtgtcctgtgcagagagcatggccacctgtgccctgccccacaaagggaatcat

SEQ ID NO: 145928 - DNA, 1357 bp, Homo sapiens
gtcaaagactaaaggtcataactcaaggtcaagggtgtgtccccggttggtgcttaatgcattgagatgtgttcaggattccatgggggaggtcaggggtgaaaaggcccaaggtcacaaggttagaatttaaagtcacttgggggctgggcacggtggctcacgcctataatcccagcactttgggaggccaaggcaggaggatcacttggggtcaggagttcgagaccagcctgtgcaacatggtgaaaccccgtctctactcaaaacacaaaaaattagttgggtgtggtggtgcgagcctgtaatcttagctacccggggcgctgaggaggaagaatcgcctgaacccaggaggccgaggttacagtgagctaagatcacaccactgcactccagcctgggcaacagagcaagattccgtctcaaaaaaataaataaaaccaaataaataaaatcacctgggccgggcatggtggctctggtctataatcccagtactttgggaggccaaggtagctggaccccttgagcctaggagctcgagaccagcgtgggcaacatgggctacccagcaacattttgcgtctacaaaaatactgaatttacctggatgtggtggcaaatgcctgtaggctgaggtgggcggattgcttaagcccaggtggttggggctgtgccactacactccagcctgggcatcagggtgagaccctatctcaaaaaaaaaaaaaaagaggaaaagtcattaggtcaatgaaaattgattatctggtcaggcatggtggctcacacctgtaatcccagcactttgggaggctgagacgggcagatcacctgacgtcaggagttccagaccaccctggctaacaaggtgaaaccccttctctactaaaaacaaaaataagccaggcatgggtgacatgctcctgtaatcccagctattcaggaggctgaagcaggagaatcgcttggacccaggaggcagaagttgcaatgagctgagaccacgccactgcactccagcctaggcaacagagcaagactccgtctcaaaaaagaaaaaggccgggtgcggttgctcacgcctgtaatcccagcactttgggaggccaaggcaggtggatcacctgaggtcaggagttccaagaccagcctggccaacatggtgaaaccctgtctctactaaaaattacaaaaattagctgggcgtggtggcgggcgcctgtaatcccagctacttgggaggctgaggcaggagaatcgcttggacccgggaggcagaggttgcagtgagcccagattgcaccattgcacaacagcctgggagacaagagcaaaactccgtctcaacaac

SEQ ID NO: 145929 - DNA, 1261 bp, Homo sapiens
tcaaccaaagggctttaagcaacatctttacaaagcttccaccttgggggctgggcacggtggctcacgcctataatcccagcactttgggaggccaaggcaggaggatcacttggggtcaggagttcgagaccagcctgtgcaacatggtgaaaccccgtctctactcaaaacacaaaaaattagttgggtgtggtggtgcgagcctgtaatcttagctacccggggcgctgaggaggaagaatcgcctgaacccaggaggccgaggttacagtgagctaagatcacaccactgcactccagcctgggcaacagagcaagattccgtctcaaaaaaataaataaaaccaaataaataaaatcacctgggccgggcatggtggctctggtctataatcccagtactttgggaggccaaggtagctggaccccttgagcctaggagctcgagaccagcgtgggcaacatgggctacccagcaacattttgcgtctacaaaaatactgaatttacctggatgtggtggcaaatgcctgtaggctgaggtgggcggattgcttaagcccaggtggttggggctgtgccactacactccagcctgggcatcagggtgagaccctatctcaaaaaaaaaaaaaaagaggaaaagtcattaggtcaatgaaaattgattatctggtcaggcatggtggctcacacctgtaatcccagcactttgggaggctgagacgggcagatcacctgacgtcaggagttccagaccaccctggctaacaaggtgaaaccccttctctactaaaaacaaaaataagccaggcatgggtgacatgctcctgtaatcccagctattcaggaggctgaagcaggagaatcgcttggacccaggaggcagaagttgcaatgagctgagaccacgccactgcactccagcctaggcaacagagcaagactccgtctcaaaaaagaaaaaggccgggtgcggttgctcacgcctgtaatcccagcactttgggaggccaaggcaggtggatcacctgaggtcaggagttccaagaccagcctggccaacatggtgaaaccctgtctctactaaaaattacaaaaattagctgggcgtggtggcgggcgcctgtaatcccagctacttgggaggctgaggcaggagaatcgcttggacccgggaggcagaggttgcagtgagcccagattgcaccattgcacaacagcctgggagacaagagcaaaactccgtctcaacaac

SEQ ID NO: 145930 - DNA, 745 bp, Homo sapiens
accagtgattttccttatcatcctgcaatgcacaggatggaccccacaggatggcaaagaattaactatcccaaaatgtcaatactgctgagattaagaaaccctactctaggagcatgagctgttttagttttcttcaccatacttttatcagcatttttcaaatgtttgtttttaacaataagcatatagtacccttattattagaaaaatacatgagtaatatgtgattaagaagtctgtctaactaataagtttaaaagagctcatttagtaagggcaaagtaaaaattctaagagataaatcactgtgttttgattcaactggcagagttttgttttgttttctgcctttgtggtatataaatgtcttccaattgacggcatcttagatgaatgaaatacagcattttccagctggggagaggttttctctggagagctattcctacattcctagcactccttccttcaggttctgagtttctgtggtgttttttccttttctaattggttttcttcttacctctctaatgctattttccagactttcctctctggttttcagcaggtgaagtagcagagttcccagggttttgtgctcagatctgtaggtatctgtttctgtggaggctcctttgggactgttacccctctctgggctcattccttcataaagctgcagagctgacatgcaacttcaagtctgtgaattattccttctgaatattttttgaatgtgttc

SEQ ID NO: 145931 - DNA, 651 bp, Homo sapiens
aaaaaaatacaaaaattagctgggcatggtggcacatgcttacagttccagccacttgggtgattgaggcatgagaattgctggaacccaggaggcatggtgtgatctcggctcactgcaacctctgcctcccaggctcaagcgattcttgtacctcagcttcccaaccaagtagctgggattacaggcacatgccaccacgcccggctacttttttatttttagtagaaatagggtttcaccatgttggccaggctggtctcgaactgctaatctcaagtgatccgcctgcctcagtctcccaaagtggtgggataacagacgtgagccactgcgcctggctgagaatttacatgttaatctcatctcaaagcactctgacagaaacacccagaacaatgttttacgtaatatctcggcacctgtggcccagtcatattgaatataaaattaaccatcacttccatataaccagcaccacatcaagaaacaacagcacaaagctggctggattttgaatgttgattttaaagttgatccaaatattgttcagtatgtaaaatgtgcgtgctacccattgacccagtagttcttcttttacgaaggtagcctatggaaatattcacagagatggataaagaaaaataaaaa

SEQ ID NO: 145932 - DNA, 181 bp, Homo sapiens
cccctcttcagacaagacagtgggtattactataaactaggacaccagactttctcatttatctgggggatcctaagtgttgctaaccactgctgttagtgaggtttagcctctgcttaaggttaccaaaatctaaaaaccaaatccaaacacaattttccttccttctttctctttcttt

SEQ ID NO: 145933 - DNA, 342 bp, Homo sapiens
ccacagtgaagagaacatccagggtgaatggtgaaaaggaatcacagttgagcaccacaggaaggctttttttcctcctcggtaatcctggtttcctgtgtgagtgataagaaaaatagtattagaccattttcattcacttacgttgaaaatgaagtttaactgaacattttggctacatgcataatctatgctgtggtttcatttcctgtatttcattaatagtattttaaatgcttggttatctgaatccgctcctaaaaccatgtatttacaagattcagaaatcaccctcttaccaccaccttttactattattaactgctggttttcttacagttc

SEQ ID NO: 145934 - DNA, 198 bp, Homo sapiens
aaatctggtgggagagacagcctcattcacacatatccagcatataaaataatacgtaataggaaagccctgagcgagctctatgcaggttgctacagcagcactgaaggggtcattggtcctgactggggggatgcagcaagcatcacctgcctatgcagacaagcatgtttcagtgccacctccaacaaggaaaac

SEQ ID NO: 145935 - DNA, 387 bp, Homo sapiens
tttggtattgtatgcggtttcaggcatctattaagggtcttggaccgtatttcctgtgggtaaagggaaactactgtactgaccactgaaagcaattgttcttttatctatttttatttgtaaaaataattcagtccattcccctaatgatcaattgtttctacttatgtttcttttgcattcttgattttgtcattttacatatataatgtttatggaatttgtcatttagtcagctgatattttagtgctttctatatgacaggcactggggatacagcagtgaacaaaacaaacatccactccctcttgtagcttctaatgggagcagccaagtatagtatgtcacatgataagtgacaaagtagggagggaggacagagtgtg

SEQ ID NO: 145936 - DNA, 178 bp, Homo sapiens
aatctctttatcttgagacccttaaccacacccgcaaagtccctgttactgtgtaaggtaacatatttgcaggtcgtaggggttaggacatggacatccttcagggccagtcattcagtttaccacagtgttcgttttaattttttctcagcgcccgtcatttggtttacttcatttc

SEQ ID NO: 145937 - DNA, 255 bp, Homo sapiens
cagaaattagaccctgaggagtcaggttgagcttctcataagtttgcccccagtgtgaagtatctgacttagaatatctgaaataaacttttggggtaaggagattacttttcttttgtttgttttatgaaagagcttgacttgctgaaatattctgtgttatatattctagttgggaccactgccttcagaataagattaatatttaagctgttaaagtcagcagttggcaacccatgcttgataattttatga

SEQ ID NO: 145938 - DNA, 390 bp, Homo sapiens
gagcggctggggaagagggcagcattggtgctgcatccctgggctagcccacgagtcatccccaggcaggactagacccctgactgtaggaccacagaggcaggtgacctcaaagccctggctccaggaagatgagagtgggtgaggcagcccaaggggcctggaacttggcagaggcctgagcagcctaaggccagccctgaccccttccctactccacagagagcctctgtgtcccgggaccagtagacacaggtgggacagggtagatgagacagggccagcatttctagccatgcttaagggcctgtgagctcagggtttactcctggcctggccaaacctgaaccgccagcactgtccctgttcatgcagccataatctgagtac

SEQ ID NO: 145939 - DNA, 280 bp, Homo sapiens
tggtatctgaactgacttggaggttggagactggaccaggtggtcccaagcaagccctgctggctcagaaagagggcaggaatgtggttggcagaaaatgacatcactcacagccaattacagcagctgtcccaacagcctcccagcttctctcccaagctttgggaattgggtatgagcatatgaaagtcatgatgcagtcccttctgctgcacttagcataatcccagggcaaagggtaggcaggcactgtgcagaccccaccaagtcctgggcgctg

SEQ ID NO: 145940 - DNA, 387 bp, Homo sapiens
accaagtagaacctgctcaccagcacctacatccagtcttccctccttatcatccaatattagctcacctcacctgaagtctcccacattcctgtcttttttgccatggccctgagcttttacttctcacaatccctctgcctgacagagttctaatggaaaataaaagcaggcaaacaaaacaaaagaattcaaaaataaacaccaagagggtcactttacctaaatcaacagaagtaacagggtaaactctgcaaaggagaccaagaagcatacaacaaacatgctaggcttaagtacagctctgtccctaacacaggaagtcaggcagaggcttgaaaagcagggagcagagcacaggaagtcttttagcactgcagagatttc

SEQ ID NO: 145941 - DNA, 384 bp, Homo sapiens
gcggcgagtgcacactggatagcacgtgatggccagctctagagtatccccgcgacaggcacgcgctatcaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatccta

SEQ ID NO: 145942 - DNA, 571 bp, Homo sapiens
tatctggccggtggtataagttagaacaactactttggaaaacattttggctgtatcttcagaacacatgcagaccttgtgatccagcaattctaccctagagaaacctgtatgtgttataccaggatgtatgtacaagaatgtgcatagcagcattgtttgtagtagtcaaaaattggaaacatccagatgtctgtcaactgtagaatggataaattgtgttatgttcatatactataatatcatacagcaaagaaaatgattgaaccacagttacattcagtatcagagatggatctggcataatctggaatgattcaaaaaaagcactaaagaatataaacagtataattccatttatgtaaagttcaaaaacaggcaaaatgatattgaataagaatatagctcactattcttaaaatgcaagaaaatgattttcacaaagtcaagataatagatactttaaaagggagggatggagttgtgattggagaagggcacatgagtaggcttttaggactctggcaatgttatttcttgatctggggaaaaagataaagtaaaaagaaaa

SEQ ID NO: 145943 - DNA, 322 bp, Homo sapiens
gctgccaagactgactttggctgcctccaaaatcctaaaacactgactttcctaagtgccagtagtaggctatattgtgggggagaaaagttcaggaagagatctgatcctagcccttgggtgggcttccaccctttatggagaggtgaggcatcgttctggtacagtcagacaaagtttgagaaaggatatgattatgtgtcctggaacagacactaagaactttagtggctcagaggaggaagagtcagtgtgggctgtgtttagggaaggcttttacacaggaagtgagaccgtattgtgactttaatgatagatgtca

SEQ ID NO: 145944 - DNA, 784 bp, Homo sapiens
ttcttttgttttgagacaagagtctcactctgtcacccaggttggagtgcagtggtgcaatcttggctcactgcaacctccgcctcccaggttcaagcaattctcctgcctcagcctcctgagtagctgggattacaggtgccccctaccatgcccggctaatttttgtatttttagtagcaacagggtttcaccatgttggccaggctggtcttgaactcccaacctcaagtgatccacccgcctttgactcccaaaatgctgggactacagacatgagccaccacgcccgacccagcctgcccttattgatggcctgccgtatggatctcaaatttgccaagccagcccctaccagcctatacaccaattccttgcaacacatctcttaatatgtatctcctaccagttctgcttctgtggtggaaccctggctgatacaagtggcttttgtagtacgtccatccagtgtctgcttgtatacttcctgtgatgggaagctcactacctcttgaggcagtgcaattcatctttggtcagcttcaattttaacaagttctgctttacagtgaactaaatcaagtctttctatgagctttacccactgctgctggttcaaccccttggacacactcagagcaagattggttctttcacctcacaatagcccagcagatatttgaagttgggactcatgctgtccatgcccgctctaccaagtgtctctcatttgacctgctgctcctctcctctgacagtcccccaggttgttgatgcccctttt

SEQ ID NO: 145945 - DNA, 731 bp, Homo sapiens
cttcaagcaaaagtgaactgaaattaacaaaagattctattttgctttcttttgaactgttcttttaaacattttagaaaaccattcacccctgtgattgtttgacttcaactccataccttgagatattttttagggtaaattattgttaatgaaccacatttgagtacaccttcccttggggtgggataaacgttggttaaaaggtgcttttaaccagatcacggtgcactgcagtgtggatggtgtggtgccagacacgaatggaattaatagtactacagactaccgtgtgcttttaccaccctgcctgggtggtattctactgtttactatgaaatataaaactcattcaaagcagactaagtttttgttccattgttcttatattttatggcttccaggggccctttatgaaggaaataagtatagtagtaatactgctttggggaaaactgtgttcatgacaatctgtttttaaaacatgctgtttcacaggaaacggattttaatataaagtattgtaaggaactcatgcatgctgggaatcctaactatgccattaaaatctttaaattccaaccacctctttctgttaatggagaagaaatggtttaacagctgccttggggtagcgtaaaggtgggctatatgaggcattgctataccctttccctagcaccttggaatatctgttttcttatgttgggaatttattgggagccagaagt

SEQ ID NO: 145946 - DNA, 157 bp, Homo sapiens
ctctgaatctttgacatctcagatgaaaaaaaattgtaaattctatggacttaatattttcaacatacttcaatttttttttcaactataaaaatggagataatttcctagaaaattattctctactgggtcgtaagctagtcacgctgtataactt

SEQ ID NO: 145947 - DNA, 348 bp, Homo sapiens
tgggactcagacactgatcccggagcgagaatgcggctgacagttaaattgcagtgtaggccgagggggggaaaagggaccatgtctctttaacgggccctgcagacaaagcgtctccccttggagcgagcggagccaggcgcagccgcgcgcagacctgtcagcgcgtctcacgcgcttgggagagagtttgcaaagtcataattatatctcttaacctgtcttgctctctgcagaagaaggtcccattatattgaaatgagattattagccatcaaatactttctttctcgggagttttttttttttttaattcaaataccttaacgacttggcaattgcattttg

SEQ ID NO: 145948 - DNA, 149 bp, Homo sapiens
tcagaatgaaatatctgcccagtggtattgaatttcatgtattatgatttacatattcttctgtgtatcaactggttttatattacccagagaatgcttatggtggtggttgagagttgtgtattgctattgactgtacgggccataga

SEQ ID NO: 145949 - DNA, 534 bp, Homo sapiens
aaatgaaaacacaacatatcagaatttgttggttgccattaaagcattacataaaaacttatagcattaaacacctattagaaaagagagaaggtctaaaatcaatgacatcagcttcttttttttttttaagacagggtcttactctgttgcccaggctcaagggcagtggtttgatcactacagcctcaacctcctgggctcaggctgtccccaccttatcctcccaagtagctgggactacaggtgtgccccactaattttttttagtagagatggggtctcactgtgttgcccagactggtctcaaactcctgggttcaagcaatcctcctgcctcggcctcccaaagtactgggatttcaggtgtgagccaccgtacctgaccaatttcattttaagcaactagaaaaagaagagcaaattaaaaccaaagcaagcagaagaaaaaaaaaatagagatgaaagcaggaatcactgaagcagaaaacaggaaaacagtagcgaacattaaccccaaatctggttcttttg

SEQ ID NO: 145950 - DNA, 509 bp, Homo sapiens
agaaatgcatttaactggaaatccatgtgtttagaggttcctgtgttgcatataggcagtgaaatgatgggtaacatggaggaaggacccttaatgagaaagaaatgaagaagactgacaaagaagcaagtaatgagataatttcattccttaacataaactcatgaagtctgaagaattttcaaagcattatgataggctcattattttggtatagttgacattaggtttatgcagtatttatgttatgaaacttgggagtcaaaaaatatattaataatcttatgagtgaatctagtcttgttccagttttcacattttgaaatgaattctgatgatgcaggccattcgatagtttatcaaaaataatctttcaatgtaattcatatttttactttttatagcagatctctgtcctttgaaattggaactccgcctttgttttttgttttggttggaaaattgccttctaaatgtacaacatggcaataaaactacaatttatcatg

SEQ ID NO: 145951 - DNA, 622 bp, Homo sapiens
agtgtggcagcatggaaagaggatgaggtgctggcatccatgagatttaggttcgaatcctgccccagccacttccgagctggtcaccatgggcaagcatgttatttggtatgtgtgagcctttagagataagttcccttatctctaaaaccagcatgataatccctgcctaccacgtgggactgttggagaatattaaatgtggtatgcatgtaaaccacctaacacagtgccaagtgcaggtgacgggctcaatgacaagctaccaatggttagtttgaatgcattgagcacagtgcctggcatgttcaaggccgttgttttgggatgtcattcgctttcaggcctcccctggcattgtggaacacagagctctgcacatagtgggtcttctctaccttccctagcactttcaccagatgtgtttggctttgatgtttcagaggaaacaaaagctgacccctttgtgatcccctgcagcttacagccactagatttacaaatggcttatgtctaatctcctcccctcctgcatttatttcgatacaatgaagttggcgtttctctgtccttctgctggagttaaccttcccctgggttctggatcacatcccttcctgtc

SEQ ID NO: 145952 - DNA, 400 bp, Homo sapiens
cacagacaacccaaggagacagacacacaggcctacacgctgacacatacacactcatttgcatgctcacaccaaaccagagacaaactcacaagtcccacagacctagacacccccccacaccagacacacacacacaggtatttacacactcatcacggtcagagacaaacgcacacatgcttggggacacacacacaaacccagacacacacacactcgcctccagatctgcgcgcacatagcaaacccctatgcgcacacactgtccaaacacacagacacacaagagactcatccccaggcactgacacacacatgtaatgcacaaccactctgcccctacgtggacggacacacacacacacacacacacacacacacagcgcaaacaaaccca

SEQ ID NO: 145953 - DNA, 302 bp, Homo sapiens
gcctggatgccacttattggaatccaatcaattttagaacattttcatgaccccaaaaaaccctacacccagtagcagtcactctccgttacctctaccctcaacccttagcaaacactaatttactttctgtctttatggatttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaa

SEQ ID NO: 145954 - DNA, 3214 bp, Homo sapiens
  misc_feature (5)..(6): n is a, c, g, or t
gtccnngcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggtt

SEQ ID NO: 145955 - DNA, 640 bp, Homo sapiens
tatgtatggcaccatgactgttcttggaaatttttattttctagtggagatatggatcttctcaaagagaacttgatagcagaaaaaaatatgaacttctacttcaaaatttagccaaaactttattaaatcagcttaaattgagtgattttttatttatctgtgaaatgatttggaatatggtttgaaaaactaatccatactttttttaagtctgcagttttctcttttccctttttacagttggatcgactggttgtggatgcagcaaaggagaaaagagaaatggagcaaaaacattccaccattcaacaaaaggtacctcaggggaaaaattaaaaattaattccactttatacaatggcttgggtgttggtttatgcaaggtatcattgtattggaacaaatcttttgagttgttctaataattgtgcagataaattcctcttttgtttttgaagagcaaaatgttcttcagattttaaggtatgtattttgttattttttcagatctttgaaagctatgcttcttgaaccagtttataaaaatttgaatctcttaggaacttaactaagctaaaagtggcctttagttagaattcaaaacactattcataattacatttaggataccaccaac

SEQ ID NO: 145956 - DNA, 427 bp, Homo sapiens
cgcaagtgagcagtggtctcaaatattgtgtttctgtaggcgctggttttcaatacagaataatcagttggtttaccagaaaaaatttaaggtaggtgttaataaatgaaaccccagtgagttaccagtttcagttatttatctgttttggtaaacattgaagtctatacatactcatttgtgtaaaattaatgtaattatttattagttttatgtttgagcaggtataagaggactctagggtggaaaatatcaacatttaattcttaaaagcaaagtgatttgaatcctgagttcttaattccttgctttgagatggatttttctgggtcacaggattgtttaaaatgttttgatagcttttaaatggtatatattagttgtacatacttttgtggtacatgtgctattttgatacttgtataca

SEQ ID NO: 145957 - DNA, 279 bp, Homo sapiens
aggtttaaaaaatatttttaatgtaaataatctaattgttctttcaccatcaaagcaaaccccaaaatgctgggattacaggtgtgagccaccgcgcccagcctgctaaagttttttaatgaagcaagttataaaagtttcactaagtttttcttttcttagagatcttagaaaattcaaagatgccaagaagcaattcgaaaaagtcagtgaagaaaaagaaaatgcgttagtaaaaaatgcccaagtgtctgtcttgggtccggctccgacttcgta

SEQ ID NO: 145958 - DNA, 6978 bp, Homo sapiens
  misc_feature (5)..(6): n is a, c, g, or t
  misc_feature (4835)..(4835): n is a, c, g, or t
gtccnngcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaantacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggc

SEQ ID NO: 145959 - DNA, 7353 bp, Homo sapiens
  misc_feature (5)..(6): n is a, c, g, or t
  misc_feature (5210)..(5210): n is a, c, g, or t
gtccnngcggccgctcccgcggccccctcggctttgccagcgccgcctgcgaggcggaggcaggatgaagatgactgtggatttcgaggagtgtctgaaggactcgccccgcttcagatgccgtgagagcaggggcttgttttaccgcttgctgtttcctaagtctctagtacagtgcgtgacatccattctggagctgggaagtccaagataaagatgccagcagattagtgtctggtgagggccagctatctctgctttcaagatggcaccttgttgatgtgtcctcaatggcagaaggtggaagggcaaaaaaagggaccattaggaccctttcttcagcctcttttataagagcactaatccattcatgaaggcggagccctcatgtcttcatcacttccccaaaggccccacctcttcatactgtgacaatggagatcaagtttcaacatgaattttggagagacacaaacattcaaaccatagcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaantacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggc

SEQ ID NO: 145960 - DNA, 7447 bp, Homo sapiens
  misc_feature (5)..(6): n is a, c, g, or t
  misc_feature (5304)..(5304): n is a, c, g, or t
gtccnngcggccgctcccgcggccccctcggctttgccagcgccgcctgcgaggcggaggcaggatgaagatgactgtggatttcgaggagtgtctgaaggactcgccccgcttcagatgccgtgagagcaggggcttgttttaccgcttgctgtttcctaagtctctagtacagtgcgtgacatccattctggagctgggaagtccaagataaagatgccagcagattagtgtctggtgagggccagctatctctgctttcaagatggcaccttgttgatgtgtcctcaatggcagaaggtggaagggcaaaaaaagggaccattaggaccctttcttcagcctcttttataagagcactaatccattcatgaaggcggagccctcatgtcttcatcacttccccaaaggccccacctcttcatactgtgacaatggagatcaagtttcaacatgaattttggagagacacaaacattcaaaccatagcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaattacccagtctcaggcagttctttatagcagtgtgagaatggactaatactgtggtcttggataacatctggaagaattctctggattaccagatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaantacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggc

SEQ ID NO: 145961 - DNA, 6920 bp, Homo sapiens
  misc_feature (5)..(6): n is a, c, g, or t
  misc_feature (4777)..(4777): n is a, c, g, or t
gtccnngcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacacttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaantacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggc

SEQ ID NO: 145962 - DNA, 6358 bp, Homo sapiens
  misc_feature (4215)..(4215): n is a, c, g, or t
gaaagtagcgtttattatatgtgagtggggaccaggagagtgaatataaaagaaaatggaagaaaagccacagaacattaacatttattgagcatctactaagtatcaagtgttggaccagtctctttatatgtaaacaatttcatttaatctctatataatttatgaggtagatacagttattaacaggacaaaattacttttatgtctatattgataacccctgtttctaaaataaaatataaatcttgaaaattagaccagttatgccaagtaatatttttaagtatttcattattggtagtattaaaacctaagtggaaaaatatggaaatttggtttcctcactataggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaantacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggc

SEQ ID NO: 145963 - DNA, 4197 bp, Homo sapiens
  misc_feature (2054)..(2054): n is a, c, g, or t
taaggatcccctgcgcttgatgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaantacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggc

SEQ ID NO: 145964 - DNA, 1281 bp, Homo sapiens
  misc_feature (5)..(6): n is a, c, g, or t
  misc_feature (1229)..(1229): n is a, c, g, or t
  misc_feature (1257)..(1257): n is a, c, g, or t
gtccnngcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccccaagaatctagaagatgtgtnaacaggtattttttttaaatcaaggaangctcatttaaaacaggccaaggtt

SEQ ID NO: 145965 - DNA, 1224 bp, Homo sapiens
  misc_feature (5)..(6): n is a, c, g, or t
gtccnngcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagcatggaaagaaaagtgcttgtaagtcgacgcggccgcgaat

SEQ ID NO: 145966 - DNA, 471 bp, Homo sapiens
tagatacttaatgtttaacttactgtcctaacactggctagtacttactgcaccttactgtgtagataatgctttgttgtcatacttcttgcctttctgtggacatagagatagatacaatagctgtgatatgtggctagatagatacatagataaacttgtagagagagagaatgactctggtgggggtgataatcttctagcagaggtaatttggtgaagaacagcaaggtgataatattactctcagttcttgtctcattttgttttaacataaaacttctttgtagaataagcatctgcagaatgtgtaaggggattagttaactgtacttgcttaaaggatttttaaattttagcttattttaaggtctttaatgtatagcttatttttctatttttttttgccaaacagcttatgtgtgagttggggaatgatgttataaatcgagtttatgaagctaatgtgga

SEQ ID NO: 145967 - DNA, 203 bp, Homo sapiens
atactaaattccaaggtaattattacttcatgtgaagtgtaatttttaagcattcatatctatcttttcatttagagttacttttcaagagtaaagtgtacatttaaacaaacgaaataacttattttatatttaatttttctagggcagctttggaagaagtagaaggtgatgtggcagaattggaactaaaacttgataag

SEQ ID NO: 145968 - DNA, 375 bp, Homo sapiens
ccactaaagtcaaatactttaatgtattgaaacatttctttattattgatcatttaagtcccccttcatttttcttattaatattgttgtaactgtcttaatataaaccttttcttccttttgaactcttttcttaggatccatttcttgtctaggaaacttagtcaagtcatatgaacttctttatgtgttattttgtgtaggatttctccagtgatgattctaagttagaatataacgtagatgctgcaaatggcatagttatggaaggatatctgttcaaacgagccagcaatgccttcaaaacttggaacaggtaatatatttcaaatactagtcttgatctatacatagttttgattttctgactttccc

SEQ ID NO: 145969 - DNA, 823 bp, Homo sapiens
atggctgaggctttggctcatggtgcagacgtgaactgggccaattcagaggaaaacaaagcgacaccacttattcaggctgtattaggggtatgcgtttatacaatgacattttcagtagcaatcaaatatttaaaaaaaatcataatatgttctgaactggctttagtattgtctttgcttcaagagatgggttagaaaatagaaggaacctctgtgctattaatagtagtggtttctgagcaccacttcggttgtttcaagtttttttgcagtggaagagaattccgataatgaaagtatataatgtgttttgctagttcacaaactgcaaatgaatctctattagaattagttcttgggaagaaaataatataatttataatttctctgccttggctgagggatattttttgttttggagagaaggaaatggaaatgctatttgagtaacgaaaaccaattgtttttaaaaagaaatgtattgttgtttcttgttatttgcttttgtctatagttatcctcttttttcctttaagggctctttggtgacgtgtgagttcctcctacagaatggtgctaatgtcaaccaaagagatgtccaagggcggggaccattgcaccatgccaccgtcttagggcacacagggtaactgcagtgctttcatatttaaggagactttatttgaaaaattattttgaattaatgttttagtttttcttaggttaaagttttcaggtagtgtttgtaaagagatgtgttccatgacttattttgtcacgatggaatttgaaagttaaaaaaaatctctttcagaaaaag

SEQ ID NO: 145970 - DNA, 683 bp, Homo sapiens
ttttcagcatttatttttagttgccccttttcttccaaaaatgctcatctgaacaaaattttaatgtaatgaattataaaatagtactagtaataaatatgaatgttgtttgattaatacttgtgtaaatgtttaaagtgtctttattttatttcatgcaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaat

SEQ ID NO: 145971 - DNA, 389 bp, Homo sapiens
  misc_feature (5)..(6): n is a, c, g, or t
gtccnngcggccgctcccgcggccccctcggctttgccagcgccgcctgcgaggcggaggcaggatgaagatgactgtggatttcgaggagtgtctgaaggactcgccccgcttcaggtaaccggcacggccgcccggcgtcaccgcggagctccttcccggcgctgggggcgtgaaagccgggcccgcgcacccggaggaggccccgcgtccgctccttccgacggggcgagcggctgttgccgccgtttcccaccctgcgagggcactgcagtccccaccgagccctcccgaggggcgacgaagtggcggggacggggacgtcgcctctcatttctttccttgccctctgccggggcggagcgccccgaaggccggcgcaccctctc

SEQ ID NO: 145972 - DNA, 7082 bp, Homo sapiens
  misc_feature (4939)..(4939): n is a, c, g, or t
gggacgccgacttctgcttcgcggtgcccccggccagagcgactctccggagggcgcccgcggtggatgcgtgcgggaatcgcggggggaagcgctgtgatcaaccgcattccgtggaccctagttgggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaattacccagtctcaggcagttctttatagcagtgtgagaatggactaatactgtggtcttggataacatctggaagaattctctggattaccagatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaantacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggc

SEQ ID NO: 145973 - DNA, 6140 bp, Homo sapiens
  misc_feature (3997)..(3997): n is a, c, g, or t
aaatattcagtgatgggttatttgtttttaagagataatttgtttcattggcaccttaatttcttcgttaacatactttgccctaaagatacatgaaataaaaccttctttcaacaaattatatatatttttggctagaaaattattaaatagcaaagtggaaaaaatataaagcttatagggtgtttttggcattaacttagtgtctgagaaaacaatatgttatttccttttagaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaantacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggc

SEQ ID NO: 145974 - DNA, 1801 bp, Homo sapiens
  misc_feature (5)..(6): n is a, c, g, or t
gtccnngcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtgattgctgtaaatagcgacgaggccaggcgggagtctctgttttgtcctgatgagctagattca

SEQ ID NO: 145975 - DNA, 571 bp, Homo sapiens
ttgctttgtgctacataaaaatctaacatgccacctttgcagcataggggaagagataggcttaacaagaaattaataccgacaatgacaagtttaaactcctcattaaacttaagttggagaggtggctgtgctggggttggtatacactcccggagcttggtagagcagaggatgtggaagtgtcgcctatggatgtaatgcaagccattcatgagataaaaagagctggcttggaggtctttaaatcatttcccaaaatacaggatagagcattcaataaagagagactgtgtggagtggacttccccaaactggaggctgatggagaacagcagcctgagaaaagtgcatcactcatatcatgagacatgcatgcaaatattccctgtggtggcccttgaagatccttgaaagccatcacaagaagaatgaaaggtcagctccaaacacctaaaaggctcagaaagccggaagccatcttacaatagtaccaattaaaggagagctttcttgctatcctcaccccgccgtcctgaattgagactgtttggcaacttaaaaataacca

SEQ ID NO: 145976 - DNA, 173 bp, Homo sapiens
ctgcttgtcccctaaaggcgttcgagtattctaactctggtagactttgggctgcttaacccaattccctgttcatttcgttctggagtaaaccgagtgattgaattctctcccgggccacaatcagatcttgctggtggaactcactctctgccttcccaggccccagcccg

SEQ ID NO: 145977 - DNA, 913 bp, Homo sapiens
ggctccaacaatgagcaggacagagccagggccgacccgccggaagtctctggcctggcagggaagacaagtaggaaagccagcaactccatccgggggtgagggtgagagggagacaggtgggaaagccagcaactccatccgggggtgagggtgagagggagacaggtgggaaagccagcaactccatctgggggtgagggtgagaggcaggacgtcctggaaccacagaggcttgacatccagcccagatcagaggaggacaaagcaggaaggacttcctggaggaagtgacttataaggtgagacttgaaaaattaggaagaatcagaaaggagaagcaaagggggaaagagcattctagacagaaggaatggcacgcacaggccatgaacgaaggcaccgttggtggaaagcccagggagaactttggctacagtgaggagggaagtggggagtgtggcgagaggcaggtgagggccagatgttcccatctcttccctgtaccagccagtcgtctggcccatgccagcctccctcctgaaattctccaaagaagacgtgatccgggcggggccctcaggatgcccttcaggaagcttctcttacccagggcctggggcctttggtgctcaggaatgggatgtgatgctgggcttcaacagggacttaggcctctccatgcctgtcataaacgcttcctagtcctcaggtcacgcccaggctgcagtcttcccagggctgtactctcccagcaccctcaggagggcagacctcaggcggagaagcctgccggtgcctactgcccagaatgggcttcaaatcaacctctgctgggtttctgggggcagggaccagttcacaagcccctccaggttcccccgtctggccttccctccccacagggctggcc

SEQ ID NO: 145978 - DNA, 299 bp, Homo sapiens
atagaacccatattcaggaatgaacccaggatgaataatgaggaatctaggattctaattccaactttcctcatttcacactgactttggggactttttacattacagagatttggtcttcccatcggtaaaatggggctaaaacctccaacctgctttcctgccttgtggggactgctgtgcaatctctccacatatgaaagtttatcctctagggaagtaaaacatcagcggtttccagcatgttgaagaacagtgtttcttacatcattcctccacccctagggttttgtagggag

SEQ ID NO: 145979 - DNA, 305 bp, Homo sapiens
gtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctatgggccaagactgaagaaagtactgttgttctaatggtttcatagaaagttaatgccaccaccataggctcatgagaggccatgaagtgctttaatgggtcttaaatgggaggggcttcaatagaatag

SEQ ID NO: 145980 - DNA, 149 bp, Homo sapiens
gacagacacggcctgcaaaggcattaaacccaggtagagtgggctgtcttcggcctgcagacggccgcggtcatgctttgcagaggagctgtggccccttaaagtgacatgacattatggacaatgacagttgatccttgggggctttc

SEQ ID NO: 145981 - DNA, 771 bp, Homo sapiens
acatatggctagccagttttcccagcaccatttattaaacagggaatcctttccccattgcttgtttttgtcaggtttgtcaaaaatcagatggttgtagataagcggcattatttctgagggctctgttctgttccattgatctgtatctctgttttggtaccggtaacatgctgttttggttaggccctgagaatgatgcagccagtcctacacatatgtgcacacatgcacgtgcacgcacacacacaaacacacagagacactgaacacaggtgtgttcggagtaggaggagtccctatactatttactacttgaaggcaaaactgtacctgtttactggtgtatcccggataattcaccagatagttagagtgaatgaatggagagatggtactgaatctatgtatgaggaacaatgtaacaaatctgtcagtgagttaccagtacctacactgggggcaaatctgcttatttgataccttcacggcatcagcagcataccttgcaaaatacgtttatttcgagaggctgacagcagaaatactctgtggtaaggtcacaaaatttaatgaacaccactgctgaaaatagctagttcttttaatttgcctatacttatgtagttacagttcacacttttcctgaagatcattataaatttgctggttagtaggaagataaattaaccaaataatttgatctagattaaatttagttcaaccccaaaatttaaattgtcccttgaggcaaagcttagtttctgcagg

SEQ ID NO: 145982 - DNA, 210 bp, Homo sapiens
atttaagacatctgtattataaaaggaagaggaaaagcgacctaaaaggtgatagtttctgtattctactctaaagtgaagaaatattgactagtagactgtgataaagtaagtacatacatactgtaatctttagcagcagtggttttcaatcaagggaggttatgcctttcagaggacattttggcaatgtttggaaacataattaca

SEQ ID NO: 145983 - DNA, 375 bp, Homo sapiens
ggaggctctgagggagaatctgttccatgcctctctccttgttctgctggttgccagcggtccttggtgttcctggcttgtagaggcatggctccaatctctgcctccatcttcacgtcaccatctctctctgtgtgtccctgtgtcttctcctcttcttataaggaaatgtcactggatttaggacccaccctaaatcgattctgagatcatcgagagccttaattaataacatttgcaaagaccctgtttccaaatatggtcacattctgaggttctagatggacatgaatttagggaggatgctattcaacccaatgtagtggtcagatgattgaacagccaccacagaaagcagcaaggaccatcacagaa

SEQ ID NO: 145984 - DNA, 332 bp, Homo sapiens
agcctcccagtagctgggaatacaggtgtgccccaccatgcctgatgaagctttctttgctctaaaatctgaactccacaaagacattgatctgccctgtaggagccagggagcttttttcatttacccacgataggtcagcaataggtgttttgcctgctgctgaaagaagttcccataatcagaattcactgcatattttacagggatcagtgcaaaatgaaatgtggggtcccatggcagccccttaagccaagcacaggccctgggtgacctcaccggccttgtgcccagagagctgctctgctcagagctacaccagggatttgaca

SEQ ID NO: 145985 - DNA, 391 bp, Homo sapiens
taaatagagatagggtctcactctgtcacccaggctggagatcatagttcactgtggcctcgaactcctgggttcaagagatcctcccgcctcagcctcctaagtagctgggattacaggtgtgcaccgccaacagtccacttactaactgctcctcaaattgtccagtttgagtgtgccatctgcttcctgctgggaccttgactgatatagcaatcccgaatcacacatcttcatactacactgctcagtggtagaaaggcgggagaaagaggttctcttttggccattttaacaggaaagagagtatgcttcttgcccggcaaacaacttttaaattcttttttattttattttatttttttgagacggagcctcgccctgtcatcca

SEQ ID NO: 145986 - DNA, 362 bp, Homo sapiens
taactgctccccacctcacctccattcctgcgcaagttacataatgctagtgagtgcttctgggaaagaaaagttttctctttctttctctagagctactgaaagagaccctttctttccttcaaaatggtgtcatatgaaatttgaggtgtggaatggctgcagccgttgttgccaaggttggatgtagcctgaggatgaacctactcatggaacagggcagaaccaagagaatggcagataagtgaaactgcaaccctgatgacattgtaaatctctggatcagacttcctctgcatgtttcaatttgtgatacagtaaagtccatccctctctctcccctttttaagtgagttagaatt

SEQ ID NO: 145987 - DNA, 401 bp, Homo sapiens
ggcgtggtttcccagtgtggaggcgcggcacttggagtcttgcctctggctgggttaatgttcttgagcagggctgtctcttccttgagcctcagtttcccctcctgtcaaataaagggcaccaggctgagggcacgccagggtctcttcccagtcccgtctagctcctgggtggaaagccaccattctgctgtaatgcttggcttcctcagagcccttgtggtctcggcacagatagggagactgaggcacagggaagccctcctgccccagcctcactcctagaggccctaggttctgtgaccactgccactctgcatctgtgtgtctgtgtgtggctggctggctccctctcctctcccaccattcccaaatttcctggtctggctgtgtgagcttca

SEQ ID NO: 145988 - DNA, 537 bp, Homo sapiens
aaatacctcagcatacctctactcctccaaccaggtccaaggatcaggccaaaactccctgatgtggtaaacagcctgaccccttgcggacctctctctctccagccacttccctaagattccccagtgctctgtgccctagccagcccgactcatctgcccagattcctcaatgtttcactctctcattcaccattttgaccccactgtgctcctgggccactctccaaggccccgcctcttcatctcctccctccttactcatccttcaggtcttggcttaggtgccattccctccaggaagccttccctgacaccaatcccatcctcacctagaacagattatgtgcgcttctttgtgccccccatggccccctgtgggtttgcttcacggattataactgcctgactacctgcctttctccaccctctagactgagaacaccatagaagcctcctcagaccactggtgcacttcactcctgcaagttgagctggactgcattgggggccagctgaggggatcctcagagtcac

SEQ ID NO: 145989 - DNA, 380 bp, Homo sapiens
cgagcctggcaccgggtgtggagtcggactccaacctctcactgccatttgtttccactttccctgcccttgccttctctgcagctatccatctcccgcaccccctgcaactttctctctctctccgtttccctatacccactctccaacaaagatactccatagccagctcccattctaccaggaccccaagctacaaacatgggcactatcctggactccacctcttaaactctgggtatagtttccacaatgtgtcaattctatccctacctaactcttttggcaaacccttttctataccctcccaataaacatttttgtctttgatagccttgaagccgaatcactgttcacataaccccagaaccatctttctc

SEQ ID NO: 145990 - DNA, 424 bp, Homo sapiens
aaaatcatggcccctttctagtcctttccttgcttaacagaacatgccatgccatgcccctggccagcaccttccaggagtctcactgccatttgtttccactttccctgcccttgccttctctgcagctatccatctcccgcaccccctgcaactttctctctctctccgtttccctatacccactctccaacaaagatactccatagccagctcccattctaccaggaccccaagctacaaacatgggcactatcctggactccacctcttaaactctgggtatagtttccacaatgtgtcaattctatccctacctaactcttttggcaaacccttttctataccctcccaataaacatttttgtctttgatagccttgaagccgaatcactgttcacataaccccagaaccatctttctc

SEQ ID NO: 145991 - DNA, 539 bp, Homo sapiens
gaggggtaatatttatctcaggatttatctcaggatttactgtaaatatgtatacacacatacaaaaacccaggcattgttaagagaaaataatggcccagaggttgaaattatcagacagaacctttaaaaataattatgattaatgtgttaaaattctagtggaaaagataaataacatgctcaggaaattttagcagagagatagaaactatataagaagctcaaatgaaaatgctagaaatgaaaagcagtattggaggtgaaagattcctttggcaatttatcaacagactggagatggcagaggcagaatcagtaatattgaaggcagattactatatattattcaaacagaaaaatgaaagagggagaaaaggagagaagagatggaggaaaaaattgggaagactggcaatactaatttgtgaggatagggggcaactagaatcctcatacattactggtggagatgcaaagtggcaaagcctctttggttgagtttgatagtttcttatgaagtaaaaaataccatgaaa

SEQ ID NO: 145992 - DNA, 377 bp, Homo sapiens
aggcaataggagggatcatcatggtgacggaaatgttctacatcctgactgcaagcatcattgtcagtatcttgactatgatattgtgctgcagttttgcaagatgttaccatagggaaaaactgggtaaaagatacataggctctcctctttgtattatttcttacaactgcatgtaaatctacaattatctcagtttaatttttaaaaaatagctcaggttaagggggaggcaagacaaatcaaaatctggcatgcagttttcatattcataagaggattataataactactaaggaaattttttaaatgtatacaaagtaaggagatttgggaacacaaggtctcttaatgacaaatggtaatttaatattact

SEQ ID NO: 145993 - DNA, 337 bp, Homo sapiens
aatgaggtgcatctcccacactgcctttcacagtgactataactgcctcttcccaaatccagctctcctctttttgtgtgggtgccgggcgaactcgtgtctgtctccatcacaagacccctgacacctttgcttgatgccatcaggtactgtccccttaatcagatgactttgagagcttgaatcaattcagctcagctgaaaggctgccttatctagggtaaaggaggtgagaaggcagagattcctgcctggggacatccagaaggcaccaaaacttaagcgtacattcacagggctagtcaccccttcaactgctgacagccccttccctggg

SEQ ID NO: 145994 - DNA, 267 bp, Homo sapiens
tgaattactattacaaatcttacatgtgaaaggatccataattctgggacagacagaattcaagccgaacatgttggcctgatagggtagaacctggaaaggagatttatttgctacagaatcgtatgtcaagctaaaatttaccttatgagatttgttgaaataacattctggatagaactcccaaatctgtccaatcttgtttgtttcttaactggttaaagaatatttgataatgagttaggctatgttgatactgttgatcgc

SEQ ID NO: 145995 - DNA, 511 bp, Homo sapiens
aaagccaggccagcctggaatcacatcctgactcctcattttcttgctgtgtgacactgtacaagtcacctagtgtctctgagcaacaggtttcttacctgtaacgaaaagctttatacctgcatcatggggttgttataaggcttagaagagatgttcaagcccaagagcctgtcagtctcctaccctagagagaggaggggacttgcataaggtcacacacagaggcagatccaggcctgcaactcaagactcactgctcctagcccatgctctttctctgaggagccatccctcatgctgctctgtgagtccttgttccagtgacacagtgccagtctggggggcggggagcgggtggaaatcacgccttggtacgtggtggtttactctcatctctgctgggctgatccagctgctgatggtgagagaaccagtgcttttaagaggccttcatgcgtgatcccatggaacagtgagttcagtctggccagcctcataggctgccagc

SEQ ID NO: 145996 - DNA, 181 bp, Homo sapiens
gcttccttcttgtagagcatcgtgctgaggtcgggcagctttgctctgggatctcagcccagtcatgttgtcccttcgctatctgtgttttgccagccatgaaacagggtgcgagatccctgattcctctggctgtgaggccactgagcaggatgtgttgtaggatggtgggtagagacca

SEQ ID NO: 145997 - DNA, 297 bp, Homo sapiens
caggggaggctcctggcttcccaacagaggaaggcatcacttcagaaagggctgtcccctcaggccttctgtaggtggccggtggggtctaagtgtgtgtgcccttcactccccgcttcattcccctcatcctccctgtgctcctgtaatgcccactggaccactggagagcccccgcagacggcaaacagcagcagagcacacaaccagccctctcaggtctagtaaaagtgagcttcctacagaaatgcacaggggactgagatgagagtcgagcaggcctggaaggatcccggg

SEQ ID NO: 145998 - DNA, 369 bp, Homo sapiens
aggtacctagctcataagcagtatagaatattatttcaagttaataatcataagaaatcagaaacaggaaggatttttacaattgtggaaaaattctttgatgagaaaatattagttccacttatctgggacaataaaaagtaggtacatttgatttataagctgtagtttcaaaaatataagagtataacataggtttttgtaatgagatgttaaataggaattattctattgtctctgacaggttgctggaatctaaaagctaaaatgaagaggtactaagtgccttactcttctacgagacaacagaacaacagaatagaaccaaacccagtcagatacgatcactgtggccagaaccactatctg

SEQ ID NO: 145999 - DNA, 436 bp, Homo sapiens
ctcgaattcctgacctcaagtgatctgcccgactcggcctcccaaagtgctaagatgacaggcgtgagccaccacgcccggctgtgactttgtatttacagagaaaggcacagtctatgtttcagtttcttcccagcttgtactaatgttaatgctaagggaaatctgtggagtgaaacttctctgtagtataaaatagccttgtattcctaaaattcaaagtaatatatgttcaccaaagaaacttttgataatatcaaaaagtagaaagaaaattaattgcctattattctgtctcccaaagaaaagcaactatttatcccacagatttcactggggacttcttttgtgccacgtactaaactaagtactagagataaaaggttaaaagttacaatttctgtcctcaaagagctcatggtccaattatgagaaa

SEQ ID NO: 146000 - DNA, 245 bp, Homo sapiens
gcctggctccagagtcaacccttttacccattagaccacagtgcttctcagagattcctacactgattctaagcaagagacaattacagaaatatttcttgctgtgttaaacttacatagcaagcatcacttgcttgttttatttctgattacacatgatatactagtaaactctgaaagctggatcacagccttttatttcttgtagcctttggaatgtgtgtgtgtgtgtgtgtgtgtgtgtg

SEQ ID NO: 146001 - DNA, 269 bp, Homo sapiens
agccactgggaatacaacatggggggtatagtctgagctgatatgcatgaaaggcggcctctcagtctctcttggagatccccggataatgatattaaagataatttatactaaaggaatttctaaaagccagtctatatgtaacttatgggcactctgtgcacaatataattttgttggtagtgggacactttgtctcagacatgtgtggcaacattggaaagaccaccactaactgaagtctacagttatttcaacctccagacacc

SEQ ID NO: 146002 - DNA, 319 bp, Homo sapiens
taaattaatattagaaaaaaagtaaaaagaaataagaatgaagggagagaaaaaagaaggagggagaaaaacaagggaaagtaatagtaatacactggctgaaataaccaaaatgtggaaaggacagccttaggtgtgagtggctccagaggtttcaacgatgctacctggtatttttccttgtgccacttctgaccagcatttccagaaagcatggaagccagccacctgtagcttcagatttcttcttctttttttttttttttttttttttccaacaaaaggggggacaccttttttttttttcaaaaacttgggg

SEQ ID NO: 146003 - DNA, 963 bp, Homo sapiens
aatcttgcagccgcacactctttgggtccgcccgtttctctaatcaagttgtaacactcgctgctgtggtccacagcttcattccttgaagcccgtgagacacgaacgcttccattgagaaaaaccttccatcagaagaagacttctcgtctcagtgggactgctgagttgaatgagacgaggtttcaccatgttacccaagctgatctcgaactcctgggttcatgcgatccacctgactcagcctcacaaagtggtaggactacagctaacatctctactcctctgcaagatgacctcctcctgcatgcacacagcagccactggctcatagcagcccgagagcccccaaatccctctgaaaattgctgtgaaacagaggtttgcctctctttcctgagaaccagaatgagtcagaagcccagtacacatgggaacagttgagcctttggatcttctgtgcagtttctcctttctgataagttattcttttcttgcaaatgattctctcccagataacaatctgagcagggaggaaaagaagaaagggacaatttgtctattgagtcaaacttcaggcagcatttgatgtaccctagccttggaaaagggctaaaactgcatttagtttgtggcaaatgtgaattatcatctttctatgtcaagttgttcatgtcttttgataacatagcaggtgatacttactcagagtattaatcatggcatttaacctactctgaaagaaaaccaaaatacccttagggagagcttccattaccaggatatccaatattcattttgccctaagtgcaacctccaaagatgcagtcctatttaaataatcaattcttctcaatcaccccacccaacaatgactggaaattaccccaaagaaaagaagaatggaataatcaactttgaaagaaagccctttttatattaaaattggaactattttttctc

SEQ ID NO: 146004 - DNA, 511 bp, Homo sapiens
aatcttgcagccgcacactctttgggtccgcccgtttctctaatcaagttgtaacactcgctgctgtggtccacagcttcattccttgaagcccgtgagacacgaacgcttccattgagaaaaaccttccatcagaagaagacttctcgtctcagtgggactgctgagttgaatggtgcttttttttctgaagctttggtagtgtaactgtaagagtcctggaattggaaaagcaaatccagaagttgagttccatgacttttttgctgtttgcctttggacttgcatcatttatatttttaattcatcgaggatgagaaaattgattaacacaaaatcttttcatgtcttttctgatgagagactagctgaatccaagaagagaagcccttgaagagtgtattctattctagacaagcattcacacattggcttctttggtgccagatcctggtcacagattttggtgtggatgtggtaaaaagggagcacttttacactgctggtggga

SEQ ID NO: 146005 - DNA, 726 bp, Homo sapiens
cctgccgatctctctttatttccctgcaaagctaacatctctactcctctgcaagatgacctcctcctgcatgcacacagcagccactggctcatagcagcccgagagcccccaaatccctctgaaaattgctgtgaaacagaggtttgcctctctttcctgagaaccagaatgagtcagaagcccagtacacatgggaacagttgagcctttggatcttctgtgcagtttctcctttctgataagttattcttttcttgcaaatgattctctcccagataacaatctgagcagggaggaaaagaagaaagggacaatttgtctattgagtcaaacttcaggcagcatttgatgtaccctagccttggaaaagggctaaaactgcatttagtttgtggcaaatgtgaattatcatctttctatgtcaagttgttcatgtcttttgataacatagcaggtgatacttactcagagtattaatcatggcatttaacctactctgaaagaaaaccaaaatacccttagggagagcttccattaccaggatatccaatattcattttgccctaagtgcaacctccaaagatgcagtcctatttaaataatcaattcttctcaatcaccccacccaacaatgactggaaattaccccaaagaaaagaagaatggaataatcaactttgaaagaaagccctttttatattaaaattggaactattttttctc

SEQ ID NO: 146006 - DNA, 297 bp, Homo sapiens
gagttgttataagaggtaaatatgaagtgttaagcatggtgcctggcatgtagtaagtgttccataaatgtcagctattttaattgtcatcgtgaagcagggccagcctttgtttatttacagagcaataatttgatgattattggaaaattctcctttcccaaggttttctaattataattccctaaattccacttataaatatccattactttggatttagactttctgtctttggggcctttttgttaatatgaagattaatcttttggaacaatgggtaataactgggagggg

SEQ ID NO: 146007 - DNA, 129 bp, Homo sapiens
tggagaattaatggtttttttttccccaagtacctttgtttttggtgtatgccatgtacgtgcaagggccttgtgcttttgaagatacagaaaatactttagatttgacagaaatctattttgaaatta

SEQ ID NO: 146008 - DNA, 429 bp, Homo sapiens
ttctgaatttatcttagagttgtgttacccatgttggtgtcaatagttgtttgttttttattaatatggaagtgacagataattaagaataaaaacaactgtgtatgcagtactgcttaaatgtgtgtcccagagttttaatatcattggcagcatgaaaagttcctgcatgccaaaagcctaagtttacataatagggagagaggacacacagaatagagagctgatttttccaccttaactggtaaccgatgttcttaaagactgtcagatttctctgaggctagcagaggccctaactccagcattgccatttgctttcatgatgggattgggtgctacagaaatgtgaggtggtagccttggccttctggcacagttaatatgccatttggagtggtgggtcagaacataagggtggtcagaaca

SEQ ID NO: 146009 - DNA, 446 bp, Homo sapiens
  misc_feature (34)..(34): n is a, c, g, or t
gtctgaggatccccgatgatgtccacgctcattngctttattattctctctttacatgggatattgggtgcaagtcgagttctgtggaccacgctttgggaagtgctgccagaaactatccaaaacagtaatctccagagcacttatgaggcagtcacagcttgaagtgtgacgcttagtgtgtcactgatgttggagctgggctctcaggctatgcttgcaggatggtccccacgtgcctgtggcaaggtctgtggtgaagcagagattatcaaggctttccagaggcagaggaggaacccagctgccctgcatcaccctggaggagtagggagtcagcagtcaaagccttgagataattggggaacacaggatgtgataaaaaccagaagtctgtgatgttgtttgttctctatgaggcatcagaggaggcttcatggagcggg

SEQ ID NO: 146010 - DNA, 726 bp, Homo sapiens
cttcataaaaagattctccaataatcctatttgggtatttttctttagtataaacaaaataaactacagtttcattaagtgtaggactaaattactctctttgtttctataatattgaaaggatctgaaactgcagatctgtgaataatttcaaaatttcaaaatattaggtatatatattctaaaactgtatatagactgagcaggctgttggtctaacgttcaggccaaagcacaacaatgaaccattctactagattaataaagttttttttttttttagctttaatcagatgtgtccaattataaaggtttgaaaacattaaggtcgaaaaccctaatctttttaaaattaataatagttgcttcacttgttaataattttgggataccacatgacagtaaataacagagaagaaaaattggtattaacattaattctagagctgctcaaagaaaatccaggaattggttgataatgttagtgttctttgaaactaagtttatttttagagcaataggatttgaaatagcattattcttttaaaataaaatgagaggttagacctggtatcgtggatcacgcctgtaatccctgtactttgggaggctgaggtaggaggattggttgagtccaagagttcaagaccagcttgggcaacatagagagaccctgtctctacaaataaaaaaattttttaattagctgggcgtagtggtatgtac

SEQ ID NO: 146011 - DNA, 306 bp, Homo sapiens
ctcaaccttcctccatctttcttcccaggtaggatagttgttattaccgttttaaacataaggaaacacactcagtgaagaactaacctcctcagtttcacacagccaacctggtacaagtctctgggcctcaggatattggttcctgtcaagtttgccatttcctatctgtgctaaggtggaagctgttctagtcactgggtatgccattcaggaaagtgcttctgattttctgattttcacagttctgactctttttttttttttaagacagagtctcactctgtcaccagactggagtgtagt

SEQ ID NO: 146012 - DNA, 274 bp, Homo sapiens
cctgctgagttgctccttcgctggaggggtacctccgagcagggcatctgcaggatggtgggcacacttgcctctcactcttggcggggccaggagtctctgttgccactgagtgacgttatgctgggaaatggaggcgtggtgtccgcttctctttccgtgatcctcatacccttcccaagacccccattttgttagtgaagaacttgacgcccagatccacctgccagcatgtgtggccttaggtatatctggcattcaggagccgatgaag

SEQ ID NO: 146013 - DNA, 695 bp, Homo sapiens
cttaatgtagatgatgggttgataggtgcagcaaaccaccatggcacatgtatacctatggaacaaacctgcacgttctgcacgtgtatgccagaacttgaagttaaaaaaaaaattataaagttctaaaactcagatggtttctatccaaaaaataacaagtttccacctaactttatagaagagaatgtttattgctatgtaacaaaaagattttcctaaaactgggcacttctgctttggacaggtaattttctttttttttttctttttctttttttttttttaaatggattcttgctctcttgccaggctggagtgcagtggcgtaatcttggctcactgcaacctccgcctcctgagttcaagtgattctcctgctcagcctcccgagtagctggaactgcaggtgcgtgtcaccacacccagttaatttttgcatttttagtagagacaggatttcaccatgttggccaggatggtcttgatctcttgacctcgtgataagcccatcttggcctcttaaagtgctgggattacaggcatgagccaccacaactggccagagaagtaattttcttattgtgcaaatacaggctatttgtggctcaataaataaaatgcttgataagcgctgttcccccactggaaaaaaaaatcttattacccagaagtgtgttgattggcaccataag

SEQ ID NO: 146014 - DNA, 306 bp, Homo sapiens
  misc_feature (286)..(286): n is a, c, g, or t
gatctagaggacccctgcggtctcataaaaccttttatctgaaacatttaatattaatctatcttttacaactagtgcaggctcaactgggtccctttataaattaacaaaataagctagtaaaagtatgttttatcaaattcctttataaccatattttcctaaataaaaaagtaaatagtgaactttttttaatagtttctaatcaatttcagtatctggttctcataggctgaaacaatgctacaatgacggggttgcacaacagtctatgagacccgcgagnattcccgggctcgaattcgt

SEQ ID NO: 146015 - DNA, 391 bp, Homo sapiens
cttctttagatagggtagttaaggaaggcttctctgagttggtggcatctggcataagccctgaagaatgagatggcgcatgtggcaatctggggtaatgatgttccaggcagtactgcaaatggccctgtggctggaatagacttggtttggtctaggaactttgggaagattagtgttctggaatgatgggcaagaaggcaagtaattagaagagataggcaggggttgattgtgttagccttgtagaccatggtaaagagattggcttttattttatttgcagttgaaagcctttggagtgttttcagccaggagagtaaactttttatactcagttcagaacaagtcaggtagaaataccattgacagtataacacttaggagatac

SEQ ID NO: 146016 - DNA, 390 bp, Homo sapiens
ccacagtgatagctccaccgctccgggctcatttatgtctttatgcacttagatttttttttaactctatgtattataatccagtattcttattctgttactcagatggtcgtagcttgggtcatgggaagctccggcagttggggtcctatgtcctttcatcatgttttcccaatttcttattttcagctaccacaggacactcagggtgcatctggaattttcttggctccagctctggagtcaggcacttgagggagcggtggagccaccgctcctgctgtaaaggtgtatctgctctaagcctcacttaaaagctatcacttggcagaagatcaagttaaaagtgcaggctagcaggtgatggtgagggtaggagagggtggggag

SEQ ID NO: 146017 - DNA, 236 bp, Homo sapiens
gtaacattaggcatataaagcagaaatcctgaagtcatcagagcttcaaaaagctattctacttgctacggagaactacaaaaacctacctttaaggaaatgcctattttctcttttttcagagtgtggtgacagtgacaaatactatatgtcagaagaatacgtaattgctttaaaaacctctaaacattagtatatgtcttagagaatttgttacatagttttattacctaacc

SEQ ID NO: 146018 - DNA, 379 bp, Homo sapiens
cctttgtcaaagtcagagctagatatttttccatatcagagacagtggctctgatacttaagacagccggaaacaaaagctgtagtaattaatgtcagtgaattcggatcaaagttgactaactaactaattgataaaagactgccatactaaaatacacaggaatttgcccagtataaaatacaaatcttaagacttctaagaggttaatacaacaatacttcacttatctaagatcatgaagaattaagttaatatgttaattttgtaaatgcagcaagcaaacatttttaatgaaacgtcctataaatttttcttaaggaattatttctatggcaattatatgatattatacttaagtgactacttggaagctact

SEQ ID NO: 146019 - DNA, 366 bp, Homo sapiens
gaaggtgctctagaggtcccggaagatcctggtggtgataattcctatggtcattcaaaagctggggaattggtgtagttgtcttaggcatgaataatggtgttgagcttacagggtgtcttcattcctaggagatgcctcaggctcagagaatttaagctacttggagagaccaggggcacacagctcatctgatgtagaactggtttataaaaactgtgataaacaaaacaacccaaaagtaggcacgggaccggaatggaaattctcctaagaagatagacaaaggtcaacacgcacgcaaaaagatgtccggcaccactaatcagcaaggaaatgcaaatcaaaaccacgaggtgctgcttc

SEQ ID NO: 146020 - DNA, 288 bp, Homo sapiens
caacccttgtggttctggctaattgaatgtttctgctgcttaagaagcagtacctctgaactgttgtcatagtaaggattggaggaggccaaatgacagcttaggctgcaacagagacatttcacacactgacaatggccaaccccacgaagccttgcaactaaagggcttccttaggcattattttttaaatgtcaaattaaagtgtgcattatgcctgggttctgtttgccacttttctcattagctggggcaacagttgcttgtggccagaagcacacaaacaca

SEQ ID NO: 146021 - DNA, 1234 bp, Homo sapiens
ctgggtactttccggcccctcctcccatggaagttgctgcactgatttggcctgtgcaaacaccaggcacttttcgctgggtcaatatttcacatccgttgtcagggtctaatccatcttcaacatctgttccctgggatgttgtgcactgctctgccacctatgacccctcatggtctttgtccccagaagaggatctctacaaggtccccagggctttctccagcttgaggctgctcggttcttctctttttttcctctttaaaccctctcacctttgcctgagccaataatctccctcaaattacagggagaagccccttctgtctggaagccttccctggctccagaacacagggacgtggtagctgctgttgtgtagaattcagcaaacctcacctgccagtgggtccagaacacgttctgacccagtgtcctgcttgccaccttgtacttcctgactgctgcttcctgctgtgagcctgctggagccctggggacacacatttacttgaataacatctcaaaatagactgggaagacaaaatgtactacaaggggccaggcaccgtggctcatgcctgtaatcctagcactttgaggggctgaagcaggcggattgcctgaactcaggagttcaagaccagcctgggcaacagggtgaaaccccgtctctactaaaatacaagaaattaggctgggcgaggtggtgggtgcctgtagtcccagctactcgggtggctgaggcaggagaattgcttgaaccaggaggtggagtttgcagtgagccaagatcatgccaaggcactccagcctgggcgacagagcaagactccatctccaaaacaaacaaacaaacaagaacccaaaatatactacaaggtgtaactagaaattgttttcaagattggtgcttttgcaccattgattagacgaggcaaccaagtgcatttattttgatgcatgcctgtcttgttcctctaatcaactcccaagaacagggacagactgggcatggtggctcatgcctgtaatcccagcactttgggaggccgaggcgggcagatcacctgaggtcaagggatcgagaccagcctgaccaacatggtgaaatcccgtttctattaaaaatacaaaaattagctgggcgtggtcgtgggtgcctgtaatcccagctacttgggaggctgaggcacgagaatcacttgaacccgggaagtggaggttacagtga

SEQ ID NO: 146022 - DNA, 213 bp, Homo sapiens
ggaagagtaaccagagctactgctggcctcagcacaggactccataaaggagaaagccattagtggatcccagcaggacaagacaagatgacacaggatgattctctcgctggtcaatggagggccattgaattggtcttaatctgcaaacttcatatttgatcattttcatgttttcccacactttaactaagggctcaccatacattttgg

SEQ ID NO: 146023 - DNA, 254 bp, Homo sapiens
cgggaagctgttgtgggaggattgcttgagtccaggaggttgagactggtgagccgtgattatgccactgcactccagcctgggcaacagagtgagagcctgtctaaaaaaaaaaaaaaaaagtttcctgaatgggcggcttctgacctgatgccagggtaacaagatagacaagatgtctttaataataaaaacacaggccaggcacagtggctcatgccggtaatcccagcatgttgggaggctgaggcagg

SEQ ID NO: 146024 - DNA, 316 bp, Homo sapiens
ctagcaagaataaataatagctatcactattattgaattacaaaaaaagactttagattaattccaaatgctaacgaactaaaatgaactcagtaccatctgtgcgttgagatgactcctacttgggtctgttttactcaaatactcaagcagtagcagagtaatgagcctaaagtagaaagatttagagttctgcacaaactatagaatcactacttattaagacagcagaggaggtcattcaacagtctgtggaagaagagcaagagtatcttaaccacctattcggcaattaatgtttctatatgaatgtcaa

SEQ ID NO: 146025 - DNA, 457 bp, Homo sapiens
ctgaggcaggagaatcgcttgaacccgggaaggggaggttgcagtgagccaagattgcgccattgcactccagcctgggcaacaagagcgaaactccatctcaaaaacaaaagaaaagtagaaagtccccacttggattcttgtatactcatataaacatataattagaagtgagcagggaggcagatgcataaggcaccttacctttgagtttcaccctcccttgcctaatcactgtgtctgagatatcacagtaaagcctgagagggagagaaagagaaaacatggattgagaagcagaagcttctcaagggcaatgggaagcattcagcggggtggagggttgatttttacataatgacatagtctgtgtctaagccgcctttatttcaaaggactttttgtaaccatcatctaatattttctaagtagcatcaatgtgaaagagtaggggaaa

SEQ ID NO: 146026 - DNA, 804 bp, Homo sapiens
ggaagctttttacttgtttccctctctgctatttgaaacattagcaacagacccctattacttttgtaattaaaggggagactcaaaacccaaaaataatctgtaggttaaagaagacagcttggagcacatgtggtctcaggaacttgtttggcctaattggctggatctgttacagcttaatgcagctccagttttgcttcttagcaaattgtccactctgcaagccaccagagtgtgtttcatggggaaaaatcaagcatctttagttgaggtcctgccaagtaatttaatgaacaataaataggaaatttcaaatttggaaggcactgtagagatcattatacccaaagctgtcaagcctcaaggagactgctctaatgtcaggatagtgccagtggaaccagcaggagagtccaagtgtcatcatagtccaccgccctgccagtgttttctgtctcctctgacaccatctttcttactgtaatggcagtcactgacatttgatttgggttcttttctattttcagtgttatgactttttgtaaaaactacagtttactgtttttgacagtgaaacctaattcttctctattgcattttccattttagcagctacttttacttctaaaagttatcaataagcaaggcaatttgaaaatctgtcctgagatttgctttctgaaagttatcttatgaaaggtaattcttcagcaatagactctaggagaaaagcaaggatcaatgatttcatggtgggcaagattactagtaactgctaattcattattcgatgataacttg

SEQ ID NO: 146027 - DNA, 152 bp, Homo sapiens
atggtctctatctcctgacctcgtgatccacccgtcttggcctcccaaagtgctgggattacaggcatgagccactagacataatgctattacacaggtaaatggtatgtttacagtatagtataaacataacttttatgtgcaataagaaa

SEQ ID NO: 146028 - DNA, 1087 bp, Homo sapiens
ccaagtttgataatttgctagaatgactcacagaacttaggaaagcactatatttactactacagtttttgtgtaaaggatacaacttgggaacagccaaatggaagagacacataggggaaggtatggaggacagagggtgcaaaactttcatgccctctctgtgccaccctcccagcacattaatgtgtttggaagccccttgagcttccaatgatcagacatgactcattaatcattaatcactagtcacttatttgaactcagtctccagttcttctccccttgtcagagatagtgagatgggctaaaagttttaatcctgtaaacacctagttggtttttctggtaaccagcctccatcctgaaggtacctagggtccctctctatctcccaacccctatgagtcacctcattaacataaactcaggcataattgaaagggatatattatgaagtataaaagacacctcctattaggaaattccaagggttttaggagctttcttccaggaaccaaggacaaagaataaatatattttttattataccacagaagagtaataagacgaacatatatacccagcatccaaattaagaaacataacataaaggtatcttttaagcctcttgtgttcctttgtgaatatatttcctctgcttcccagaggaaaccattatcttgaattttgtgttatctgttaccttgcttgtcttcagagtttattatagttttaacgctatctagcggtatatccgaaataaacctctttttgaccttaatataaacggagttgtagtgcatgtatgctttcagtggtttattttcttaataaatatagaacatatcatttgttagataattgtattgggccattcgtgactactttttttgtctttttgttttcttaagattttgttcttagctttgagaatttcatttctttaacatggactagtgatatattaggtaacatgtacttaacagaactgaaaatcatactttaaaattatttattctgaaagtgttcaaatatacacaaaagtaaagaattgtataatgaacccaacaacccaacacctcta

SEQ ID NO: 146029 - DNA, 662 bp, Homo sapiens
gacaaagggaaaaaagggcaagatttataatttattttactttcatgatttttccaagtgtcttcagaagtagaaacctatagcattaaaaaaaaaaatctacattaactatatatgagctgagagaatgagaaggtaaaaaacatggaggataagtttcctttgtacttacgaaatagtcccctttcttaggatagaagatagcaactgggtagcttctgaagcaccataaaaacagctagaaagaatgcttatttttgaggggatagtggacaaatgagcccttgttgctagagagacactgataaattatctgaatcctgtcaaaaaatactgtaatacctgtgttaggttctctcaggaaatagatgaatggccgatctgctttaaaaataggaatccgagaccttttcaataacaacagagctgcaggaaagaaagaaaaattccattgcattttctgtgcatttttaagaaaataactattggttatgaagtaagttaattttttaagaaatcaaagcatcctaatggcatttgattgtttactgttgtgatgggggtgcagatgggaaaattaaagagaaaagatgccatttagccaatcctgtctcctgttttcaacacattccatggaataaattccttattgaaggtaactt

SEQ ID NO: 146030 - DNA, 596 bp, Homo sapiens
gtctcattggcaggaccattcgatcatggtgattaatgcattaagctatcatttcttaacctggggcaattaaacatgtatctaagcaactcctctccttctaattccatgcacaccaaacaaccaacaggcttccaacagcgaggtctgtccacagaaatatattaaatagtcttgcgaatggcttgagtgttctagccttagtaatagttatttctcatggtaaagtaacaaaccaacaagttggtttcataacatcagtcaaatgagctttactcaagtcttaacttgtaaggatagtccttttcttgacgaatctacaaaatcagacttctaagcaaacaaggctctgaactagggtaaattcatcacaataggccacattacgatgctacccaggaaacagatccttctgtatcatggagctattcaagcttacattacagctcctgcatttttaaactttaaatgtctatggacatgttttcagagtatctggaatggaatcttaattccatttctattgcctttttctttcattcagtctctaactgtatttttatactgtatttatttttatatatttttgagactgt

SEQ ID NO: 146031 - DNA, 101 bp, Homo sapiens
  misc_feature (16)..(16): n is a, c, g, or t
ttttggatggtggggnaagttgtaaccttaagctgaaaaggaaaataaaaatttctcagtgtattggccaggtgccatggctcacacctgtaatcgcagca

SEQ ID NO: 146032 - DNA, 269 bp, Homo sapiens
cacaaattggtcattcgtcatattaattttcagtctacttcctagtctaatttttgatagctataccctaattgtctctataagaaaccttaaaaataattcttaacaataatcctaaacctacattctcataaacatggagtatttaaccattttaatccctgctatgagatagatggatatatcatctccttccttcattcattcattaatcaacccattcatttaaccagtatttactaagtaagtatctactatttgccactcac

SEQ ID NO: 146033 - DNA, 394 bp, Homo sapiens
atagcgtcaggtaggggaaatttcagattgactgcaactgactgatcttctagactaagggtatgcaaactttatgtgaagggccagataattttgttaggcttttgtggccatatggtttctgtacaactatctaactcagccatggcagtgcaaaaactagtcacagataacacatgaatgaatgaatgagtgtgtctgtgttccaatgaaactttgcttcattttgttatgttaatttgttctacaaaaactgggttgactgaatttggcccaccagctgcagtgtgtcaatccttttctaaactcaccaggtagattaatatccagtggcatttcccaatgaaaagaaaatttaagtacttgttggcatattcacccaaaatgctgatgt

SEQ ID NO: 146034 - DNA, 327 bp, Homo sapiens
atgtactttgtgcccagaggccatgtatttctgatggatttagaagtggattcccatttccttcagtgtttaaaacatagctctatgtatatgtacagtagcatcttctgagatttaatgtacagataggaagtacttacttgctaaagaagggttgatggacagataacaagggcaagcctcaaaggacatgggttatttgaagggtttatttataaacaagccggctcatgagtacggttcacttttaggacttgaaactcccttctgaacatgagtcttcacttgtggtctccttgctgatttttctgagttcctagatttgat

SEQ ID NO: 146035 - DNA, 731 bp, Homo sapiens
ggtttgaaggttcatttacagactgacttccctgctctctttctagcagtaggatcccatcccatcaaagaaccagctggtgccttcaaaccctggacgaacacagaccggcacaggctcattcatttcatccctgtcagagccccaactcctctctttacccacacatgagcctattatatttgaacggatgaggagccacagaggtgatccattagttcagctgagcttgaaattagtagctcatccccttaaatggtgtgggcagtttggctgagcttggactgcaaagctgttcccccttggattgcacccagcatggaaatgaggacacacctaatattttttccttttgacacttgattaatagttgacaaatccaaacccaagtagttagctttcctattatccatcttttgacaggcattgctggttttctttttgagtcccattgttctaaaaatacactcagatctggagctgttcactgtgcatatataggcctgatttcatggtgtcaaagataagagacatctggcaggcagattacaaacaaagtgggttgctgggtttcagaactgaaggcagggacctctgggctacttaaatctacttaaattcagtgctgccaattctgtcccttcttccttggtgttgtcatgtcactgataacctgccagggtcaaccatcttaccacccggtaggaaagccaagcgtggggtgtgtgtgc

SEQ ID NO: 146036 - DNA, 584 bp, Homo sapiens
ttcccacccccacctttgacttctatgaagtccaaggaagtttgattcttttatctgaggctcaactccatagagcacagtacccagaataaggtaggtgcttaatgatgtttaccatttgaatgagtttcctggaagtacttagcagatcaggaattctgatgcataagcacaattcaaaggtggctgaggagtgacatcagagaacatagtggcataggaactccaagggccacctctgcacagagacaatgtgcttgtaaaacatcactataaaaaaaaatcccttggctgggcatggtggctcatgcctgtaatcccagcactttgggaggccgaggtggggggatcacctgaggtcaggagttcgagaccagactgatcaacatggagaatcccagtctctactaaatatacaaaattagctgggtgtggtggctcgcgcctgtagtcccagctactcgggaggtgaggaaggagaatcgcttgaacccgggaggcagaggttgcagttagccgggatcatgccattgcactccaccctgggcaacaagagcaaaactccatcaaaaaaaaaaaaaaaa

SEQ ID NO: 146037 - DNA, 457 bp, Homo sapiens
gtctgttttcttgctgtgtcctcacatggtgaagagcaaagaaagagtggaagcaagctgtctagggtctcttgttgtaaaggcactaatcccatgcagggcttcacccttattatttaatcaccccccaaaggccccacctactaatatcatgtcattggagattaaggcttcaatatatgaattctggtgcggagggaggggggaccacaaacatgcagtctataaaatgctttttaattttttgagacaggatcttgctctgttgcccaggctgcagtgcagtggcatgatcttggtttactgcaacatctacctcttggacccaagtgatcctcccacctcagtctcctgagtagctggaactacgggcacaccccatcacactcagctaatttttaaattttttgtagagaagaggtctcactatattgcctaggctagtctccaactcttg

SEQ ID NO: 146038 - DNA, 447 bp, Homo sapiens
gcaggagaatcgcttgaatctgggaggcggaggttgtagtgagtcgagattgcgccactgccctccagcctgggcgacacagtgagactccatttcaaaaacaaaaacaaaacaaacataggttattctcttacagttgaagaggtcagaaacccaggatgatccacctgtcaggggtcagcacctggaccctcaactgccactgtaagctcctctcggtacatgctcacaggttctggggttagaacacagacagctttaggggccgtgattctgccgactgcagcggaccgggggccgagaatctgagggagtgcccacaacccacctccagatcctcctccactgtctccaggtatttccttgcgtctctctccatcctcccttccatctcattttaatgcatttcagggaagttgtggatggtaggacggttcccctaaatac

SEQ ID NO: 146039 - DNA, 720 bp, Homo sapiens
gttatcaggggttgggattctgtcccaagggccctttgcgccgtcagggcggtctcatttccagtggccaagcttgtggcagagaggcaagccattagaggctttttcccatttatcccattagggcactttgccttccagtggcctggcttcccacaccaatggcagttacctggaggagtgcccttagggcaacctggagggagttggtgggcttgcagagcagccagtacttgagcccacctcctttctctgtgtttctcctttttcttagccttgtcctccttattctgctgtcagttataaaagactgaggaggctaatctgaggacctcctgcacaggggtactgagttctaaggctgacttttgcaatttcctcccagttcattcttaagccaaatagtattacaaaggaaaactagttttttgttttaaggtttgggggaatcagacttttcccagtttgagggggcgcctccaaggagcatgatctttaatttggagatgctattacccatctgcaaaaggcaaacagaggagaaaaaggggggtaaaatttttcctccactttcctattattctgaatgaggcatcctccattgtccttagggttccagaataaaccagtcttaccatgtacccttggtccatctcatcacaattacccacttgaaaacagaagagatactggagtgaaaagtgggccctctgttcgtcc

SEQ ID NO: 146040 - DNA, 421 bp, Homo sapiens
gtgtgccttctctccttgggtgtcctgatgggcctgagcaagggaggccatggtcatccccctacaccccccgacctgccgtccagcatcgatcccagcctggccccgctccggtctgtgacttgcctagaaccagcgccttccgtgtgtcctgttggcttcgttgctatcaccggctttttttggattatttccgtggctggcttggttttccttttcctttccttcgctgttcggtgatgcgctcatttaatttctgtttaaattttgtgtgtctctctttctctcccctggcttgttccttgtctgtccacgctgtcgctgactctgtcttcgctgctcattccctgctgcctctagtattcatcaggtgcaaactgcggacctgcggcgagtgtctgctccccccggctccttcacc

SEQ ID NO: 146041 - DNA, 730 bp, Homo sapiens
ggagattgttctcaaaccctgtcctcaaccgactaaaattgggggtttcatagcagggaagaaatataaccacgtgtgggaaagcaggaattaggagggctaagaaaaaagagttggtcagcaagaagctggtggtcccagaggcaggcatgatgggtgaggggtctagggtctcactgtccagatgctgtgatctagtgagtctctgttccttgatactatttaggaggactgctggttggtttcctgaggaaggagctcagataagacaaatgtaacgttcccaagttttaaagaatggaagggtcaatttctatgtttatttaaaagaaaccatagacatcagttctatgggacaattgggcccgtttcaacacccttcccccccattcgtcaattcctcaatcatgaggaatcaggccacgcatccgtctcgctgcttcatgctgaggaggggcgtcgtgggcagctgcacaccatgggtgtccctgcggcttcccaagaatcaaaggttaatctgatactagagtttttttctaaaatgcaatctttctttccaatcccccacttccaccaaaggcaaatcacagcaagaacaacctacctgcaaaataagcttcagtggcctgattacccacacaaagtgcagaaagaattattgtccttttttttcttttgaggcagggtcccactctgtcacctaggctgcagtgcagtggtataatcatgg

SEQ ID NO: 146042 - DNA, 463 bp, Homo sapiens
aaaaacagctggatatggtggcacacatctgtatcacctgagcctgggaggcagaagtggcagtgagccaagatcatgccacttcactccagcctcggcaacagagtgagataaaaaaaaggaatggaacctgggtcataccgtgtctgcagccagagtgacgagagtagggaacagcacatgctaattgccaaacaaagaaacctgccacttttcaatttggcttttgggcaaagctggctctgtgagtatctgtgtgccagaccagtgttcatccttagccatttatcaaacccctgacgagtgctggaacatcagagctctgagaggtaaatacagcaccccacaaaaccctccactccaagcccacagggctgtcaaggaaggacctctgaagtcaggcagactgagttcaaatcctgactctcctaggagagtcatggcctcccagcttggccagcaa

SEQ ID NO: 146043 - DNA, 357 bp, Homo sapiens
tgctacaggaaccccttcaacataaagaacggtatgaaaatattgtacaaaaatatgattcaaaaatcctaaatgaaattcacattatcatttacatgtaagggcagaagaaaatttttgaatatgcatgcatttataaatatatccccatgtactcttttgcagaaaactaaaagaacatagaactagaatttacacatcaaaatagaaaaagatgacctgaagataaaagagatgataggatttttttttttttttttttttttttgaggcagagtctcgctctgtcacccaggcttgagtgcaatggtgggatcttggcttatggctcactgcaacctctgcttcccgggttca

SEQ ID NO: 146044 - DNA, 476 bp, Homo sapiens
gcgtgtgtggggcagggtgggggtgggggaagttctgctctgcctcccctccgtttcagaggtcctagaagcccagattaaacagtcactagagagtctgcggttattttttcttggagaataataggccccgccactgggcctccagagaaagtgaattgaggctcagtggttggcagttatctccgccaggtctccaagtccctgactttctatcacaagagaggaactagaacatagtgcagagcaagcttacaagagttcaaatcccgtctgtgccactgacttagctatgtggcctcaggtgaagtacctgatttctcaagtgcctcagcctcctcatctgtaaaatgggggagggaggggtagtaatagtacccacaccataggcacagagccatcctatgaaagcccttggcattttgccccatgctatgtttgtgtttagggagttcagggattcttgataggattga

SEQ ID NO: 146045 - DNA, 683 bp, Homo sapiens
tgaattatgagaatgagaaaatgaatagttatcagtgcactgagatttacgtaactacctttccttggtggtggcttttggtatacaggagatgaaatacaaacctacttctaactattaactaagataagagccagtttgcccaggacagttttggtatactgctgtttttagagaataactattaagagcttcttctttaagttaataaattggatttggaagataaattatatagtcaacctacttggaaccatccttactaacagtactcttactctgtacgttctaataatagaagaatttgtagaatggaaatcttactgtgggatccccaaagaaagcttcccttcctctagcaaaaaactactttttgtagtagtagagaagaacaagtgtataaataatattaatttactaagctatacttttttattgaggtgaaatttacataacaaaattaaccatttaaaaatgtacaacttaattgcatttagaacacattattgtgcaaccattacctttaattccaaaagttttttactaaaagccataagctctttactcactaagcagtcattccttgtacctgtctcccaacccctggcagccactaatctgctttctgtccctatgaattaaaattgtgtactttaaaccatataataaaaatactgcagatc

SEQ ID NO: 146046 - DNA, 204 bp, Homo sapiens
agccaagaaattgccccagatttagagggtttctatagtgtatcacattatactaaaggggaaaaaaaaagcaatgataaaaattctgttaatcagattaagcacttatattagtaaataatttcatgtatacaaaatatcacaactgcttattccttatctgtgaagacatgggagaaattaatatctccctttagtaaatga

SEQ ID NO: 146047 - DNA, 338 bp, Homo sapiens
tctaaccccagagcctgcctgctagtcagtgtctgatctttcccttggtcacactgtctagctaaagaggccatctagctcattccagacaaatgaaagtccttaggatatgattctgcacagaattgcatcttacaaatgttaccattagactgaaccgttcttatttttctaaagagctcatgatacaggaatgagattttagactgtgtaataatttcctgtcactttttttttcaatttgatactctacttcaaatggtaacagaatgaaagtgccagtgttcattattatcccatttatttatcccacaaacattccatgagccctatactat

SEQ ID NO: 146048 - DNA, 288 bp, Homo sapiens
atctgcaacttgctgttcttaaattcatattatcacacatatttctctatgcctgaaacctagtcgacttcattgtattttaaatggctgcatagtattgcattgtgtggtcatattataacatttgtttacctgcagctattacgtggaaaccttcaggagcagtttcacagacatacttgtctacgttataacctagaagtatactgtaaagtcattttctgaaattagaagtggagataatgtcactaatactttccagtttttttgtaaaagtaacttgcgctg

SEQ ID NO: 146049 - DNA, 543 bp, Homo sapiens
tccctctgcttcaaagttttctatatttttcttctactgagaaaatctacaattcttaagatagtattccaggctctacgtatgacccaaatctaccaatattccagaattatcttctactatatatcctcccacaataccctgagttctacaagtagctctgtttcattaacattcaacattaccctgtaatctttacttatactattcattttagtttctttcacaaatcttgaaccaaatccagccctataaaaagccaagttcaaaatccccctcattccaagaccttccataactaccctggccagaagttctttcctctcttctgcaagactatagtgccctaatagcactagtcatattctgtattagaaagtatgtgcatgtacaacctagattatcaagtcattgaaaacttaaatcgaccaggcacggtggctcacgcctataatcccagcactttgggaggccaaggcgcgaggatcacctgaggtcaggagtttgagactagcctgatcaataaggagaaatcctgtctct

SEQ ID NO: 146050 - DNA, 247 bp, Homo sapiens
ggaggatctgctatgggatgtgtggggaaagcccctggcaccactttccatgccatccgctcagggactgggaaacagctacatgtcttccttgtggtcctaccattgagagtcctccccttcccacatactgactgataccccgaggcagtgccgtggtgctctagggagtgtcaggctaggagagggggcttgccctggggtatctgagctgtgtctggatgcctccgaggggtgggcgtgatcc

SEQ ID NO: 146051 - DNA, 259 bp, Homo sapiens
cggccgaataaagagaaagaggaaggtcactttaccactgtaggctcagtattctcttactttggagatttaatctgtccttgattcttttccccatccttggccaccggcccattagaagcctcatctcatgatactgtaaaaatattttctcatcttttttgttaaattaagctaaaacagttaagtgaccacgtacaacaaaagataaaggaaaagtctttggtgaaagttatcccttccttctttctctttcttt

SEQ ID NO: 146052 - DNA, 523 bp, Homo sapiens
aaagaaagaaagaaagaaagaaagaaagaaagaaaggggagggaaggagggaaggaaggaagaaaggaagaaggaaggaaagaaggaaggaagaaggaaggaaggaaggaaggaaggaaaggaaggaaggaaggaaagaaggaaggaaggaaatgctggtgccaaattggtatcatccccagagagcaagtcacacctttagtcatgccttttgcctggacagaagaagcaattctctatctttgtggtacctgggcttattagaacccgtgctcctagagattaattatacaagtttgtttgctatataatagattctcttactttggagatttaatctgtccttgattcttttccccatccttggccaccggcccattagaagcctcatctcatgatactgtaaaaatattttctcatcttttttgttaaattaagctaaaacagttaagtgaccacgtacaacaaaagataaaggaaaagtctttggtgaaagttatcccttccttctttctctttcttt

SEQ ID NO: 146053 - DNA, 712 bp, Homo sapiens
ggggcgggcggggagatgggtactcctagcctgcgcctttaagaagggtaggcctcgactttgacgtctctgccttccccgcccttcaggcccccactggtcgcgtccggcgctggaggagcccagtcagccggcgcctgccgggttagcacgtggactccgaggggccaactatcagctttccctgacaaaatgcctttgagctcccccacagctctgaaactccagcttgggagcagggagagtgcaatctgtgacctgtaaaggggcgctgggcaaaagggcccgagagaaggcgtcctttccattcccttcccatctcaagctgagttcagaaatgacacgaaataatttaatcaactatcagtcaaggtcgggctcacgcctgtaatcccagcagtttgggaggccgaggtgggcggatcacctgaggacaggagttcgagaccagcctgaccaacatgacgaagccccgtctctactaaaaatacaaaaattagccagcggtggtggtgcgcacctgtagtctcagctacttgggaggctgaggccagagaatcgcttgagcccgcgaggtcgaggctgcagtgagccgagatcacaccactgcactccaacctggatgacagagggagactctgtctcaaaaaataataaataaataaataaataaataaactatcggtcaaggtgaaagcctactctccgccaa

SEQ ID NO: 146054 - DNA, 645 bp, Homo sapiens
ggcgagttccatgcctgtccagcgctgagagctgccggccaacttcgcggtctccacgtcgcgcttaacgtggcagcagcacgcacttccagcatctttttttagacagcatctttttcagcctcgctctgtcgccgaggctggagggcagtggcgcgatctaggctcactgcagccttgacctcccgggttcaagagaatcgcttgaacccggccggcggaggttgcagtgagccgagatcgcaccactgcattccagcctgggcaacagagtaacactccgtctcaaaaaaaaaggccgggcgcagtggcttacgcctgtaatcccagcctttttggaggccgaggcgggcggatcaccagaggacaggagttcgagaccagcctgaccaacatgacgaagccccgtctctactaaaaatacaaaaattagccagcggtggtggtgcgcacctgtagtctcagctacttgggaggctgaggccagagaatcgcttgagcccgcgaggtcgaggctgcagtgagccgagatcacaccactgcactccaacctggatgacagagggagactctgtctcaaaaaataataaataaataaataaataaataaactatcggtcaaggtgaaagcctactctccgccaa

SEQ ID NO: 146055 - DNA, 827 bp, Homo sapiens
agatcccaccttcgcgtgaccttgggcaaatcacaacctcgcctaaggcccggaatgactctgcgcggagaggaagagcactgagtgcgggagggcatcgacgttttggtgttggttgctctcgtatcgtgatttcttctgagtctcaaaactctttgcagtaggttattgttgaaatagattaccacaggccgggcgcggtggctcacgcctgtaatccagcactttaggaggccgaggcgggcggatcacttgaagtcaggagttcgagaccagcctggccaacatggtgaaaccccgtctctactaaaaatacaaaagtagccgggcatgatggctggcgcctgtaatcccagctactcgggaggctgaggcaggagaatcgcttgaacccggccggcggaggttgcagtgagccgagatcgcaccactgcattccagcctgggcaacagagtaacactccgtctcaaaaaaaaaggccgggcgcagtggcttacgcctgtaatcccagcctttttggaggccgaggcgggcggatcaccagaggacaggagttcgagaccagcctgaccaacatgacgaagccccgtctctactaaaaatacaaaaattagccagcggtggtggtgcgcacctgtagtctcagctacttgggaggctgaggccagagaatcgcttgagcccgcgaggtcgaggctgcagtgagccgagatcacaccactgcactccaacctggatgacagagggagactctgtctcaaaaaataataaataaataaataaataaataaactatcggtcaaggtgaaagcctactctccgccaa

SEQ ID NO: 146056 - DNA, 623 bp, Homo sapiens
cttatgccactgattggacatcctaatgtggtcccatgtcagatgtgggctgtgaccctttgcagccgttttacaattcccgttattttagattctcacactgaaaggaaggtgatagtgggacaagttagatggctgggagaaataactcacttataactatctggctgtttgcaaataccaactaatatacaaatcctgtctggctcgtgtggactgcccacctgtgtgttgtatggcctgccaattcccgcatggcgggtggtggtctctgggattacaggtgtgagccaccgcgccaggccattttggtttttaaataccaaaaatttgaaatgaactagggctcctggaagtaatggttgattccaggactggggcaggaaaagtacaagatgagcctggaacatattgctgtatttaaagcaaggaacagctgaaaatgaaaggggtatgagttttccaaggtcaaagaagccagcttgaaagggcacccactggccttattttggacaatttgaacatcaaaaagaacaatgacagtattagattataacacatttcattttctgaaattccatgagtccataataatactaagaaaatacaaaagcaaaaaaaaa

SEQ ID NO: 146057 - DNA, 424 bp, Homo sapiens
tacaagcaaacttcactatgacaaacctttcgtttgtcaagagccacatgttggctcggcctcccgaagtgcctgggattacaggtgtgagccaccgcgccaggccattttggtttttaaataccaaaaatttgaaatgaactagggctcctggaagtaatggttgattccaggactggggcaggaaaagtacaagatgagcctggaacatattgctgtatttaaagcaaggaacagctgaaaatgaaaggggtatgagttttccaaggtcaaagaagccagcttgaaagggcacccactggccttattttggacaatttgaacatcaaaaagaacaatgacagtattagattataacacatttcattttctgaaattccatgagtccataataatactaagaaaatacaaaagcaaaaaaaaa

SEQ ID NO: 146058 - DNA, 442 bp, Homo sapiens
cctgggccctgcaaagtaagaattgagttggctcaatagaaattcagaatagtaggcatggcagtgcaggtaaaggggttagatctgacggtaataattgagtgatttctgatttaataattgagggatttcagattgatagtctgattacactgcagtagtggaagtaagatttaaaagtaaaaacattttaatttgggataaaattcagaacacaagtttctcaatatgccatgaaatctaagaaaatgtcctgcaatcattcaagaatgcagttttcatttcagggttagaaagcaggagaggaggtagataaaaaatccttagtaacatttttttctggtgctgcataacgtataattgggaaacttcttctagggtaattaataaattgctgctgtctcagtgggatgagctaactggaagctgtcaggtgggaatg

SEQ ID NO: 146059 - DNA, 447 bp, Homo sapiens
ctccccagtgtactttgtaagaaggtctctagatcattatggctgtctcacaaaataatgggctgctctgaaaacttgggagcttcctgtccctgtatgaatcacaaggctgttaagtgaccgtgggcaaagagcttcatacataaagagtgctggatgcttattagatgaattaataatattgtatgataaagccctgcaaagagagctctgagtcttttcccctcttaaaatgctatgatttgattctttcttcttaagcattacttgctttaggatgcaggcccgatacaatcattcaacagtccgtacagagtatttactacatgccatgccaggtactatgctaggtgttaaagataccgtggtaaacaaaactaggtgcctgtctcacagatctacattctagcaggggagccaaagaataaaccaataaatgtatacaca

SEQ ID NO: 146060 - DNA, 363 bp, Homo sapiens
gagagaggagaaaggaggaggagggaaaaggagaaggaggagggaggaggaggatgaggaagagaagagggggaggagggggaattgtatctccactaggaaatcaggtagagattgctgaattcagctttgtatctcaggccttgagtacattgtcaaggttggtccccactccaagtcacaattcattcctacttctcccaaactcctaaagcactttgtagggcagaaactgggccttgctgcactctatcagcactgcccctctattattgaaagaagacagaaagaaggagatcctgaaggcctttgtataataggtaaaaatcttttgactcttcagccaatcactgctccatttgg

SEQ ID NO: 146061 - DNA, 456 bp, Homo sapiens
ctccacagagggaagctcatggcccaagggctgaacaaaattgagttctttctctggggtcgcactgcattacatgtgcccaggacttcgaactgctgtgaccccctcaccccaggactgagggagcccctcaccccatgaccgagtgaacccctcatccccctgaaccaggtgagcccctcaccccaggactcagggagcccctcactttgtcctctcacatggtatccatcagtctagcccaacattgctgattctgtgagggtctcctccagccttctgaggtctctggcccaggccacgccccctcctgtctgtgcccctagtaggggcatcctgtgtcctccatggacaaagctgcccatacgtctgcatccttcaggagaccccgcggccttcccaacccctggggctgctgagctctccccctgcccacacctcgcacccaagcggccg

SEQ ID NO: 146062 - DNA, 431 bp, Homo sapiens
ctccacagagggaagctcatggcccaagggctgaacaaaattgagttctttctctggggtcgcactgcattacatgtgcccaggacttcgaactgctgtgaccccctcaccccaggactgagggagcccctcaccccatgaccgagtgaacccctcatccccctgaaccaggtgagcccctcaccccaggactcagggagcccctcactttgtcctctcacatggtatccatcagtctagcccaacattgctgattctgtgagggtctcctccagccttctgaggtctctggcccaggccacgccccctcctgtctgtgcccctagtaggggcatcctgtgtcctccatggacaaagctgcccatacgtctgcatccttcaggagaccccgcggccttcccatgccactaattggatgaaatagcactgta

SEQ ID NO: 146063 - DNA, 202 bp, Homo sapiens
ttggaggtttatccaaacctctgtggaacctatttatgctttcagccggtagctccttttacaggctcttgagtgttgtggttcagagtccaggccctggagctgaactgtcagagttcaatgcttgctattagccgtgtggccctagacaagctactttacctctccgtgccttggcttctttatttttaaaatgagtata

SEQ ID NO: 146064 - DNA, 155 bp, Homo sapiens
cgttgcctgctcttctccaggaagctgactgtggcctcaccagacccccactcccacttgtcggatcccaatccccaggacaatgcccagtcaggttccaccacgggctgctggctgcagggagtggactgcagctctgcctccacagggaagtg

SEQ ID NO: 146065 - DNA, 133 bp, Homo sapiens
gtttctcaaattaatgccactttaaaattttcaatgagccagactttaactgataactctaaactaaatcacacatgtagaactacaaaccgctgtatctgctatttacttgttcataagccccacaccttgt

SEQ ID NO: 146066 - DNA, 412 bp, Homo sapiens
atttctcacccaacctccttgcccttggctgaatcatccaatcctgaacttccatggagaagagagaagtccatggacagggattttcctcatcagctgctcctgaccacagtattggggtttgagtgctcaaggtgcccctaaggaaccatcccaagggtattttccctagaggtctcttaagagttgggtgaaatttaagaagagcaagctgccttccatctgctatccccggggtcatgtgcccccagatggtgcaggatgagtgggggcaaagggcaagggggaagtatgtcaactggaacatcacagaagtctaaataaggactgttctgtttgccatccatctcttaattttttgatctcactaaaggaatacaaccctataataaacactccagccttacataaa

SEQ ID NO: 146067 - DNA, 968 bp, Homo sapiens
taggatccataatcatctccattttgtaggtagggaacttgtagcttagagggattaggtaacttgtccctggtcatctgaccctagagcccacaccactaacccctgtggccttcgccatggccatggttcaccagttggttaaaaactcggagagggggccgagctcagtggctcatgcctgtaatcctagcactttgggaggtcaagacgggcggatcacctgaggtcaggagtttgagaccagtctggccaacacagtgaaaccccgtctctactaaaaatacaaaaaattagctgggcatggtggcaggcacctgtagtcccagctacttggaagctgaggcaagagaatcatttgagcccgagaagtggaggctgcaatgagccaagatcgtgccactgctctccagcctgggtgacagagcgagactccaactcaaaaaaaaaaaaactctggctgggcatggtggcttatgcctgtaatcccagcacttttggaggctgaggcaggaggatcgcttgaagccaggagttcaagaccagcctgggcaacaaagtgagaccttgtctctaccaaaaaaaaaaaaattccgggcttgggggccttccccgtataatcccccgcccttttggaaggggctggacgatacggacggtgatcctttgaccccacgggctgtttgacgtcgtaatggaccttttgttggctcccctggccctccaggccttcgcaaacaggaccctacggcctgtcccgaaacatcaccaaccagagctctccccaggcacccaattttttggccctcctcgaacacgcggcgtcggtacactcggctatcacgccgttccccgccggcgccacaatcacgttctaggggggggggagccccgatactcaccctctcccgcacttttccctgttgtttgcccccccccgcgtcatggcccaggccagtccctcgctc

SEQ ID NO: 146068 - DNA, 291 bp, Homo sapiens
atgggtgggcgcggccctgtgggatggtgctctgtggcagggctggcagtttctgggtgtgtggcctgtgggtagcctttgtactgggcgcacagtccccggctcctcccttccaacaccttcgccctgagcggcctcggaaatggggcttctggcggctctgcaggcaccgtcagagtcagagggagggcgagcggcttttggtttctgtttaaacagcgtcctgtcgctccctcctctcctgtgcggattggcgctgcggcttctgtgttgagagggaaacttgaaacc

SEQ ID NO: 146069 - DNA, 544 bp, Homo sapiens
agaaacatctgtttccacttactttctcatggaaaccacggtcattgagtggacagtttcattgttccttggcagaagaaggtagaacttcttcctttcattttaaaaatagataaacataaaactttgaaacccaaataaaatatgacagggcacttctagtaactgagcttggttagcaagctcatgaacagaataataacacgcacatattattgcacttacatgtgccagccacacttattcttttcccatgaaatgaccccattagggaatgaggaaatggaggtgtaatttaattaattaaatagctaaagttgctcagctaacaagtgacagaaccaggatttgaaccctggaagtcttaactccagagtccatgtccttaacctctacattatatcatacagattgtcagagcacatggaaactagtgagatgacggctcatcttttttttcacgggcgtaggacagcctagtattaatttgtgtttgtgtctaattttagaagacagcagccttgtccagtttcttggaagttaa

SEQ ID NO: 146070 - DNA, 734 bp, Homo sapiens
ttgttgttgggccaactgatacctcgaaaaaagaatggactaatcccaggtaccaatgcttgttaaccagtggcaaagccagtactggaatataggtattttcatttcccaactaatgtgcttcctgcctcatggtgtctccttaatctgtcctatattcaaacgattgtaatttctttatccagtcacagtggggtttttctcatagaagaggtctgacctttacatttctttacagggaggtgtgtgtacatagagaatgccaagatggtagttgtttgtttgtatgttctcttacattacttgcagttgaagcaggtaaggtgactacttaacaagtcttcattcaaaaacctgtaatttgagaagcttgctccatattagtggaaaatgcacttttcatcatggggcctaaatctcttgatgcttatcattttttttggaatagtttactatttacttaattttgctatttttgtagatttagttgtaaggtctcaaagtacataactctgttttttactccattatctcaaaatcctgtaaaacattcagtaatttggtcaaactgcctcagttcagatattgatctgccacctgctagcagtatgactttggaggcagtgttaacctcttgttacttcagtttccccctctgtaaaatgagttgtgatgattgaatatattatataaatctaatgctttgaagtacctggtacaaacataataagtct

SEQ ID NO: 146071 - DNA, 132 bp, Homo sapiens
atcaacttgacattttactatccacaagaattttacataatctgcacaactgattttttttggactctcatctcccacattactttttttaaatgttaaaacaaaactagatccccaggcatccactcctag

SEQ ID NO: 146072 - DNA, 593 bp, Homo sapiens
aagagagaacatagccccaccacatttaacagactggtgaaaacagaggagcccgcaaggaagcaaaacgtagaggaaatgtcaggggatagcagactcacagaaactaaggggagggtgtgctcacagaaggcaggcagggtcaccacagccgatttttgccaagatgaccaataagatgagcaccaaaaagagcccactgagccaggcttctcactggcagaggaaggagttataaagaaagcaagggggggatggtgagaatgaaccctctggtactagactagtgtcagagtatcagtatgaactcatgcttatttttacacaccattctccaatgaaaagaaccagtgactctagaggaagagctaattctagggctggtgcagggagaatacatgagcctggaatatcttgcagtgccagaaagtaagaaggtgttggagaaaaaaaaagagtaaagaacacaggagccaacctgaaagataaacgctgatggccaaggctaaaacaacttgagcaaaaaaaaattgattacaataatgttggggtatgcccaactaataaatattcatgagtcacacggaaataaa

SEQ ID NO: 146073 - DNA, 308 bp, Homo sapiens
atcccccatgtgtggaggaggaaggttgagacagacagcactgggggcctagactttattcccaagaagttctcaggatgctatgctttccaaacatttatttcaagattccacagtcatcaaacttaccctctgtctagactcacttccttccacaaagcaattctgctgctagaactgaactagcaacagcagaataggagcatgcctctctggtgggagaagtatgtactgcctgggccacccctaatgtctctctgtaaggtaggcctgtagcacctgttgtaacaaacatgtagtggctgggc

SEQ ID NO: 146074 - DNA, 336 bp, Homo sapiens
aaaaaactacaggagaaaaaacattaattgtcatttgaatgtcacatgagcctatggaagcagctgtaagtaaaaactgattgttagttactatttccagaatggatttctcacaatcaagaattagctcagcaatccattgttgaatgtacactatgagcaaggcaagaacagcagcaaatttggtgcccaacattgtagaatcactggggaagggaattagatagagtcccactaaccaggatgaaaaatggcgaggaaaatcacacaaaagcacagaggctgacttagagaggtcagccaggtagtctagaagcagtccatccaggtatactc

SEQ ID NO: 146075 - DNA, 237 bp, Homo sapiens
aatcccttttatcatgttttcaccaaaagccccctaaatgcatttatttgtgttcccattttcacttgctaaatattaggtcagaacttctggtcaaggctctcaaagtgaccagaaagggtttattacatttcagccacaagcaaggaaacctgatttactcgatcttatcataagcataacttcctagattaggtgtgtgggatgtttttgtgtgtgtgtgggtttttttttttt

SEQ ID NO: 146076 - DNA, 479 bp, Homo sapiens
catgatgactcattcattcagctatttttttattgagtacccactatgtgccaggcacagttctggatgtcagggatacagtgggtgcatatgacaaagcccctgccccatggaactgagatgccattttgggttgcagctggtgtgctgatgtcaggagcttgcattttggagcatctaccccaggtaccacacgtaggctcagctcccatgtaactcgtctcctttgccctcccagcagaactgtagagtatgttccaatattgtccctctttataaggagctgaagagatggaggttcagaaaagttcagtgagttttccaaggtcaacagctaagaagtggcagaatcaagagtcagtcttagatcttttgccccaaattctgtgttcttgctcatatagttctggatattttacctcatagtcactcataccttaccggggaccagcaggtcccagccccgtcaaatgaagaat

SEQ ID NO: 146077 - DNA, 634 bp, Homo sapiens
cagtggctggactggagatgtctgaggaggctgtttggaagctacaggaagcagtggctggagatgacacttctgaggaggtggttggaagctacaggaagcagtgggataaaggagggggtgatcttcatcctgagcatgcttgccaaacacactcatgcccattgcacacgctgagatgtgcacccagctctcttctccagagaggtccacatggcacacatgtgaatggcccaaacttctggacgtgtggtcctctgtgcccaaagcctccggggtacctagggaaacacgctggctgccttatgagcacgtgaaagaagcccaggtgccagacctgagcactgagcagttcttggcactcatgctgctcatggggattgtgtacagagagcagactgggctggaggaccagcaggtgcacacagaggccacctcaaagggacatggcagcagtactgtgggtcccttgctctccctatgagtgaatgcagctttgggcagcgtgactgagtccacccaaatctaagcacatctggtgagattgctggggagccagtcacggaacacagactctgacgtctcctgagtcggcagagattcaggctcagacatctccagtcctcagcacccc

SEQ ID NO: 146078 - DNA, 165 bp, Homo sapiens
ccttggcttgggatgagggtatcagggaagccaggggagccaagacaaaacagttaaaatgttaaagtaattcattctggggaaactcagagtctgttctagatcctagtctcccaactcaattattagttggaactgagatgcctcacagtggttctcaaaaag

SEQ ID NO: 146079 - DNA, 158 bp, Homo sapiens
aaggggatggagctggaagcaggaaactagttagaatcctgttgtaatcactctgatgggctgaaaagagtggagatggagaccagggaacatttgagggaaatgttttgaagtacaaccaaagggatctggcaactaaatggatattgaggctgtag

SEQ ID NO: 146080 - DNA, 460 bp, Homo sapiens
ttacacaatacgttggccacctatagtcctcaagcccccggaggctctaccaataaacaggttttattatgcattggtttggggaatttaaacccccacctctgtcacttttatctgcttccagtgtgattctactcctgtctgctctcctaaattaaaaaaacccttttttgggtgatacataaaaatctgcctttgtctgcctcattcaggtgatttttgtctaaatgataaaatacactagtctatgaagtcattatttcacagaaatgcaaaagtaaccttttcaaagtctgtgactactatccagactgtcttctgcaggctctaaggttccactggggccagccagaccccactcttctcctcgcaggcctcctccagccccatcctgaatcgcaggggtgcgatcaagacccctttttttgtgtaaactgattgggatcctctagatcgccgc

SEQ ID NO: 146081 - DNA, 432 bp, Homo sapiens
ggctggcgcacgctttgtattgagtggtgtcttcctctttgtagcctctgtggttggcccaaaggtaagtccccaccctgatccctagaatgtgacatttgccttatttggaaaaagagtctcaatatattgacaccatgaagatctgaacgatatggagaagattgtcctggggcatcctaaacgcggtcacaatacggagacaggaggagatttcacacaggcagacgaggaggctgcagtgcgaccacagagaccgagacgggagtgatgtggccgcaggccaagcacacctggagccttcaaaagctgggagaggcaggaaggagccccagggcctctggagggagcgaggcctccacacaccttgacttcagccccgcagtcctgattttggacttttcatttccagaaatgtaagaaaatgaacgt

SEQ ID NO: 146082 - DNA, 468 bp, Homo sapiens
ctctgtttaataagtatccagcctctaccactcctgattccattcttcccattgagatcagaggaaccccagtgtggtccccagaccaggtgcatcagcaacctttaaggactagctagaaatgcaaattcacagctccgctccccaagacctactgaatcagaaactctgggaatgcagcccacacttgaaacttgagtttcaacaaggcctccaagtgattttgaagcctgctcaagtttcagaaccattagactagagtagttagtctcaatcctgcctgcacattaaaatcaggggagttggctggacgcagtggctctcgcctgtaatcctagcactttgggaggccgaggcgggtggatcacgaggtcaggagatcgagaccatcccggctaacacggtgaaactccgtctctactaaaaatacaaaaaattagctgggcgtggtggcgggcgcctgtagtc

SEQ ID NO: 146083 - DNA, 454 bp, Homo sapiens
acttgatacccgggaggtggaggttgcagtgagctgagtattgcaccagtgcactccagcctgggtgacagacgcaagattccgtctcaaaagaaaacaaacaaacaggccgggcatagtggctcacgcctgctatcccagcactttgagaggcccaggcgggcggatcacttgaggtcaggagttcgagaccagcctggccaacatggcgaaaccccatctctactaaaaatacaaaaataagctgggtgtgatggcacacgcctgtaatcccagctactcaggaggctgagacaggagaatcacttgaacccgggaggcggaggttgcgtgactgcgcaagggtcctggtgagggtcccaggccaactcctcccgtcccagtgtctgccaggccaaggggtgtgggcgctgccccacctctttccacactttcccttccagctgcgttgtga

SEQ ID NO: 146084 - DNA, 519 bp, Homo sapiens
cactcagtagcagagaaattccttgagattggcattcaacccattcacagggagggaggcaggatcaatggagtccctggtgggctccagacagagggctctggctaaaacagacagaaggaaatagaaagtgtttaaaaagcaggaagaaacacaaagggagtctgggggaatgatgtatcaaggatgctgtcagatgataacatttagtggaaaaataaacagaaaagcctagaacacagaacagtgtcaatgctgtgataacaactacctcaaattatgtacacgcaggaaagactgacagggatcctgggggaaaaacactttaatttgatgcattgagaagattgtgggtacatttttatcttctgttttgatttctgttaacattgataaatgcttatgcaagagtaattttaaatgctttcagagataaagaaatcacaaagaagaacaaagagtttgactacataaaaattagaaacttctgcatgtcaaaaaaagcaactaaaatggaaa

SEQ ID NO: 146085 - DNA, 256 bp, Homo sapiens
agtccacctgcctaggcctcccagagtgctgggattacaggcacaagccactatgcccggcctgtccctaaacagattagtgagattaacatgttttaaaaggtagagctgttaaaaattatttcagaaaatttgcaggtgcatttgtgtgtcttatgtagtgcatgtatataggcaggagtttagtttggtgagatttgtattaagaagggtttacagtgatttaaatttcccctaatatgggatgactgtgaca

SEQ ID NO: 146086 - DNA, 271 bp, Homo sapiens
gtctttgcgccacatgtgtttcttccaagaattcactctctgtactttgagtattgttagttcatgagaaagtgagtctttcatggtactatatattgataaagggtcttttgcatttaattttacttaacatgtagattaaccctgggagagagtaaactgaccacgtttatggaagtagtctgatacacactaaaaatgaataaaaattagcattcaggagcacactttggcctccctgaccttttatttcggtaaaaaaagttatttc

SEQ ID NO: 146087 - DNA, 835 bp, Homo sapiens
ggacagcctctttgaggctgccttcatcaacacctgttactctgttgcccacttcattttccccagtctgttgtgttggctcgacatccctgagtcttgcccactgtctgctgtcttattcctgtgtttgttctgacttgacaaattactctcatctcaactactgtgtagcaatactttttattcaacttttaccaatttcctaataccatggtcagtgcaaatattctccattctttggctttacctcaagtttccatcctattttttttctctttcctaaagagaagtccatacattctaactctgttatgacttgcttgctccttaatctcttgtcatttggtttccactcttcatgctgtgttgttcccactgggaaaggcaccatagacttgaagagtctgtccttgatcttgtcttgcatggtttctctgcagcctttggtgctgtggaccactgcctggtcctgacactccttcttgcttttgctgccttaatgctccatgtgtctgtttcttctgctactgctatttctccatccagtcctttctgagattcagtctctgcttggttttccttagaggcaattttcactcccatgacttcaattatggtcacctctatgccaggtcacacttccagttgtctactggatttttctacttgtccatcctactattattaaaacttgagatatctcaaactggatttattcccccttccaaaactgcttattttcttctactaacttcaaggctgaaggtttctgcccatccattgattgtaatcttccatcagtcattaaagtacatgattccttcagatctattct

SEQ ID NO: 146088 - DNA, 383 bp, Homo sapiens
tctagaggacccaccaccatgttggccaggctggtctcaaacccctgacctcaagtgatctgcccgcctcggcctccgaaactgctgggatcacaagtgtgagccaccacacccggccaagtagcaactacttcttatgtcctaccttgtggattatcattttgcaccttctgctcaattacatcctaaaatctcagcaggtcggctgcaaatatctcccccactctgtgcttgcttgcactaatccatttggtaatttgataaagtctcaattatttaatcatatcaatctttcctttgtcatttccccttgatgcacagaaaggcctcccttgatgacaaattcaataaacatttacatctattttcctttacttaaaaat

SEQ ID NO: 146089 - DNA, 381 bp, Homo sapiens
tgctccttctgctggaacattcctcctccagctgctgactggccccctccttctgtggagaggccaggcccagtctctccccactgatggagcagccactctgctcttcctcacaggaggcgtcacctccacggttgttttgctttggacaaaccaacaaaccgacagcctcccctagagcgcagcgcctgtctgtttgctgcccagcaggttacgagtgctcactttagttgagcccctgaggggcaggggcaagggcagaggagatggagtctgggagctgcagatgcagtcaccttcccgcgtgcctcccacacatgcagccatgagaaccacacggcataaagggtggctgggctgggccgccccacgcgtcctcat

SEQ ID NO: 146090 - DNA, 367 bp, Homo sapiens
gtcgggcacccccactcccccgtgaagatccttcaagtccccattcgctcttccaaactccagacttaactctcagcccacttttgaggtccagctaggccatggaatcatctctgtcctcccatttcggggtgggcagagctggcaggacccttaacccagccagcatcttggaaatctaccaataatccacccttaggaagagaaaattcccctgaccaagtccagtttttttgtttcttcttgctggggaaggggacatccttatttgctcaatatctgggattcccagttcctgacctcagaatgctctgtctcaaggaacaacaggtgccagttacaggttgccagtcggggccaggaagct

SEQ ID NO: 146091 - DNA, 414 bp, Homo sapiens
gagaaattcactgttgagctgcaaggagtatagttggccgacagcctctagctgcagcatcttctagatatgccatatttttgatctgaggcccatctcttcctgggtagcccccaggccaatatcgtacaagctgggagtgctcgggtgtggccctgtctgcccagcatgagactcctctaatgagtagtctttgttccagagctccttgttgcattggcagagacttatgcagatccacagcatggtctgaagctcctgttgcccagttctgcttctctttctttcctttcacaagtgtctaatctgcatggaggtgtgaagaattttgttgcccagtcctgtttcctctaccttcttctgtcacagccattagcccccaataaatttcttgtactcctaattccatcacag

SEQ ID NO: 146092 - DNA, 1489 bp, Homo sapiens
cgccccgggatttcccccgcacgccccggggagagacacgaaaaccacttctccagcctctcttgccatccccggctgtcccccgccgacctgtcattgctcttaaagggttctccactcgtgcacacctcccaagtgataacctcattccgcctgcttcctccgtgccctggcatcctttttgtaacgggctgttggattcctattattgcctcctcttcgccgcctacgggatgataaactcctggcaaggatgcactgaggttgctggcaaagagaaactgggatgtgcggagtgaggaaggggacaggctgtggttgatcactctgtcgcacgggaatctatcggcctccttgtattcctaggtgtagtgggggaggaaccatcctatgaatcctggaaggctgaggcaacagagcagaaccacttggattaagtagtatctcacattcctgggggtcaggacaccaagcaaagcagagatgggcatgagctgtgcggggagcgggcctctgaaattggaaacagcactggctggtgtaatgtgtgtgtgttgtgtgtagaacagagatggtatctaatgtggccagagcatgcaactagagtgcaaggcaatcaagtcgtttgcaccatgagcacttaaaagtgaagtaacccagcagcccaaagaccatgatacacaagtccctctggggtttcagaaatgattctttctccttagaggtttactcagtttttaaagtaatttttctgtgtgagtggtggtggtgatgggggaaattacgttcccttttttcagaaagaacaaaatatcttcttttgttttggttttactggaatcattcctgcttcagcttcggtgcaggattcatatacccatgaaaataatgaggaaatagctctgcaaaaatgattcgaaatagggctgcagagagatgcacagctattttatttttcctgcaggcatggattttcatggaaacagtccattcacatttatttgagagagctgtgttttgcatgaaaggcttctgttgacattttcaaaaattgagaccctttgcagaaatatcagagaatgacaattatctccttaatgtgtgaagtttagatgtagctccaatctaggttaagatcaaaacaatgtaaagcttataattcaaatgatactagtgaacgtgttggcaattaaaaaaacacttgtgcacacataaggtcacattccctgttttaaatcataggatgtggattcttaatgtaggtgtaaagtcatcaggtgaacatgtaaaaataaatgtttatactttctggcttagtttctctactgcttaaaatggaagagcccactcaaccattccaaggctactttgccttgctttttttcaatactgtaccattataaatgacttttcattttaggtacacacactcacccataatttaaaaaattttattcacatactatgtggatagtagactcaaaatagg

SEQ ID NO: 146093 - DNA, 444 bp, Homo sapiens
aatggaattgtaagattttaaataatcggcgttctggactgtgtgacatagaacatgtcatttcactaagccgtggtttccctttcagtaaaatgaacaggtgagttacagtcagtgattttcaaaatcttatcagtgagcacattgcctctcttttcaggcaatcttgtgtggattaccagttttaaatacagtatcccttcacccctaccacatcacacgcattcatacacacacacacacacacacacacacacacacacacgcactctgaaagcagacagcactagaactccagtggtttgagtggaggacctgggtccttgtcaccctccacaaggctttcccagggatccagccctcacctgggtcctggctactcatgggctcagaccagcagtatcagtaccatctagaagcttgtgagacatggaccgttatgac

SEQ ID NO: 146094 - DNA, 239 bp, Homo sapiens
tatataagaactcctacaactcaacaacaaaaaggaaaacacacacacacacacacacacgcactctgaaagcagacagcactagaactccagtggtttgagtggaggacctgggtccttgtcaccctccacaaggctttcccagggatccagccctcacctgggtcctggctactcatgggctcagaccagcagtatcagtaccatctagaagcttgtgagacatggaccgttatgac

SEQ ID NO: 146095 - DNA, 337 bp, Homo sapiens
ctcaagtcccccgaccttctcccactgcttgatccttcttcaaaacgcaaatcacattggccagattcatgcatgtatcacccagcagttagcgatgagcactcatgagctctgggctacaggtgtcaggagagaccgagacaagagaagacacacagtaagaagagtccgctttccctggttttaaggtttagattgcaaaagtcagatttactcccagccagtaacttgaaaatatttccccagccacctaccttggttgccacagagacccccctaaagagctgcctgtgcgctccaccatgacacccactggccgggtctccctttgcctgtt

SEQ ID NO: 146096 - DNA, 269 bp, Homo sapiens
cccactttccctttcaaagacaaagctgagatgagagctgccggtggctgggcctccatctctggaggaagccatggtacaggaggagagtgagagccgctattcaggaagaggcagaggggccgatcgcccggtggaatctggttgtttccagcaatacccggccccgctcagcttatctgagccaataaatccctgcctttaaaataaaaaagatgcttcaggttgggtgtcgctagcaatccaaaggtttataacctaaacactga

SEQ ID NO: 146097 - DNA, 286 bp, Homo sapiens
aggtgcatggctgccagtggtcctgagtggcccagtaacacatcacagcactgcgggcaatggggcttaagagctgagccaggattccacgtgccggcccatcgcggttaatgtatcaggacagagatgccacagcatcagttggtgtctttcctaatatcaaggtaccaggcagagctctttggaacaaaatacatggggatcacaacaaatttatcagacagagcagggcctttaccaaaagctctagtactgcggacatcctgagagtgatgtagctgctgac

SEQ ID NO: 146098 - DNA, 533 bp, Homo sapiens
cctcgatcacacccataacagagcctcctgggccctgcctaagtggctctcaggagctgctggatggaacactacccagtgctgaaattacaggagaaagaataacaagaaactgcgggagttagttgtctccactcagagatcttggggccagctgagatggaatagcgagtccattaacagggtccagggcagctggaaggctggacaggaagtgggcgtgtttcctgcctccttttcccagattcaggagtggggattttcccccatgttgaggtctaccccagggcttggtcctgctgccatcaccctgcagaggcagtgcagtgcagtggaaagagctctgacccgtcagtggaccccagttctcatcccagttccggttggctcatgggggtaccaggcctacatgctgtggccacactgggcctcagtttacctgtctgggagtgagagggaggtaggcatcaccctctcttggagcccctggcaggttaagccaacacttaagcttatttctctctgtgtaatcg

SEQ ID NO: 146099 - DNA, 723 bp, Homo sapiens
cgaagtgctgggattacaggcatgagccactgtgcccggctgggttttctagacaagttcttactttttgccttattggaagcaacctagtgactgaaaaagagacatcaagtgacaagtcactcattatagctatataccactggagatttatggcagttctaagtgacacaaaatcgggggtggtgattgcgttcctcagctagggctgccgtaacaacttgccacgtgtgccgcagcttcagacacctggaattatcctcatagttttggaggccagaatccaaactcaggcttcagcagggcaatgccctcagggtctggagaagaatcccaccctgcccctttctggcttctggtggcagccagccagccatggtgtcccttgtcttgtagtggcgtcactccagttcctgcctcacatggcattttcctgtgtctgtgtccagtttccctcctacaaggacatcggtcattggaccaggacctaccctcatccagtatgatctcaacttgatgacagctgcaaagaccctaatcccagatatggccactttcatgtgtccttgatggacttgaatccaggagagtcactaaccaaatacagttactatttccttctggggtatttacacagaaagcgatatattacaaatgtaaaatcttagccgtttctttgagaagtgattatacctggcctactgtatgaacatgattctttct

SEQ ID NO: 146100 - DNA, 388 bp, Homo sapiens
ctgccttagcctagccatgtcccctgtcatttagtctcagagtatcttgaacgtcttcttcacagcccaacttacaatcctcactcatttgctgagtgggtgccatcctttccacctagaatgcaagctccctgagggcaggggctggaaccgtcttgttctttgccaaatccccagtgccatctctggcacagagtgggcattatgaaaatatttgctgagtgcataaaaggagggaatcatggatttaagcactcggcttggtgccctggggatggggctccataaaatcagttcccattttttctctctcctcttctcctgggaggtgggtgtctgggttctcctgccaggcgagcttctctctcataagactccaggtgcctct

SEQ ID NO: 146101 - DNA, 320 bp, Homo sapiens
ggacattcagaggtaggatggcacaaagacacagggtccactggagatcactggaagcagctgcagcagggttaagagaagggagtcccagcgagtcttcagtcaccacacactaacatcatcagtgaaaagttcctgggcctgaagatccagctatgttgtttctagttgactattttaagtgacagaacttggcccaagcattgaccattttggttcctcaataagcctgattcaacagggtcacctttgaatctgtcctccacctttccaataaacctattttatgcatcattcagtgagttatttatttatttact

SEQ ID NO: 146102 - DNA, 468 bp, Homo sapiens
aaaatgttcatagcacatacatctgacaaaggactcgaatccagaatatataaagaactcttccaactcaatagtaagaaaactaaaagctcaataaaacaacggactaaagattggaacagacacttcaaaagatgaaacttataaatggcaaaaagcatatgaaaagattctcgaaaagaagaaaagatgctcagcatcaccagttgacaaggaaatgcacattaaaaccacatgagacagcactctatatcccctagcatggctcaatttattttcttttgtttttatttttattttggagctttcaaagccagaaaacctactagacaaattctaaaagctataacactgaatggctaaatttaaaaggttggcaatactaggtctgggttaggatatggagacactggtacactcaaactgctggaaaattaaaatactacaacccctttgaaaaactgacgg

SEQ ID NO: 146103 - DNA, 153 bp, Homo sapiens
cggcggctgggaaatgggggtacaacccagagtgaggggcctcgagggacaggcagcacagcggagtcgacacccctggacctgagcctcaaggagagcagacgtgcagcggcacggggttgagccgactgctggggcagagcgcacagagtg

SEQ ID NO: 146104 - DNA, 319 bp, Homo sapiens
ccaaatttatactgtaaacggcttaggtttagggaggggttttgccctagtcactgatgttttgaaataggactcagaaacctctttcataaagtctctgcggtgattgggctaccccagcaatgtgatatagtggtaggattacagaatattttaacccttttctgaatgttgcaatatattcttatatgggaaatgattgattattaactacttagaatgtgtttcttttccaagcatgtcagcagagtaagtacagcagacttcgtaggcgatcagtgtagtgtcaggtgtgagcagtatggactggagatggtct

SEQ ID NO: 146105 - DNA, 574 bp, Homo sapiens
ctgggccgtacttagagaaagaggagggagaagaggaagaggagaagagaccctatataacccacaaagcctaaaatatttactatctggtccttcacgggacaaattgcaaagaaagagaaagaaggaaggccaacagatattaaaggcaatctgttgaagacattatactgaaaggactatcatattttaaagacaagatcactgtctccataggtttttgaaacatttttaaaaaccatatagctgtattaattagagcacttattttctacaataatagtgaccttaaatttctttaaaaaaattacaattagctacaagtatcaaagaagcaaagtcatctagagtagtctacataggagctctttggactttcttttattatggtaaaatagtggtgcttttaggatttacattattgtactctccaatacaaagtatgagtgagggttagagtatacagtacaccattttcatacatgtacaacgtgggtggatgaagaatgtctcttagcagtaatactggatgtagtctctgcttttaccagctgcataatctaggactattata

SEQ ID NO: 146106 - DNA, 942 bp, Homo sapiens
ccatgaagtaatttctaagaagttccagactttctctacatttctgcttttcttctgagcccttagcagaatcccccttagcactctgttcacagcaatacaggctttttccagccttcacttcaagactgttccacatctgtccatcacccagctccaaagccatgttttcaggtatttactatagcagtagcccacttcttgataccagttttcttagtctgttttatgttactgtaacagaatagtacagactgaatcatttataaagaaaagagatttcttataattctggaggctgggaagtccaaggtcaaggggcccacatcaggcaagggcttcttaccgcatcttcccgcggcgagggctttctcactgcgtcgtcccgcggcgagcgccttctcaccatgtcgtcctgcggcgagggccttctcactgcgtcgtcccatggcagagttggaaggcaagaaagtgtgtgcatgcacgagaaagtggctgaacagatccttttatcaagaacccactcccgagataatgccattcatttgttcgtgagggcaaacccctcatgacctggtcacctcgtaaaggccccacctgccaacaccattgcattggggattatgtttccaacacatgaactttggggatgcattccagccatagcacaggcacccgtaacgtattgcagatgggactcttcacttccagccccgcaacacaaaaaaactgctgtaagcccttcctttcaacttttctggtcaaagcaacccaattttctcttccagaaatggcccgttgacttcccatgtcggttggctatataagaacccttaaataaaaaatgggggagggccccgaaaaggggcgggaaaaattccggtgcgaacaaggggggcacaattggagacacaaaacttttttggaaaacaccacaaccag

SEQ ID NO: 146107 - DNA, 411 bp, Homo sapiens
tgacttacgaccagctgacacactgttcccactggtgatcagccacccacagcacctcgcaccccatccatccacctgagccaatgctgctgccgtgtggacactctggggctcacattcagagcagaacctgctttgcctagcaggtaaagctaggtggagtagccaagtgtgatgaagtctgggatctgaaacacaggctactccctcttcaatcaccctctgtatagtgataacagccgtcccatgttgctagcacaaatgacctaattaatcagtcaccagactcagtctctagcctgaactcttccaccagctccagacccatatttctaactgcctgttcatttcctctgcccacaatccactcatctgaaacagaattccttatctacataggatcttcatctt

SEQ ID NO: 146108 - DNA, 203 bp, Homo sapiens
atgtgcagaagcaaagaagcttccatgcaacagctgtgtggcagcagccctcagcaggcaccaatccagacagaagaaaagatatggtctgagagctctaggaagggtatctccaatgaaagaagctgatttgcttgccagtttgacaggtgttttccagatttggtgacaagtctggtaatgagttaataatggtatataaa

SEQ ID NO: 146109 - DNA, 320 bp, Homo sapiens
gcgaggtgttctagaggatcccggtgatgagtaagtagatttttggtagagaataacaggggcatagaattttgcagatgtggagtgctaaataaatgcagcataacaacacattttttgaaatgaagatagataacagagggacttgttagatatcaaagtctgaatttgtcagaccaagggcttaaaaaagaggcccttagcatttcacctggaaacacactggtataaatatgacatactagaaactactccaggagagttattcttattatccacatcctctcatgaaacagaaagcaatcaaaagtaggatgcat

SEQ ID NO: 146110 - DNA, 281 bp, Homo sapiens
gaagaagaggatccctgcctagatgcatacataggatcatattattttgcaggacattcgtctagtgatgaaagcagcagcagagcctccctccagtagatgggaagactaagacgtatctgagtagtatctggattggttgatggggagagggtctatctgtaataaatgttaagcaatttgcttgaggtcacattctgatttgattacaaagcccatgctctttctactaaccttggtatttctgcaacaagttgagcatgttcaactcattttttttt

SEQ ID NO: 146111 - DNA, 260 bp, Homo sapiens
aggatgaaggctgaggcccttaagctgacccacaggggtctgcctcactgagctccagatactctccagccacgtcttgtaccatgatcacctaccatcatgcccctgaggtgggctccttcaagcccccggcagctgcaggctccatccagcccaggaagacgcccacatcgttccctctgtctgcgacactttcctgcctcctcttccaaatttcttcacccagctaacccctgctcatcttccaggtctcagacaca

SEQ ID NO: 146112 - DNA, 348 bp, Homo sapiens
ttatttcccctttttctgctttgaaattccataacaattgctgaatagacaagtaggcattaagattagcagtcacccacatgagtacttattttatttctgctatgtggaaggcactgtgtttggttccagaaatataaagatatgtaagatttcttgtcctcagaaagtaaaatgccaagtaaatcattccataaaaatagaacagtaaaacattgctgccattctgatgatctgttttatttggagagttatgctatgagtataatctgtagactgtgactttgttgatcagcttcctccctgttttaaatatcgagagtcatagaatcttaatgttagtgctcc

SEQ ID NO: 146113 - DNA, 252 bp, Homo sapiens
aacaaacaattttttagccactgcacacaatggtatgttaagttttaccacatatttccagttcacaaagcactttcataaaattttaaagttgattcacaataggccaggcacggtggttcattcctataatcccagcattttggaaggccgaggtgggcagatcacttgaggtcaagagtttgaaaccagcctggccaatgtggtaaaaccccatctccactaaaaatacaaaaattagctgggtgtggt

SEQ ID NO: 146114 - DNA, 456 bp, Homo sapiens
gtccgatacctcagatctaacataatacttgtcatagactaggtgcaccaaatatataagtccatgaatgcacattgccatattcattaagtacctattatggaacagtaaccaccgcgtccggccaagaccacccttttcttagtggcctcttgttcaccacccctggtgcttaaagctctgctcttggcttccatgatcctgtatacttgcttgtttttcctcctacgtcttcaaccagtacttctttgtgctttttctcccttgtttctcctcttaactgtcagcagctttacagatccactttcaattctttcccttattgtcctgactgccattttccttgagttgtgctctacctccatcctttttgctgctaggtctagcttgactctttcctgccttctcccatcatgcattcaccttagagaccctccaccaagttgccctcactcc

SEQ ID NO: 146115 - DNA, 485 bp, Homo sapiens
aatgaagccccagcctctctctcctccagctctctggtcttttgtgaggatgctcatcgcagtggccaagcccaaccagaggccgggggctctggaagtgcaatctgatgcgtatagcctcctggggcatggaagggcagagaagagattagctgggggctgatggggagagcctaaccagcacacacacttttttaggctagggctgggcaggaggattaagactggtacctctcaacacaagcacatgttggaatggggtagggtaactttccaaaatatgttgtgtgtttggcagaaggggttcctgttgttagaaaaagtgaggctaacagatggtaggccaaaaaagcaataaactagagtaaaatcaacaggtatgataatgcctaccccacagaaatggataggaaaaacatgcatgaaagcactgtgtaaactgtagggctctgttcccttttcatgaggccatcagtcatactgga

SEQ ID NO: 146116 - DNA, 395 bp, Homo sapiens
cagggttgctgggaagcgtctagcaggtgctgtgtgagcatttgctatgatttgtttttgtttctatatcttttgccagatcatgacattcctgagggcagggatcaaatctttcactctgttctttgtcccatccagcacagggtctgaggcaaagaagggctcagtaagtgtttgttaaatgaatgaatcaaggttaaactgtgtaacccattataggtcaggggaaagtgggattgggggagcagtaaggaggccccagaggtggcagcttgtagtggtcttaaaggatttcagtgcagggaaaggaaggtggcacagggtgtgacattggggttaggtggggaataagggtagtaggagcaggtcatgtgggccttgaatgccagggtaag

SEQ ID NO: 146117 - DNA, 412 bp, Homo sapiens
gtttgtttctaaacttgcattaaaatagccaaagtttttttcctatctctttgcctaccttggctccacagagtggagagaattttctatttcatctacttaactttcacataatgctgtttcctttccaaatctaagccttaacttctgttaaaagttggtttcagtattgaggctccaaagctaggactaggaataaaggaaactaagaaatgaagagggtactcattttgcaagaatagagaggtggcagtctgtagcatttttaataaagattttgaatattctgtagattgtgaagcagaccatactgtatccaaccaaccaaggggaggtagagaaagatggtggaatttcagcatttttataactaagaatgaccggacacaaaggaaattccaagtagagggtt

SEQ ID NO: 146118 - DNA, 187 bp, Homo sapiens
ccgctaggtcctgctgtcattagggattgctcacctgttgcttgtcaggtcattcaaaacctcttgggtctgtgctgcacattaaaccccagagtcccaaggagagtgggagatgtacccccggagcacccctggggtcgggggagcttctccgtttctgcacatgttctaaaaactcgaggacttc

SEQ ID NO: 146119 - DNA, 153 bp, Homo sapiens
taatttctttcattgaatacatttttttatataaatcaagctaaaacttattctagcttgtttcaaaatgtccaaacttgactattttatcaaataaagaggttactgtagaaaataagacaaatgctttcatatttatatttgcctgtttga

SEQ ID NO: 146120 - DNA, 398 bp, Homo sapiens
ctaagatcgagcgaggaggttctaagcagagggtgaaccagcaccatggcccctgaaatgcagcagctcagagttcaaggaacagtaaaaaggtcattgatcaaagagggtgagagggaaggagagtgaaggagaccatcactcccctaactggaaaatagcggccacctgtccaagcacttgactcatgtcatagtgaccttcagttccctacctatgacccaggtgtcattatcctcacttcatcagaggaggcgacatcgctcgaccccagtggctgcccgtgctaggtgggcagtgtgtgggatgtgaagccaggcagcccacctccgagccacctcctttccatcagtatgcattctgcatcttaccaaggcctatgtttgtggcatccagct

SEQ ID NO: 146121 - DNA, 359 bp, Homo sapiens
aggcctgcctcacaggagaactgacccagggagtgcatgcccaggagggagtctgggtgctgtgtagcacagcaggtcttgagctcaggtctcggcctaaagtgtccctgtccacaaccatatccactcaaacaaataatgagaaaggaaaacagaaagacatgccctatcagttcctgatgtatctgttgaacactcctgttcagtttgctgagtttgtaatgtcctctctaagggagaagaaaagacattacaaactcaacgggaatgttcagcaggtatgtcatgaacttatctgctggtttcaacagatcttcccttccaaagggcagggactcatggaccaactccacgcccaa

SEQ ID NO: 146122 - DNA, 257 bp, Homo sapiens
cgtattaaggtattccttagaatttcacttcttaggtgcttttaatttctgaagccccttaagattcagcaccaagtctttgggaggacagaaagtgacaggagggagaagggaggaatgaaagaaggaagagaagaaaaggagaagagaacaaagggagaaaaaatctaagagaacttgagtgaccctaccaggagacagatggagagcagatgggagctgatcccaggtgaatactattccaggtacctctaaac

SEQ ID NO: 146123 - DNA, 757 bp, Homo sapiens
tacactgccctctgagatctgatggggtaaagcaaaggataccaactaagcttgcaggctttggagtcacctcacctgttcctatcacttagatgttgtgtggtccaggatcagttacttaacatctctgtgccacagttttcttatatgtgtataataggtatatgattagtagctaaatgagacagttgtgagcatgaaataatatatgtaaagcattcagaacagtgcctggcacatagcaaactttatatatgttagctgttattatcaggcctatccaatttataagtgatatggaatcgagaaggatagcaaatgttttagaccataaaatcaagaatctaaaaaagattttgacagaaaggaaatgagccaaatataaaaagatgaagtttaataagtacacataaaggtcctgtcttggggtaaaatagcaagaatgagggaggcctataggtttttagtttattataaatttaatataagttaaccatgagatgcacttacaaaacaaaattagatttaggttgccttgatagaaacacagtattggaaacaaaggaaaatagaacccaactctgtctctgcactggttggaccacacttgaaataatagatttccttctagtattcctcacagcagcccctgaaaattgataattgccttcacgttctttaagggctggtatatgaaaaagaaaagagatgtattttggggatgctacagaagacagaacatccccaatatgaataa

SEQ ID NO: 146124 - DNA, 688 bp, Homo sapiens
gaaagaatttgcactatacaaaatagtcttttgagtggaaagcatcacccatttttgtgattctgtctttaaaaatgtagaatgaaactacatgagttattaagttctgttctagaagaaagtgtgtattgaagttgtgattggaatggattcactttaaactagaaatagctttttattgctgaaatgtaatttgctcatttttgactttaaaaatgttaagtaaaataaggttgaaatcacagagttcttaatacccttacccttgtttttcttttccttctgttagagttcagctgatttttaccttgattttcatttataaagaactttagttaaaaaataatggcaagtctatcctgttggtctagcttactaaattcctttacttctttcactaaattttggcatcttttttttactttggatatccattatattcagagtgttccctaatgttgcttttgatttttgtccagctaatttaaatagtgacttaagagtttcagttccctgtgaacacagattcccttttggaaaatcccttttggaaatcaccgtaactgacagtcttgataggtaaatatgcaagggaaaccttcctaggtcaggatttaagtatctccgttaacgaaaggaaaaggtaatatggagaatatatttggcaaagtatctctgtctctcaaaa

SEQ ID NO: 146125 - DNA, 340 bp, Homo sapiens
ttttgtacattgtataaatgaacctgccgtaagtgttttagatcaaaccatatttatcgtactctctctttcattttggtaacttaatttgtcagtttattttgacaagtaatgggactaggaaatgtttggaaccaaatacatagctctttaataacttctgtggctttgccagatggattgtaaaactggtaattattcagttgtccaggagtgttcaaggactttcttaagtatggcatgagaataaattgttttcattccattttctctgagggtttattgtcttgtttttaaatttaaaaatttagtaatgtctttgttttaggggcttgaaata

SEQ ID NO: 146126 - DNA, 143 bp, Homo sapiens
tgcaggctgatggctgagggctcatagaaattttactggctggtggagctgacagagaaattagagacaaagggaaaccatggcttggttacatgcttgcccatctgccagtcaaatcctggcagaaaatctcacacatgggc

SEQ ID NO: 146127 - DNA, 544 bp, Homo sapiens
gacaccggatgctggtgatgcctgagaaatgagatggggctcccatttcccaggggcttggagtcttggggacaggacgaggaaaccaaggactgtagaccggttcgtccggatgctgggggaggggcacctacagcacacccaggtctgggcaacttcccggaggaggtggcctcaggctgagctctggagaatacacggatggagaaggtggaggagaaacaggcatccagacagaggaaagagcgggtgccagaggacggagacctcaagtgtgatctgttagggactgagtagctccagggagctggactgaaagggactcacgcggggtggggaagggccagatggaaacgctcagggcttactccctcctttactggcataggaagcccttggagccaggggtggcattcagatttgcgtttttcagagctgcctctggaagcagcgtgggagacagatgggaggcagaaaaccagccagggctggggaagaagtgatggagaggagaggagacctgcagggggctggcgatggatga

SEQ ID NO: 146128 - DNA, 150 bp, Homo sapiens
ggatttgctggtgcagtacaactaggcttaatggctcatgttgataatcccagcattttgagagtccaaggcagaaggatcgcaagaggccaaagtttgagaccagcccaggcagcatagcaagacctcgtctcttcaaaagggaaaaaa

SEQ ID NO: 146129 - DNA, 472 bp, Homo sapiens
cagaggactgctgtacaaactccaggcttatataagcaagaagacctctagggagtaggctctgggccccttccatccccaggaaggcagggcccaggacacagagaggtttggggtctcccccagattacagaactgaaccatgataaagacccagatccaaggctgggtttttccagcccaggagcagtaaggggaccatggcccagccccgggccccaagcagacacatgaggcctggtggtcctcagcattgccctctatgagctccctgtgaccaaagacactacccccacagtgtctcccagcagtgggcagagctgcccctctcaccagtaggagaaccctgagctcagagaaggggagtgactgccgcaaggtcacacagcgtgagactcaccctcaccaagtccctcaccccagcactccaggcagcagccacacagcatcgggggaagctgggctgtgactc

SEQ ID NO: 146130 - DNA, 537 bp, Homo sapiens
tcatcgagctcggtaccagttcgacggagactctcagaagtggttcttctccttcgtaatgaggttcagttttagtcggagggaactgtgatgaagtgggtctggaaaggggcctctcccttctgggcagccagtgctccctttacttggctgacgactctgaaattggaggagagggtatgtgtgcaccccagtcagatgtatatcaatgccattcagattcagaagcaaattctgcacattggctcatggtgcctgtgatcagaagggaagtccctggctttcaacactctgcctctgtgtcagggtctagacatgagtgaagaggctagccacatacagaaagataaaaacaaaacaattcttctcattcagtgccattgaataagcccagctaaagagtatcctgcaagtttaggaattgaacacagtctaaaatccttattagcttgctaggactgccataacaaagaaccacataaacagtggtttaagcaatagaaatgtatgctctcacactgctggaggctggaaggc

SEQ ID NO: 146131 - DNA, 598 bp, Homo sapiens
acaactgtgtttagtaaagtgaatgtcctctggagcagaaacagagatttgggtgtgaggaagttcagtagcagatgaaggtgttagaatgtggcaaagaagcaaacttcctggcttggcagaggggccttaagggccttaatgcagatagtttcctacagtggcactagtgagtctgaactagtctagaccaggaggctgtgcttttccaagtcctatttctctaaccagatattaaggctggttctgcttgtcagtaaagcttaacttctttagctactgtaaatttcttggcattaagcagacatttattaagaggctgctgagtgtatcttagacacaggggagagaaagacacatgggtgtagtttctgccttgaaggatcttaagagctaatagagaagaaagacacttaaacagaaggtgacaactcagtaaaataagtcatgtatcgggaagtttcagcagatgctgtaggaacactgaacagggggcactaaccagagctggggtactggtatcaggaagacctcctagtggagggtataaattgggtcagggatatggtttggcggtatccccatccaaatctcatct

SEQ ID NO: 146132 - DNA, 294 bp, Homo sapiens
ctgagacaccagctggagcaagccgtcccatctgccccccgtgaaaatgaggcaggtgccgtgtgcctcacagggcagggcttgcacggggctcagggcagcgcctggcagagtcactggggtgctcacggtggcttccctgccttctcagggagagacccaggccccagcagacggaccccagtgccccacgaagtcttccctgatcccacagctgaccggcagcactcacttcaggaatggggctcggggacccgcaaaggtccagcctgggtgacagagtgagactctgcc

SEQ ID NO: 146133 - DNA, 557 bp, Homo sapiens
caaatagccactgagacagatgtccctgaggtggaagccagtgaggttgggcagtctcccatcaccccgaccctggtgcctcctgtgcacccttcccctccctcgtcccgcagccctcagccaggccaggacaaggagtcaggggaggcccaggtaacccctactggccctcctctgtctgaacctctacagggacctggccccactcccctcagccctcagagaattcaggatgaggaaattgagtcagacaaacttccacccagcagttcccaccatgatcctccaaaagattcttcccacactgacttggtgcagaaacttgctggcgattctcagcaagctctgaaggaggaaacctccaaaccggaagccatccgagtcagtatccctcacccagaactgccacatccccaagacttagcaacagataccaagcagccccaggccaggggagccccggggaccttgcttcctagaagccggctggctcccactcggctgccccagcctcaggtgctggctcccctccagagcaggaggcccacacccaaact

SEQ ID NO: 146134 - DNA, 362 bp, Homo sapiens
aacaatcctcctcccaactaaatagagcaattatgatggctaactcagtcaaaaatgaatgcaaacataaattcaccttccatggtcatttattattttttgattggttctcattttttattcctgtctcttgttctcctttagtacatatttccttccttttttactgtaccatcttttttcatatcccttttcctccctcccattcttatactcatctccattcctttcttttaaaactagccattctagatatttttaaaatttaagttttgccacttaaggatccctatttatggattagggaatgtatttacagagttaaaaaaaaatcaaaacacttaaaaagagtatacaggaaa

SEQ ID NO: 146135 - DNA, 397 bp, Homo sapiens
cacccagtcccagagagcacttggggtcagactacctgcacctgatccctacagaacctgtgtacctaccatttctcagtacaggtgaataaaggcaacccctcaccacacctcctccctgcctctttaattagatcccaggacgtttgcttacactggcctttgcaatggccaaaagagttgttgctgaactttcaaaatgagacagcagagagctctgggtaacagttgcctagactggtctccttgcccccagagctttacttttacttctctctggaaatgccatctgatttcattctaatcttcaatcttctcaatagccacttatctcatcctcttgtggaccaatgaaaggagcccagaattcacttctgttttcaactctgctcagtag

SEQ ID NO: 146136 - DNA, 307 bp, Homo sapiens
cagaaaccatctggaccacaaagctgaaaaatactcactgcctggccagcaaagcttgctggtctcttctcttgggaggatgacttgagtgtaggagtctgagaccagcctgtagaccccaactctacaaataaataaaaatattagccaggtgtggtggtgtgtttctgtagtcccagctactcaggaggttgaggcaggaggctgattgcttgagccccagagctagaggctgcagtgaactttgattgcaccacggtactccagcctgggcaacagaatgagatgctgtctttaaaaacgtttt

SEQ ID NO: 146137 - DNA, 106 bp, Homo sapiens
actgaagagggagcttggtcaagccagtcctgttactggctgggctcatgtgaaagaaccacagcagctcatgggctggactttcaaagaactcctcaggactttt

SEQ ID NO: 146138 - DNA, 306 bp, Homo sapiens
ctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctc

SEQ ID NO: 146139 - DNA, 491 bp, Homo sapiens
tgtgcttgtggattgctgctggggcgacgggtttgaggccacgtctgcggccagcagcaatgtcagttccaggaggaccttggtggctgcggtgctgggaagtgccattgtgctgcgttggtgtgaccctgtggcacctgctgccaggggaccattctttttgagtcatgttttcttcaaattaaatattgagagattctagtcacatcccacagttgccatttgctgtctgagtagaaaatatgaagaatcgcctgatttgaagctatgtggtcagtttcatgtccatagcagccttgcttttcttccttgctgagagatggaattccccgtctcacgctctttctgccattatgtctctgtctgctctgatactgaggttccaggagggctgccttggcctcctttccctgtagcccacgacccccgcattctctggcttctttgccgacagttgtggtgtgcgcttacatctggtgctgggttgcagg

SEQ ID NO: 146140 - DNA, 812 bp, Homo sapiens
tcagaaagtgttctccactctaaaaataaaatggtttgctcactgtttaaattaattttcataaattataaaatactgttaaaatgagtgaattagaataaagataaatattttcacaaactgtacacctccatgtaaccagaatctgaataaatataagtaagaataaccaacagtcaagaggccctcccattctcccctcatcagagtaatcactatcatttatctaacaccataagtttatcttgctagttgttgaattttatacaaatggaatcctatagtatatattgtgtcaaatcataaatgcatgcttttctgcactgtcatttgcacactcaacactacatattttgattttttttcttatgggttttcatatacttacaatgaggctgtatcattttgattataaaatcactaaatactctttcaaataaaatctctacctcattggcatattgtcatgtacccagtgcctatctaatgaatccaagtgtgttccagttgtgactttcaaatttttctgctcagccacagctttctcacaggtgcttcatggtaggccaagtgaatgaattgtggaagacaaatgcataggtatagtatgatcccaacacgctgcacaatgatcatccacttttcttggcttgttttttaaaatagattccattttgagaatactgagatgattcagtatattcagaaatacaacttgggcaaaccttcttgccagaccttgatcctggaggtttgcttaaggattttgaaataaaatctgaatgagacgagaggaaggttaaaaaaaaaaa

SEQ ID NO: 146141 - DNA, 758 bp, Homo sapiens
tcagaaagtgttctccactctaaaaataaaatggtttgctcactgtttaaattaattttcataaattataaaatactgttaaaatgagtgaattagaataaagataaatattttcacaaactgtacacctccatgtaaccagaatctgaataaatataagtaagaataaccaacagtcaagaggccctcccattctcccctcatcagagtaatcactatcatttatctaacaccataagtttatcttgctagttgttgaattttatacaaatggaatcctatagtatatattgtgtcaaatcataaatgcatgcttttctgcactgtcatttgcacactcaacactacatattttgattttttttcttatgggttttcatatacttacaatgaggctgtatcattttgattataaaatcactaaatactctttcaaataaaattgtgttccagttgtgactttcaaatttttctgctcagccacagctttctcacaggtgcttcatggtaggccaagtgaatgaattgtggaagacaaatgcataggtatagtatgatcccaacacgctgcacaatgatcatccacttttcttggcttgttttttaaaatagattccattttgagaatactgagatgattcagtatattcagaaatacaacttgggcaaaccttcttgccagaccttgatcctggaggtttgcttaaggattttgaaataaaatctgaatgagacgagaggaaggttaaaaaaaaaaa

SEQ ID NO: 146142 - DNA, 309 bp, Homo sapiens
tcgcgtgggttggtgggctaagaactgagcgatgttgttagcgaaggtcccacgtgaaggagaaccctggggaggggcccggtggtgaagggggtataccctgtaggctcagcgcccaaacctcccttcagtcctgggccacggggctctcccaggcagtcagcgggtgaatctcagggcaggacaagctccaggagggcccagaggtggtggaaatgtgagtccagcctcagggcctccatggagcaggtctgagaaacatcgaggtgtggatggatggttatggagaggaacttgtctagcctcatg

SEQ ID NO: 146143 - DNA, 423 bp, Homo sapiens
agtgaaatggaggcacagagaggggtatttgtctcaagcacacagctattaagtggaggggccactgggatttgaacttagatcaatagaccccagagcctgtgtgcttaactaaggaccctaaaagactattccagcctggtgagctgagttcctgtttgagaggagtctccgcagcctgagtctggggggttttcgcacctgtgggccatgggtgcccccggggaggtggacacgctgcaaggtggaggttgtgtgccacgtttccaggacaccatatggccccaccctggtccaggtgctgctggagcaggacctgtgctgtcactgctctctgacaccgctccactgtctcctccaaaggctcccaccctggtgggctctgcacccacagatttgatgaaactcacaggagtcaagcat

SEQ ID NO: 146144 - DNA, 262 bp, Homo sapiens
ccacctgctgctcgctgccctgtgcccttctgccgtgcctgctatgtctagcccactccccacctgctgctccctgccctgtgcccttctgccgtgcctgctatgtctagcccactccccacctgctgctccctgccctgtgcccttctgccgtgcctgctatgtctagcctactccccacctgctgctccctgccctgtgcccttctgccgtgcctgctatgtctagcccactccccacctgctgctccctgccctgtgcc

SEQ ID NO: 146145 - DNA, 720 bp, Homo sapiens
agaccttaaagccccgatgcccactgggttaccgacttacggcactaagttggctgcctgtggctgttaataaaccacggggattgttgtcaacgaggacagatacatccttacctttccacacgactgtattttagtgtttgtttctacatgtctgcactcttccccacacgcctcaaggtagtttttctggatacatatgtttatttttcaggaacaggagttcaaaggagagataagccagtatgtatgttgcaaagttaaaatactgttgcataatagcaatccagtttcattcttagacatacgaagttgaggaggaaataaaaagtgacaatgtaaataaaacacatacagaatgcttacactggggaagaagctgtagtaactttaatattgcaacctgatggattgcaagtgtaaagccctgcaactaaggattttactcagtaaattctttcagataaaatgataaatggaatttgaagtctgatgtttactctgattaggtgggaaatgcaccataaaagttagaagtcattgttttattttatctgggtataaatagtataatttatttaacttgttgacttgcctgtcatcctcagattttgttaatcttattgaagcctatttgtatagttggaatttattctaagttttattggcttctttgtaatacatgaggaaccccaaatttcctatttatgccattgagac

SEQ ID NO: 146146 - DNA, 278 bp, Homo sapiens
acacggaacactcactgggtcccagcactgctctggacacatctcacctgtgtggcatcatttgattcacccctcagtctcttgaaatagggaccgtcatttcctccacctgacagggaaactgaggcagcctgatgcatgaggccacaaaagaagtgagagacgctcgctccaagttgcaaggaggcgagttctttcctcagcagatcccagccctggctttacggctaatcatgagcaaggggaatctaaacagcatggtaatttgatttttgaat

SEQ ID NO: 146147 - DNA, 796 bp, Homo sapiens
tgaagtataagaaattatagatttacattgtggttgtttttacagcttctggacatctttgagaaaatacttgggtggcattgaaacactagccaatggaagcatttgattttgtagaattttgaaatgtagtgccttactcatagtacacttcctagtcttgggggtgggaagaccagtctgtagctaacttattactgtcttatacatcatgctaaagcccagcctgggcatttgtaaacctcggggaggtttctactttagacaacagtttttgttgagggattacaccacagtcagttccctccatttctccctctcttcctggcccccctcccacccaacatggagccttttcaactcttcaaagaagtgggaaaaaaaagtagactctttattaatggcagaaaacaaactggctgctgtacttccgaggcagctctctaataataaagcagagtaggcactgcaacaaagaattcttgaatgtactaaatatatagggaagcctatttaaattcaccagaggggcttagaggacaagcagcagaaagtttagaattcaattcaagccatgccagaaaatgaaaatgtacttaaaaaaggatttctgaaacaattgttcaaagaaatgtcaacttttaaggttctttctagaagaatgaaatttgtactctaatttatgtggtgactttttcaattagagaggaaaagtgattaacagaatctcaaaggaattgtatcttatgtttaaagaaaacgtgttttctttccataggatgttctctagtgaggg

SEQ ID NO: 146148 - DNA, 673 bp, Homo sapiens
gattttcttgactcatagcatccctcagagcaccttgcatccttatgattaattcattaatttttttatggttatttttgattaaacacctctgttttccagtagaacaccaatagcaggagtgcaagaatgacgttctgtctgctgggagcctcgttaggtcatcattatccctagcctggattagacagatgtgtttctaaaacgtacatctgcgcaaaacccttcagtggtccctctttttactcaggtcgctctttttactcagtcaaactcctttatgtcgcttccaaggccctgcatgatctggccccaacttcttctgtccttaccccccatcttcttcaaccttcatctagaccgaaataccactcagtgtaataaaagggctgaccctcttgcctacaagtctccagatatgctctacccattttttctggtagagacaactcctattaattcttcagctcttggctgatagattgcctgcttgattcattaacttgttcactcatccccgttctagttgccaggaactaccctgagtgctgaggaacagtgaacaagacagacccggcctgccctcccccgccccgcatctgtctcctccgtgttgtcttccctcaccagcctcacctccaggctgaattagttgtctctcctctgggtcccc

SEQ ID NO: 146149 - DNA, 703 bp, Homo sapiens
gttggtgttctctctcttatactgggactaaattagagcctaagtcactggggatggctagaaaaaaatgaaagggattccctttctaagtggagagcattctagactctggaaagttcaaagagcttactgcaattctttccagcttctcctgtgagtcccctgttttttcctttgtttctctcagtttataacctgtgaacagggagtagcctggggctctttacaggagatttagaaccagggaagctgtgtctgggcctggggtatataaactcaaacatgaacctgatgatgtatatagatgcagatcaaagacctggcttctcacccaccttctttcttttctgccagaaagctaactcatttgtatcatgaacattgtgctctagacacagaggagactgtgacattagggatttttaccaccactcctcttcctcaaactgtgtgatccttttgctttctgaccagttcagccaactcccagattgccaagagctaatcttcctttagaggaagacctcaccttggaaatgcggaaaagtaaagcagtacctttctgaccttaagtggcttgcttccattgcagcaaaaaggcttatgttttaacttcagggagatatctattataaattctgggatttaagaccctagagttgtctcaaatcacactttccttccatacctatttaaaaaaaaa

SEQ ID NO: 146150 - DNA, 1178 bp, Homo sapiens
atctatcggtacctattaaatacacttttaaaacagctttattgagattatttatataccatgtaattcacttatttaaagtgtacaattcagtgggttttgatatagtactttttttaattataaaatttgccattttaacatttttaagtgcacaattcataaaaggcattaattacactcacaatactgtgcagccatcaccagtattttcaaaatattttcaccaccccaattaagcagcaacaccccatttccttcctccccctaacccttggaaacctctaatctactttctgtctttatgagtttaccaattctaagtacgtcatatgtgtgcaagcatacaatatttgttattttatgttgggtttatttattataatgttctcacagttcatgcatattacagcatctgtcagagctttactcttttttatggctgaataatattctttttgtttctgatattctgatattctgtttggtttggttttgtttctccatgtatctgttgatggacacttggattgttttcgccttttagctgttgttaacaatgctgctattaaaattgatgtacattgcttcttgcccttttgactaagatcaagtgtctatcagagcccctgctctcaattcctttagatatatacattggagtagactagcagggtcggtcatatggttattctatgtttagctttttgaggaaccaccaaactgttttcacagcagctgcacctttgtacattcccaacagtgcacaagagtacaaatctctccatattttcccaaacccttgttaattttatagccatgctagtagatgtggagaggtctgtcactgtggttttgatatgcatttttctaaatgattaccattattgagcatcttttcctgtgcttattgaccatttgtatatcttctttagaaaaatgtctgttcaagtcttttgcctattttttaattgggttttttgttattgaattgtaggagctctttatatattctggacactaaacgcctatcagatgacatgatttgtaaatattttctcccattctatagattggcttttcactttcttaataatggccttggccaggtgtggtagctcatgcttataatcccagcactttgggaggctgaagtgggaggactgcttgaggccaga

SEQ ID NO: 146151 - DNA, 116 bp, Homo sapiens
gaaataatgattctactgttttaagttactacgttttggaataatttgttatttaggaaaagctaattggtatacctagcagtagaaaatgtgcattattttatgtcattagaaca

SEQ ID NO: 146152 - DNA, 361 bp, Homo sapiens
gctctgtctccagtttgctgtgtggcctgatcggcttatagcccttctcggggcctcagtttccccatctgtaccatgaaaggtctggctagatgctccgaagtgctggacgtggtgcgttcttgttgagggggtcttgatctttgtcagggtttccccaacagctgccaattttctgcatgattttcatgccgaagggtgactggttctagcaaagcaaggagcgcccagtgaaggcccaaatgcaggtgagaacttcgtggatgaacgagtgttgacagagatctgggcttcctctcggtggttctgggtcccttcaacttgttcccagcactcatctttcctcatgtggcccaagcac

SEQ ID NO: 146153 - DNA, 156 bp, Homo sapiens
tttttttcttaaatagtacttcaacagaccaaaatagaactgggatagttcttaaaaaataaaaagaccagaaacaacaaaaaagtaccacttctgttgcctccaacatgcattcatatgtagtgattgcacctccattctgtgtaaatatttcag

SEQ ID NO: 146154 - DNA, 208 bp, Homo sapiens
aaacagtactagagatggggcttatcctatgaaaatagaacactgctaacctggacattcacataattcattttaacaaaatgaaggagaaagaaaaaacaaaacacaacaaaagagccaccaaaaagcagtgcatgtcatataattaatcaagacaatttacctcactggaccttaattttccaggggtactactgaggatcaaaag

SEQ ID NO: 146155 - DNA, 308 bp, Homo sapiens
taattttgttctcaacattccatggacagtggccctcagtttccttcttccctctctctgtctttttttgtttgtttgtttttggtttcagatggagtctcgctgtgtcatccaggctggagggcagtggtgcgatctcggctcactgcaacctctgcctctcaggttcaagcaattctcatgcctcagcctttcgagtagctgggattacagacacacactaccatgctaggctaattttttgtatctttagtagagatgaggtttctccatgttgcccagtctggtctcaaactcctgagctcagg

SEQ ID NO: 146156 - DNA, 146 bp, Homo sapiens
agtgcagttaagaataagaaactaaagcttcaatatagcctcttgaaacccagaagagtacaaaatacctatcgattttcattttggagggtgagttctttatcaatggtgccttccctaaacttgtacttgagatggaatctcgc

SEQ ID NO: 146157 - DNA, 122 bp, Homo sapiens
ctcttgatcagaaaccatcctgaaacatggcttatctctctcttggggttgatccggtccctccagttggtctagattttctttgaagttaggaaccattatgcctttcactctctgcttcc

SEQ ID NO: 146158 - DNA, 362 bp, Homo sapiens
gcaccccctgctcaggctctgtggctgaccatataaagcgtcagagaaaaactggagctgcttcctaatacggtcacaagagggaaatcctgggcctgcagctgggacttgctggtggcacagggcccatgagatgccggctgggacacaggaggctgggatgttgaaacctctgaatttaaccagctggagaggggctcgtggggccagagaggcagaaacacagccaactatggttgggctgggtcgaggtgaaggagaagtggctgaataatgtgggaggaagagcccgatgctgaagccccacgaccctgccgtgagatgtgcggctgcctgcaccagtcttaccttcactccatcgt

SEQ ID NO: 146159 - DNA, 172 bp, Homo sapiens
tgggtggcccggaggctgtggtggggtgaccagttgggggtaacatggtaaggatgcttggaagaagaaagtgagagaagggggtcaatggaaagacataggtcagtgggctcacagcctcgtccactgtgccgggtcatccagtcccactcaggctccctccctcctgctg

SEQ ID NO: 146160 - DNA, 820 bp, Homo sapiens
atgtttgtcatgaccttgatcaccttaaccctggtctttccattcagtatgcctcctggtaaatgactctttagtgagtgttatgagcttcacgtttattctcatgaatatgtgtgggttcctaaggtctttaatcaatagcataaaatttagattttatttttaaagtgaaaagaaatcctaggattctttttggcactagctaagagagaaagtacgattataaaatatacatgatctaggccactctactatccaaaaggataattaaagtctacaggaaatattaatagttgctgcctgtcttcccaaagagaggtaaatcaaggtccttccatgttattttttttccccaggttagcagatgtatctacaattgatttaaaaaaatcagaatgacttatataagatacaaaacctaaagggaacatccttctttcatgtgttgtagtttttctcaggtccttgatccccaagccaaaaaattacttaaaaaaaaacaataaacctttttgagataaaaataaatgtaagccaggcatgctggttcacacttgtaatcccaacacttcgggaggctgaagtgggaggactgcttgagtccaggagattgacaccagcctgggcaacatagtgagaacctgtctccagtaaaaaatttaaaaattagccaggcatggtggcacacgtctgtagtcccagctacttgggaggcagaggcgagaggatcacttgagccttgaagttcaaggctgcaatgagctgtgattgtgcaactgcactccagcctgggcaacagagggagatgctgtcttaaaaa

SEQ ID NO: 146161 - DNA, 180 bp, Homo sapiens
cgtgtcctgctcagcgcggtgtcccacgggcgcgtccacagcccggggcgtccaggggctgcagcggtgcgagctgctctagagacggagggcccggccggagaccaggggccggcggtttcatcctgcgctgacccttgccaacgacgtggctggtcctggggatcacagggcttcgct

SEQ ID NO: 146162 - DNA, 216 bp, Homo sapiens
atagtggtacctccttgcggtatttatttgcatttcccttatggcttatgatattgagaatcttttcatgtgctcgtagcccatttgcatatgttttttgcttaaatattttgctcttttttgtgtatgcgtgacagagtctcactctgttgcccagcctggagtgcagtggtgcaatcttggctcactgcaacctccgcttcctgagttcaagtg

SEQ ID NO: 146163 - DNA, 236 bp, Homo sapiens
tctcccaaaacatgcttggtggcttaaaaagccctcacacaattgtaaggtcacatgaggctcagagcagctttctgcagagggaagggtggacaaacatcctcctcaccttgccaaatggggaggtgcctgcccaggtcacccggcagctcctggggctgcccctccctgacctgcacctcatggtgtgacctctagaaagtgacactttgcctccaaccctcagttcctcattg

SEQ ID NO: 146164 - DNA, 496 bp, Homo sapiens
acagccttcctgaagagaggcagaagttattagttgtttatgattctggtattgaggtcacctgcaaataactctgaatgggatatcacatccaaaagaaaccagtcggtaatggtgggatttctgggcactgtggccttctgctgtcctatagactgggaggaaattcagagcacaggtgtcaggggaaactaagaaggatgatgcgagggagaaagactgaatggtgagctttggaaagcaggagaccatgcattgtcattcattcattcattcattcattcaatgaacactgaatgcttaccatgtataaaacagtatattcagtccaggggcccaggggccaggactttagacactttgtatatgtttaattttctacctgatttttttaaagccttctgtaacctgaggaggttggggaggcagcataggtttcatgtcacatgacatgtcatccccagttgatttgttgtggctaaccagagagttctga

SEQ ID NO: 146165 - DNA, 301 bp, Homo sapiens
aataaataatttattatatggtaaaggtggcatttcaaatcaatgggaaaaggtacgttcattgacaaaggtattgaagcaacgggttaagatttggaaaataactatctctgctcccaaacattcaccatatgagactgtagacctaataaaaataaacataagattatgagaataaaatatcaataaatattttatactatcttgcagtgggataggaattgtctcactcctgctggggtgactccccataaccccagggctctcagttccaaagagaaaaagggaacagatgcctcct

SEQ ID NO: 146166 - DNA, 499 bp, Homo sapiens
atggaaaatcatgcacgaggtggatcacttaatttgctcacaacggatcgaaaccagtcatctccagcttcctcttttaattttccacacctgaattccctttatgggattctcagtttttccttttccaattagaaaatgatgcccaaaatagaaacagctcagaaaaggaaaggattatattcccaccactgtataacactacagcttttcaaagagttgacagagaaagaaaggaaagaatgagatgagcgagcaaaaaatggagcatttccggggcacttgggagggtgagagacaggcagtgagaaaggcatgaagaacttcacagttcaacttagaacctaggctgcttttttacataaaataaatgagattactgtactgtactacactacatcaactgaacctctgccatgggaggatacgagtattttatgcaaaggaggatgtacgatagcttccgtgtttctgcattgggagggaaaaagtttttgac

SEQ ID NO: 146167 - DNA, 322 bp, Homo sapiens
gtcccatgaatgaaataaataaaattgatatgcacttggaaataatttttaaaaatcagtgtggggttagatagcattctgggtatagtgtaccatatggccaaaaaggatatttaaaaatgtcctggaaaataaaaactgcatgacttgcttatgaaaccaaaaactctctgctctgcttaacttcttaaagtcactgttcttctcacatgcagattagagattttttgaatgactcctggtttgttatcccaggatcagaataaaacttaaacagttagcatatgtacacctgtcagtgagatagagtgtcttctttggg

SEQ ID NO: 146168 - DNA, 393 bp, Homo sapiens
tacagcgatcttcatgttgacaaaacccccaaatagtaatattttattttcttctttgtggtaattgtgcagcagcagtcaactaataacaccattcaccattctgctcgtcctaagtgcataataagtgtatttcatgaataatactgctacagaaactggataaaaataagtagagggggccaggtgcgatggctcacgcctgtaatcccaacactgtgggaggccgaggcgggcggatcacctgagatcaggagttcaagaccagcctggccaatatggtgaaaccacgtctctactaaaaatacaaaaattagctgggcatggtggtgtgcgcctgtaatcccagctacttaggagggtgaggcaagaggattgcttgaatctgggagg

SEQ ID NO: 146169 - DNA, 369 bp, Homo sapiens
ttgggaagaaggatggacctgagggagtagctggagcgtggagatttctgcatcccatattaactcccactgagagcatgtatcatagacagcagacagccagggagacatgatgacacagccagtggatgtcagccagcctctgccactggtcacctgtacatggcacagggctcatgaacacagcagccgtggtggcagggatggaggctgcgcgtgggcctgaaagaaggggctcccactcccacggctgggtagccaccactgctgtggaatgtccaacctgcctgcgacagagatcaatgctgagcccctgatatgacggcattccccgaggagactgaccagccacctggtagcaagctgatg

SEQ ID NO: 146170 - DNA, 311 bp, Homo sapiens
tttatgtattttatagcttttttagcatccattataataaatacataactattaaatatataactctttcatatgtaacagttaaaatcatattcttgctcagcactttggaagatactgctttgggcctaatcagctcatttttaaaatgaagattgaactaaagcttatgggcttgaaaattctgtgatctctatgatgatgttcattatcataacacaattctagcaaagtttactggttccaccagatgaaagtagattagggccgggcggtggttcatgcctgtaattccagcactttgagagtct

SEQ ID NO: 146171 - DNA, 172 bp, Homo sapiens
aggtggatcacttgagctcaggagttcgagaccagcccaggcaacatggcaaaaccttgtctattttttaaaacataagatttgactttgttgtggtataagttgtttcatagaatatgaaatttgaaaatttgagtagtatttggtaatgttcagagttttaagccttttg

SEQ ID NO: 146172 - DNA, 1016 bp, Homo sapiens
aaaatacatggatcaatgaaagacaacagatatttgttgaatgcatattatattctagattcagtgctagccaggatagatacgagtatgtataagacatagttcttatcctccagatggttataatttagtatgattgtattcagcttacagttatgatacctgttaaatagaccattagccatagtataatatgatcagtagtttatcagcaaagtgaataaaatgatattggcacattgatagggggtcatcagttatgcttggcaggtagaacaaattttagagaaaagataacatgcaatcgtggctttaattgaatgtgggccagttatggtggctcacccctataatccctgcactttgggagttcaaggtgggaggatcacttgaggccaggagttcaagaccagcctgggcaacatagtgagacccctctctctacaaaaagatttttaaaaatcaactaggcctggtggcatgtgcctgtagtcccagctacttgagaggctggggtgagaggaccgcttgagcctaggagtttgtggctgcaatgagctatgattgcacccctgcactgcagcctgagcgacagagtgaggttttaatatgagttgagcaataacccctaggtagtctcaaaaacaaaaacaaaaagatggaatgtgatttcagcaagtggaaaatggctagttttgcactcatgagcaaagagacatggaggtacctcgctttgcgtggcagatgttagcaggggcatgtgggaaggagggacctggtcaggtgaaatgggctttcacaggaccttgcctgctctgctgaattagccacaaaaggcttcaggcaggctgatggcctgatcctgtggcagaagaagatgattctggccacgttttgaaggttggactaaagtagagagaatgcttcattggataaattgaaacctcttttatatatgtattgtctttttatctcacccacaagattataaactcctttattcttaagattgtgtt

SEQ ID NO: 146173 - DNA, 520 bp, Homo sapiens
agctctgccaccgtcctgatgcacagagtgtgcactcaataaatcatggccctaattgtagtgggtattagctctaccagcaggtattgagtgcaaccaaagagtaatttggcataaaagatgaggattgtgcttccaggctgggttatatttgttatactcaccccattaattctgttctggggtcctcatttcttcgatgtttgctttccttccactcctgttctttcagagccttctgatactggagcgggagggaggtggttaccagctgcagcctcattacagctaagagagtgccactgctgtttatttacctttatgtgctttgctacccagctcccaaagtctttaaatagccacatgtggctagtgactactgtattggacagctcaggtctaaatagtcgttttataacccattttgcagatgagaaaaaatgagggttagagagttaagtaatttgccaaaggtgcccacctctgtagtcgcagagccacactttggacccgggtttcc

SEQ ID NO: 146174 - DNA, 291 bp, Homo sapiens
ttcccagttgggtcacagcactgtgccccattcctatgggccccccaaaacattgggaatacaaagtaatagtggaaaaaactgggaacaaatcgttctatgtgtttccaagtcagctgcaattttgagtagtgacctccttttaaaacatgtgcatggagggtgagatggcccgggtggggccatttgatgagatcaaatcagttactcatttgatccagagcacaaaggttgccccagcagcagggaatgggggacctgccctcgccctgagatcctcccacctcaaca

SEQ ID NO: 146175 - DNA, 119 bp, Homo sapiens
taaagacttaaatctaagacctgaaactatgaagcgactggaagaaaacattggggaaatgcttcaggacactggtctaagcaaagccatttagctaagaccttaaaagcataagcaac

SEQ ID NO: 146176 - DNA, 232 bp, Homo sapiens
acaacaaacctccgcagacctgcacctcttcctctccttcagtgacaccaccattcatccaggagttcaaaccccagacctaggacacatccttgaatctcccccttcctgtacctccaatattcaagccatgagtaaatctcatcatctttacctctcaaatccagcctgcccatttctcagcacataactccgccaccatatcggtggcaagggtgccgatgaatagcga

SEQ ID NO: 146177 - DNA, 128 bp, Homo sapiens
ctctcttatttaaccactaagtattatgctgaccttatctgtagtctaaatgttttatctacacctaatgaattgtttaacaattactattttattaagtgtgttttttattttttattttttttgta

SEQ ID NO: 146178 - DNA, 661 bp, Homo sapiens
tctgggggccagccttcatccaggccgaaggtggtcagtggcccaccatggcccaggtagaaaactcacggattaagatttcatgcccgactccaaaggcaagagactttattattttattttttttgagccagagtatcgctctgtcacctaggctggagtgcaatctctgctcattgcaacatctgcctcccggactcaagcaattctgcctcagcctcccaagtggctgggattacaggtgcgagccaccgcacctggctaccagacacttcagagttacaggttagtttttctttttcttttatttttttttttttggcggaggtgcagggggagttaaacaaacaaacaaaataaacaggccgggtgcggtggctcatgcctgtaatcccagcactttaggaggcctaggtgggtggatcacgagatcaggggttcaagaccagcctggccgagatggtaaaaccccgtctctactaaaaatacaaaattagccaggtgtggtggtgcatgcctgtaattccagctactcgggaggctgaggcaggagaattgcttgaacccaggaggcagaggttgcagtgggccaagatggcgccattgcactccagcctgggaacaagagcgaaactctgactaaaaaagaaagaaagaaaga

SEQ ID NO: 146179 - DNA, 772 bp, Homo sapiens
aaggctcttacacagagaagagccggcatgaagttcaccaggatcccagggtggggactgggaggtggaagtcgctggctttctggcatggtcaccaagtaacacccacctgagatgttctcccaaagtcttgtggtggttattgttttcaactccatctttaagagcacatatgaagaagttatgtagttgggattaaccaacctgtcagctgtgggcccttgtgttatcaagttactaacacaattaatagttctaattacatagtttttagttcaagtttaattccactaaagtgtcatggtgaagctagaccaattatgaaggtttatggataaaaggatagtgataagattaaaggttatcatatatatgattcacagttgagacacacaagatacttgcaaaccaagagtggtccttcttgttctacgaacagcaataaaagtaaatgtgcccctcacctatacagatttctaaacatctggactcttactgaaaatagattgaagcctctgctctgagaaggtcatggaaggcctaactgcacaatggccctcaggtgggagagtgggctaggccctccagggttacagggagctctgcacaggggaagaaggacttaaggtggtagaaagccactgtgattgccaaggtcagcaaaagtggagttctcacccctgagggcaggacaaagagttcccaagattccaacccaggaggtgtttacaaacttagggacataaaccagggaagtctatgagagccgtta

SEQ ID NO: 146180 - DNA, 449 bp, Homo sapiens
aaagaaccaaactgtttcatccacagacttttaaaattcaaacatgtagttcagagtcagccggcactcaataaacattaataattaatgttacttatcccaagtaatttagaacaaagcatggcagagagaggggagtgtaatgggttacatgggaataatgaccaactcttacgtttttagcagtaattcaataccccctcatgtctgtgtacatagcaattcagagtcccacagaatgtgcacaagtccactgccctcaagactacaggggtgtacatcacaacaacattaagaatcttcatatcctttggtatgttgttatgatcagcagtaccacttgtggaaatgtacactgccctggctagctcttttgttgatccagctccctccctcttccattaacaataaccctcttctttgtgggatactttgtctccccacagccc

SEQ ID NO: 146181 - DNA, 146 bp, Homo sapiens
gttggttcctctgtatgtactctctcctcgcctagaatccccagtggctttctatattggtgtaaaagctgaagtctttaccttggcctatgtgatatgtggtcatcacttccccacactctgccacccaaatgctgttactcaaa

SEQ ID NO: 146182 - DNA, 156 bp, Homo sapiens
ttgtcctaaaagacctcataaatttctttaaacatgcaaaggagaggctccttttcaatcagaaagactcaggaaatgtcaaacctgaaaagaaccgtagacatcacctccatccctcactttataggtgactgaagtgaggccctaagaggttaa

SEQ ID NO: 146183 - DNA, 469 bp, Homo sapiens
aggactgggtgaaaatgagggactgagctaagccagtacaattttccagaatttgtcactctggtgaatcattccacctcttcagggaggatggagtaaagtggacagagaaagatcttaaatgcgtttaggaaaacaaaactccgtctttatggaatccacaagtggcacaaggcatcccctcctctagccctgagactctaggggcctctgttgggagggccaaaggaatgaataaaaacacatgtcaaatctgcaactgtgatgctccactgagtctcctgacaggacaccgttaacatctccgcaacaccaaagtcaatgaaaaatcaaacacgataagtgttccttctccatttcctccactttattaatttttttgcagagccttagaaaaggtcattgtaggagattacagtataccccaaaagtctttagagttccccagaggaaatattgtaaccaatag

SEQ ID NO: 146184 - DNA, 410 bp, Homo sapiens
tgagacagagtcttgctctgtcgcccaagctggagtgtagtggtacgatctcggctcaccgcaagctctgcctcccgggttcatgccattgtcctgcctcagcctcccaagtagctgggactacaggcgcctgccaccgcacctggctaattttttgtatttttagtagagatggggtttcaccgtgttagccaggatggtctcgatctcctgacctcatgatccgcccgcctcggcctcccaaagtgttgggattacaggcgtgagccccccgagcccggcctccacttttcttaaagttggagaaaaccatataactacaaagaacagtatcactgtaaattcatggtttcaattcatctggatactcaatgctattgaataacctttaaataattgactcagctcta

SEQ ID NO: 146185 - DNA, 708 bp, Homo sapiens
agggggctgcccctgaccgtgggtcctgttgctcacatcttcccagggactctgactctcaactccccaaaggtcacagtcaccctatccaggaaccctcatgttcctgatgcctccaaactctgtgggacccccagcttctatagagcccaacatctgaaatcatctgtgagcttaaaacccttctaaactttaaaaagcctccaagcgccgggcgcggtggctcacgcctgtaatcccaacactttgggaggctgaggcaggcggatcacttgacatcagcagtttgagacctgcctggccaacatggtgaaaccccatctctactaaaaatacaaaaaattagccaggcatggtggtgggtgcctgtaatcccagcaactcaggaggctcaggcaggagaatcgcttgaacccagggggtggaggttgcagtgagccgagatcgctccattgcactccagcctaggcaacaagagtgaaactcttgtctcaaaaaaaaaaaaaaaaatattagccgggcatggtggtgtgtgcttgtaatctcagctacttgggaggctgaggcaagagaatctcttgaactcaggagacagaggttgcagtgagccaagatcacaccactgcgttccagcctgggcaatagagtgagactccgtctcaaaacaaacaaacaaacaaacacctctttgttttagcactcacttga

SEQ ID NO: 146186 - DNA, 347 bp, Homo sapiens
aaatatctcataaggcaggtaatatattattatccccattatacagatgagaaaaataagtttagaggtgttgagcaaattacccaatactatatcgctgttatgtttcagagaaaaagaaaaaaaatagaaaggatgagagagaagaaaatgtataaagcgaggacaatgtatagaactgtaattaaaggcttattttagggaagataggccagattcagtaatcagccttttctttttttttcttcctgagacagagtctcgctctgtcgcccaggctggagtgcagtggccgatcccagctcactgcaagctccgcctccctggttcacaccattctcctgcct

SEQ ID NO: 146187 - DNA, 179 bp, Homo sapiens
atgaatattttatagtgccttctgagggcaggcccaaggcaaaagaataacgtcattatgctgttgggcccagcggtatgttacaatctttgctgcaggtggaacctagaaagaagagaggagtcacaccagccaggtactgggcctagcagtatgccacaagatgttttgtgagaagg

SEQ ID NO: 146188 - DNA, 241 bp, Homo sapiens
  misc_feature (177)..(177): n is a, c, g, or t
tatccatctccagaagtctttcaccgtcccagacagctgtattttttaaaatagtcggatttatcaaattcgtttaatcttttatgggttttgtatcacagttagaaaggcccttaccgctctgagtttatttgttttgagacagggtctcattctgttgcccagggagatgcgganagctctaggattggatttctgttgcgtttcctccatgtttggagggtgtcggaatagagtctga

SEQ ID NO: 146189 - DNA, 116 bp, Homo sapiens
ttgttagtgacagtctacatttcatatgaacctatgaatttcattcacatacttttcaactttcctttcaagccactaaaaacaatgatgaattaaactgagcttttaagtctctg

SEQ ID NO: 146190 - DNA, 609 bp, Homo sapiens
tgtagttatccaacaaatatttcatgaaaattcatttttttatccttctgtgtgtcacaaggcattatataatgtataagaatggagcttacagtgcagaaggagctgatggtgataaatttcacaagtaaaaataaagttcagggttaagatagtatcttattctctattaaatcagaggattaaccttcctatgcatttccagctacaaaatgtgacccatgatgaggtgagtgaagtcaaatcagcttttcaagactatatgtaaaataacatgaatagaaagaaatacttcaaatttatagaatgttaatctgtatagtctttgaggttaaattgatttagtatctttgactaaaacttatgaatcagtgagaatttgatggggaaatatgagcatgtaatttcgatccatcatctatctttatttgttggtttagagctaagcatatgtcagtattcccagtataggtctttcaaggtatgtctctgtatgtaagggtaatataaccttgtgagtatgagtatgagtgtgagtgtgtgtggagaaatcaattgcttattaatagctttaggaaatggtattagttatttagttgcctaattggg

SEQ ID NO: 146191 - DNA, 471 bp, Homo sapiens
gataggaaccgcatgcagtctcctgatagacgagggagtactcatgagatctaatggtttagaagtgtctggcagttcaccctatgcaaccatgtatcactctgtctctcctgctgtcatgtgaagaagaggtcctatgcctccccttggcccactgcacctggctagaattaactttttcaagagattcacataaccaaagcaatagaaaattctccttgattactttaccaaaaagcaacagcgatctaaaaataggatctttgtacattccagttggcctggaacaatccctgtttatgcctgttgtctggacttattaataatgtttccttttctctccaaagtgacctggtttgctaaattacattattagtctacctaaaaaatgattcctagagttgtttgaagaatagtataaagttttcattgtttctgttttgatttttttgtttgtttgttttattatta

SEQ ID NO: 146192 - DNA, 424 bp, Homo sapiens
acaatttagaaacaaaaaaataaataatatagttagccaggcacagtggctcacacctgtaatcctacactttgggaggccaaggcggacagatcgcttgagctcaggagttcgagaccagcctgggcaacatgttgaaaccccgtctctataaaaaacacaaaaattggcctggtgtggtggtgcgtgcctgtagtcccagctactcaggaggctgagatggaaggattgcttgagcctgggtgatggaaccagaccatttctaaataaataagttatttattaacctattatggtggcatgtgtctgtagtcctagctactcaggaggctaaagtggaaggatcacctgagcctgggagatagaggctgcagtgagctatgatcacaccactgcaccccatcctgggtgacagagtgagaac

SEQ ID NO: 146193 - DNA, 815 bp, Homo sapiens
caggatgaaaacagcatcaaccacattggattattttgaggttgttaaatgaggtaatacatttcaggtggttggcccatcaataagcgcttcttcctaaatatagttttgttatctatattatgtatagatttgtttttaaatggtaggagggagtatgactaaaaagcccctcttttttttttcttgctaccaatggtaaaagccggatgatccagttgtctataatagccatgcatttattaaaccctgtgggttataacccctctgtttcttatggttcactatgcccagagcattcaagtgtttagtaaagttgtgaaaggctttgcaaatatgagggatgatgcccattttctggtaggtttcttatggggttctttcccccaacatacacatttctcagtgattgtcccctctttgccctttgctggccatgtgaaatgcaggaccacatcttctccaacagatgaatccacattaaagccactcactgacctgctttctacatttaaagctactcaactttgctatgtaattgtaaggctcccaaattcaaagcatggctagtgagcaatggatgagggtatacctagtattttttccatagacttatggaatctcatgcatggaatttagatatcaggcctccctgtcctcatctgggagtgctgggattcatgagctactcctatgtgctctgcagtacgttctggtgtgtttaaggtaaggtattattctgtttacataaatcaccctgacatcttgtactttttcatggattattacttttttaatgaggtaacagaaatgca

SEQ ID NO: 146194 - DNA, 293 bp, Homo sapiens
tctagccactcactccactctgacaggtgcaaccccatctgtgaatttagcaggtttttaacaggatctgccctcaaaaggtggctattttaaacaacacgcaggtgcccctgcaagagctaatgtaagcattgtcaacttctggcaggtgaagacattgtgtgtcacagtgagtggcttgcctggtgtcacacaggcagtggtcgtgcaagccggtgcttagctgtggttcagtttccctctgcactgctcgcagtctcacctgtcccaagccgaccacctctggactttga

SEQ ID NO: 146195 - DNA, 424 bp, Homo sapiens
aatattcctcacatgaattttcagccccacaccgactctcccaccccccttctgcagtactggatgcctacacattctgaggcttcccaaagttaaatctgacaagaaaaaaaattaaaactgatcaagaacaaaattgcatacataccataattacaactataaaaaaattaatatcactatatgtgaaagactgaaagggaataacacaaaatgaaaacagttgttgtaataagcaccattttttaacataattcctttgtagtatttaatttttccattaaaaaattttaacataactgagtcaaaggagtttaaaacttcactcaaactttctaaattagggagtgtcatcaagtaaggtttcattggtcagacaccactttcacagggccatcagttcacccatcccacaaagaaacaa

SEQ ID NO: 146196 - DNA, 240 bp, Homo sapiens
tgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgta

SEQ ID NO: 146197 - DNA, 491 bp, Homo sapiens
actggaatatttactatagtcaggggaatgtaatctttaaaacatcagtaaataatgatggtccagaaattatgatgatgcgtatttcttcatgcacattagtaacttcactaaccacaatttttagctgatttgctaggatttttctttaaacatatggaggcaaaaggttttaagaatagtgtcaggggcattatttaatcagtgttagttctgacaggtgaacaacctgagttggtctctgcagatagtacctatgaaacattaaggtcagattgattcagctacctggtgtgtaagataatgcccaatttatagtttcctttttattttttctggtacttctacaaatataaccctgagcatagaaataccctcattattttaatgggacatcctatttctaccatgcaatttgagcttgatctgagacatttctgtgaagtgtgaaagtacagttaatcattcttaaatgttctttttatgcacaa

SEQ ID NO: 146198 - DNA, 877 bp, Homo sapiens
ccgtctatctatccgttcatccatctgtccatccgtctgtccatctgtccatctatccgtccatccctccatctatctctgtccatctctccatcaacctctttagccatctcttctctatctatccacccactgctccactcacccacccctccttcttccttcagtctgtctggcttccctgcaccttcccacctctggtcctgcccctggtctggacaggccatctcaagcctccagtctcttgaccgacctcagccccagcttttctcagcagcccaattaggaaggctgggcagatacctgctcagaggagaagcctatggcccagagaaggcatgggcttgcctgagtccctccttctgcagcagggacgaggctcactgggccctggtgtcctaacttcctgctctctggcaggtgtcccctgtcctgggcatgatcacaggaacactcatcctcattctggtcccagccactaaaaggggtcatgccgaccagctcggggaccagctcaaggcccggacctcatggctccgagatatgaaggccctgattcgaaagtgagtaccgcgggaaggggtctggtgggaagagagaggggtgctgagatgagagggcctgtccctgcagggcagcccactagcaccctcagccagacaccccacctctgctgtctcagtgctgggagggacattttggccccagaatcgattattcctgcagcctgaaccctcacccctggagcctgtaagacgaggcatttgggggcctcctgttcccccagtgcatggggctgcctaggggggtgaaggaggtccctgagctcagtgtcactgcctggcctctccccagccgcagctacgtcttctcctcc

SEQ ID NO: 146199 - DNA, 377 bp, Homo sapiens
catgtatagcaattgctgactctagctctttttctttcttcctctccctcagggtcaggtgacactttgtctgggtaatgcaacattaactcactccctttaacctcttggttatgtagcaacataagtgcctgaatgtaggggaatttttaaacgcttcctcccatttcctcaaacattgacaaaacagctgtaactgaaagatataatagcttaaagaccccaaaattggccaccattttttggatcctaaagcatacattagccaaaccatattacaatagtaaaccattttcctcttagtcatgggggtaacctcgtactatttccaatctgacagcatttttcccagagggctccctgagggaaggaaagca

SEQ ID NO: 146200 - DNA, 468 bp, Homo sapiens
tgagtcaattaaacctctctcctttataaattacccagtctcaggtagtacctttatagcagtgtgaaaacacactaataaatccctcaaagtgatgtatagccttaatgaagatcaatcaaattcaagcaagctttataaaaaaagcaattcaaatatttatagaaatgcaaaaacttagagtagcgaaaacaattgggataaagaacaaagttgaaggacttgcactaactgatgtcaacaattactataaatctacagtaatcatgacagtgtgatattggtaaaaggatagttagaagccaatggaaaagaatagagaatacagaaataggccaggcacagcggttcatgcttgtaatcccagcacattgggatgccaaggtgagaggatcacttgagtgccagagttcaagaccagcctgggcaacataacaagaccccatccctaccaaaaaaattaaaaaa

SEQ ID NO: 146201 - DNA, 327 bp, Homo sapiens
tctacccataagtgacggatgctatagctagatgtagccagctcatctgagccccctccttctgactccatttctatgaagctgtcagaaatctctatagaaagagaatgtgttgctcatgccaacttccagtggtctgactttgtggcagtttcactctggtggcctggcatcagccgtgattacatggccttagttaagagtgaatacctgccaatcagatggctctgttcttggtgtctgtcccagtcagggcctggccctgcagagctgagagctagaccctggaccaaggtaaagttcacagaggctgtaaatactacttgg

SEQ ID NO: 146202 - DNA, 711 bp, Homo sapiens
attttaaagtacatatgcacattaaaaaacacaagtcagcttttatttttaagactgcacaatactgactactagatcatacttcaattcatttatagataaaccaaaatagaaatggaaaaatgacctctgcatctgaactcatccaaggcctagaatagtgacacatcttacctctacccacagttgttccactgatagatatttctctctcctaaatcccctttaaaaaaccacataaatatttcatgccttgtttgtgagatatttcgcaaagattccttttaaggaagatgttaaactaacattcttatcttccatcactagaaagttttcagaacttttagagcagaaagtcttttccacaggaaagttaggctggaagcccactcatctttcagggaaaaactggaaattaaccttcacagcagaaaataaaaggtatatgaaattttaagccataacccagacataaggggttcttcttgatcaagtgagtccctaagtacgcagttttctgactggaagataaaagaaaggctcaccccaagatctacagtgttcaaagaaccaagtagattattttgtaccgccattcagaaattgtaaaaaatcatccattaaattaagacatgcctaagaaattattatttttaaattaaaagattccattcatctggcacaccttactggacggggatcctctgaacg

SEQ ID NO: 146203 - DNA, 916 bp, Homo sapiens
aatcacttaataaattcagcttaatttgaggtctagagagtaaattgtgtagttgtgttttgctaaagaaaacactttagcttcgcttaagaaatttaagtgaagccactggatttagtgtttttacggtattttaaatatttaactttgttattctggttaaagagaaatctaagggtaagaattttttattttcagatgatggtgatggattttaaatttttaagttaaaaaatcttattcagaatttctgcagatctgatatccttcagtattaaacgaaatgtttctagtttttaaaatcctgtaaataatactaggaactatttgattttcatatagaaagttttcattttcttttgttttaactttgggtagctttagtataatccagttggcccttgaacaaagcaggggttagggatgccaaacccacacgcagtcaaaaatctgagtataacttttgactcccttaaaacttaactacttataactactgttataagcgttaccgataacataaatagtctattaacacattttgtatatttattatataccgaattcttacaataaagaggataaaaaatggtattgagatcataaggaaaatatatttactgtttattaagtggaagtggatcaccatgaaagttttcattgtcatcatcttcatgtttagactgaagaagaagaggagggattggtcttgtgtcttgggggtggcggaagcagaaaagaatctgcatataattgcactgtttgaagtttaaatccatgttcaagattcaagtgtataacaacttcagtgtaaatacttactacttacttttaaatacttgattcctaatgttttagtgaaaccctactagcacccatgaccctgattaaataaatttacttttttcctgcttaa

SEQ ID NO: 146204 - DNA, 490 bp, Homo sapiens
  misc_feature (246)..(246): n is a, c, g, or t
tttcatgctgacttcttttgatcagcattttgatggcaagattcatcaataatattgtatcaagctttattttgtttattcttgttgctctgtggtatttccttgtatgaatataccgccacagtttatctaatctactgctgatgaacatttgtgttgtttacagtttgaggctataatgaatggtgctgctatgaacatacacgtgcatgtatcttcctaacagaatgacgtatattccttggngtatatatccagtaatgggattgctgggtcaaatggtagttctgcttctagatctttgaggaatcgccatactgtcttccacccactgtgtttaaggcacaatcaacacataggccaccatgtacaaggtacctggctacggtgccactaataaaagtcattcaagacacatatgtaaatacatatagtgcaaagtgtagggtacacactatgtgcttagtgtctactaaaacacagaacacag

SEQ ID NO: 146205 - DNA, 107 bp, Homo sapiens
aaggctcagacaggcaggaggctgtctgcccaggaaggcaggtcagaagctgctattaaccactctggcagggcagtgtttctgtcagcctgcagagcacttcaggt

SEQ ID NO: 146206 - DNA, 120 bp, Homo sapiens
ctagcccctataaactgcagtctgaatgcagtcctgcccacccaggaacctgccaggagtcacactgtatgtaccctgggaagcaggcttgctgaactccatcccacagcagatcctacg

SEQ ID NO: 146207 - DNA, 276 bp, Homo sapiens
agataccacttggtgagaagaagattctcctcctctccaggcccaggtaataaatagatcctcatccccaggagaaggcatggctgtttcacacaagggtagaagtgtgtgtggaaaccagagatccacctgggagccttctggtttcccttgccccattgtaagtgtgagcagaatcatccagcaattcagcctgagaggatttgatttccaagggcccagacccgtcagggcagaaggtttgagtcacacttgtgggcaatctcccaaggccct

SEQ ID NO: 146208 - DNA, 1014 bp, Homo sapiens
aattgtttgggccttaagaaggggaaaaaaaaaaccttttgagaaaaatgagaaactcagatgtatcaaaatgccttccttatgattacctgaggctttaggtttttaaaagcctttgtacctaaaggttctgattcattctctattgtggcaactttttcctaccagacaaaactgaaagattttgtttctttaggaaacatacttaaagaagtatagtagacctggcattccttttgcatgctctggtagaccccggctcttgtataataaaaacaatataggcatgttatatttgccatatgttagttagggggtttcagcaaacaaatacctccttgtgcacagaagtagatgaaagcaaagcttactgatgtctactatgccttaacttaccttcttggtcctacatagtctgccagacttctttctggtgggtggtatgcatattgggataatgggtgatagctcagcatattctttatgcttggttccgctctgaggacagctagtacactcgattcagtattatatgctttcctatttccttgcctgatgcttctgtgtaatgctaaatctcagtttattctgtcagtaaagttgaggagagtgagtgaggagtgcgttgcatgtgtgtgtaacttatctgtaaagttgaactttggttatgtttaaccaggaaaatcagaggacaaggagattaaataaatatattcggtgagaatctcagggtatgcattatataaatgggggttgagataaagtctgagtaacagtattaaatagggaagggggttagaaagaagttaaagaagcatgaaacagtgttaaagtaaatggatagaatcaaatagcagaatagacaaaacggaaactgaaaagagggtgtccggaatggtgtcaggagaagattttagaagtagagaatatagtaggagaagataaaagaataaaagaagatgaaaaaagataagagtggataaaacaagtgtatatggtgattatagtgatggc

SEQ ID NO: 146209 - DNA, 223 bp, Homo sapiens
tccaagatgggagaccccttacggaccagctaccacttttctcactggacagttaggaagattgacggccagagaagggcagggatgtgcccaaagcaaggatggtaacctgtgtcccctaattacgtgggactcctctaatgggaaaagtagccagcatatattcagataattagctgtgatcagtgtgtgtgagcaaacccagccacgcagtagcatgctg

SEQ ID NO: 146210 - DNA, 197 bp, Homo sapiens
tgctggggttacaggcgtgagccaccccacccagctagttatgagtttttctgtcttgcctctctaaataagccatgttcctgtgccttccacttgtatattccttagaatttttagtatagggcctgcatgtggtaggccctctgtaaagagctgttactttgatagtgtgtgaattatagaattagaactctgag

SEQ ID NO: 146211 - DNA, 228 bp, Homo sapiens
ctacctcagccactgtagggaatgtaataacgtctgaaaatcattagaaaaacaattagcatacacaaagatttatgatcttaaaaatcttagtcgtttagaagctctgtgaatcagatatatttgaataaggaagaacaaatagcaagtcttatatcaggatcagcaaatcagtattattactgctataatcaggataaaaattgatacattatctttaataaaaga

SEQ ID NO: 146212 - DNA, 329 bp, Homo sapiens
cgcggaccttatgttgaccactggctgagtcaggagtgtgtgtaacctgcccacctgcccaggctggttagaagcaagcgtaggcgttgggtctgcctgtcctggtccaggcacctctcctggtttggccaggttttggtttgtatatgttcctgatgttgacgtgtaaatgatatcgttacaaagcaggtagtttgctttgctattctacgaataacccaagaacctgaggataataggacacgttaacagtctgctagttgagagttctgtttctgtgacttcaggggacatatgaccatcccgattgtggtgggtcagaacataag

SEQ ID NO: 146213 - DNA, 250 bp, Homo sapiens
ccccttgcggatctcatagcatcccctccctatgagactgaggggtatatcctgaattcagacaatttctgggcaagatataatctgccttttccccaaattattctggatgatgtggaagcaactcctttgttagcccaataaaaaatacgagtggttttactactacctgtctactctgattgaaagaaatcaaatcatcctgtcctgaatctgttctttttcctcaagtgccacttctatgaagccc

SEQ ID NO: 146214 - DNA, 437 bp, Homo sapiens
acaagttaagaaaaaaaatattaattggattttacaatagggaattctctgtgatcttaacaaaagcagtttcattgtaggtgctgagtatcaaaagcagatttgggggatatggaaatataagcagaaggtaaggagttggactcagcagatatagacaacatggctgcaaatgcagagagaaatacaaatttggtgttagaatggtgtgtaaattctctgatggcttccattttcttagaagtttgaaagagaagtcgatggtacgattcagtcgttccacaaagtggacaaagatcagtaagagaagtatagtaggattgctgcctcaacatgtgttttcttacaatttgtcattagaaattcaaattgaatttagtagaactggtcattagatttctgcagcaatgtttaactgcttgcatgtaggcatagag

SEQ ID NO: 146215 - DNA, 420 bp, Homo sapiens
ttgggaccccctgcgcctggtttctcttaattctacctccccttgctcacacgacttacatcaaccccaaagaggccagtggcattttgcctattatgataggagagactaggtcctatttaagtctttcgttgtaacagtcagtaaccctgttaaattaatcatgtgggtcttggctacttttatcagctgtggctccagtggcactctaattttcacagactttgaggtgttattttgttctgcttgattaatctggttgcaagaggccactggttcctgcctctaccccactgccttgtggggcagaacagatttccccacactgggcctcaggtatctctcagtgggagaggaatacggtggggtctgccatctgcctcagtgtctttgggcagggaaggagagtctcaggcatgt

SEQ ID NO: 146216 - DNA, 828 bp, Homo sapiens
ctcagatggagatgaggaactttttgggaactggagtaaaggtcacgcttgctatgctttagcaaagaaactggcagcattttgcccctgccctggaaatatgtggaactttgaacttgagagagatgatttagggtatctggcagaagaaatttccaagtggcaaagtgtccaagaggaagcagaccataaaagtttggaaaatttgcagcctgataatgtgaagaaaagaaaaacccatttcctggggagaaattcaagccagctgcagacatttgcataagtaatgaggagccaaatgctaatcaccaaagcaatggggaaaatgtctccagggcatgtcagagaccttcacagcagcctctcccatcataggcctggagacctaggacagaaaaatggtttcctaggctgctgctattctgtgcagtgtcagaacatgttcacctgtgtcccagtgacttcagcttcagctgtggctgaaagaggccaaggcacagctcagacccttgcttctaagggtgtaaaccctaagccttgcagtttcccacatggtgtttggcctgttggtgcatagaagtcaagaatcgaggtttgagaacctccacctagatttcggaggatgtatggaaatgcctggatatccaggcagaattttgctggagaggcagagccctaacagagaacctctgctaaggcagtgcagaagggaaatgttgggtcagaactcccacacagagtccccactggggcactgcctagtggagcagtgagaagagggccaccatcctccagaccccagaatggtagatccaccaacagcttgca

SEQ ID NO: 146217 - DNA, 623 bp, Homo sapiens
tgcattaattgccaggagcaatgaaggctcaaccagggtagtagtagcggaagtggtgtgaggtggtaggattctgtttatgtttttaaggtagagctaagagtgtgtaatgattggatgttgagtgtgagagaacagtatctgggacaatttccaagatttttggccttagcaactggaagccatagagttgccattggctgaattaggaaagcctgcaggaggaccatgttttgtagggaaagattaggagtttagtttttgatagggtaagtttcagatgtctgttagacatttcaaatgtagacatcaaataaatagttggatctatgaggctggcttttggaatagaaaatgaagttgcagatacaaatttgggagttgtcattatatatataaattgtatttaaagtcatgagcctggatgagtcgttcacatcacctagggaatgaatgttgataaagacagaagcagtccatgatctagtcttaggatggtgttgtgctatcatgagatgggggaggaagtaaagtccagcaaaggaggctgaatggagggaacacagggtaggaatatcacttatagtatgtggtgtcctggaagttgcaagaacaaaaatatt

SEQ ID NO: 146218 - DNA, 246 bp, Homo sapiens
cggggcgggcgtagggggcaaaacggcatcccagctcaaagaagaggcccaaaataaagttcaaccaagaaatgccttcttgcctgatgggcaagtgcaatctatatatttacatagctttattatgactgaataagaaaatatctttttcagcttctgagtctagcaatgaatctagatgatgaagacaccatagataaatgatcttcagtttaaaagctgaatttcagttaactgcatgctttc

SEQ ID NO: 146219 - DNA, 336 bp, Homo sapiens
caaattattttaaatggctcaaccatgccaaaggatagcaagtttactttaaatcagccatcttctcaaaaagccacttaaaatgttaaatgtttctaagaaaaataacattatttttagtccatttgtctctatcaacaaaatattatatccccttttgatacacattcttccctacaaataaagcagacaatgtgctcttttagaactttcgtttatctttgtaaagagaaaataatacaaggcattcactgtggcactcacagtctgctttctctaaggacaagcctatctatactcaacagtcagaaaagcaaatgatctggctggaagggt

SEQ ID NO: 146220 - DNA, 143 bp, Homo sapiens
ctgcctcaagtcttccagatgagggactgtggacctacacctagcactcaccacagtatttggcaccaaagttagttatcatctatctcaccacccacccaaaggcaggaattatgacagtttcatctccacaggaccaggca

SEQ ID NO: 146221 - DNA, 487 bp, Homo sapiens
atggagttaatcctagctcagtgcattttaaacagctttttctccctatatgactgtctgataggatgctctgaggcctgggggatgtaggaaagtctgcatttggttgcctgaacatttcagaacggatggcattcttagtaccctgcctactatttcccagtaagacaccacaatcattatgacaaccaaagtgcccacacacattccaacagtcccctagtgaatgatatccccctgttcataaatgtgaatccagtcagtggctcctgattttaaaaaatggaggtcacttcactctgtctggccagaggacgtggctggacgtccaactgggccccttctgacaggccctggattccacagctgggctcactgggatgtgggtgtcagctaggcctgctttccaggtaagtggctcacttctgcatgccaccctcttggcacagacactttccgacgttatttcatttgagccttaggacaa

SEQ ID NO: 146222 - DNA, 373 bp, Homo sapiens
ctccttttcccattctcagttaacagcatttcaaccagttccttatgtgaaacgaccgcgtggtttctgttttagacatttccctgactggcccacctgtgatccccgtggggatcctatcctcatctctcgggcctggggcccctctgcaggaaactcctcccttgtggttttcactcccagaggcacaagtgtccctattcactggactggctgtgctgactgtccccaagtggggacagcagggcctggctcttccacagcactaccctcaggacagcccaggacccggcacctggcgagcattcggcggatgtactcaatcaatcaccgacgcatcttccaaagcctcctgcgagatggagacctcact

SEQ ID NO: 146223 - DNA, 405 bp, Homo sapiens
gaaagacttttattttttgtaaaatgtaaaatactgtggcaatgtcagattgctataaaaggttttcaaatctgtacttccaggtacttcaaaattagtttgcagattagtaccagtggtcttagtacaatttgagtagctacagtaagtaaggagtcgatacaaaagaaatacagcatattgtcaccatcattggtgtaagaatgttctggggaggactaggcttacctatgtaaccagtggaaaatgcagcatatggtacaattactaaagataaatatagacataaagaagagcgatgataaaagctgttctggatcccagttaaaatctttggggttactgcttaactctctggactcacagccccgacccaccatccccaatgtgcagtttcactcatgg

SEQ ID NO: 146224 - DNA, 370 bp, Homo sapiens
catatgactatctgttcaccctggtgaactcagtcgtcaaaaccaggactggctggtccacctaactcattcctccttgggaggtgcccacctcgcctctccaagctgccagccagcagcaaagaatgctatgactatggcgatgggccttctgtctcgagggtggcagctgccagcatgtggttccagcccacagctcctaaactatgagattctcagttcaaaggcccaagctccgagttgtgaggtggtctggagcctgttggaaagaccaccaagaatgcccaccatctgctcagcctcacctgtaatgaaaaccagctgcctgtagccaaggggccgcctgggatacccctactttacatatccc

SEQ ID NO: 146225 - DNA, 288 bp, Homo sapiens
ttgctcaaggccagggacgacaccacagactggggcgggggcggggctgaagcagcagacatttgttatctcacagtcctggccgtcagtccaaggccaagtgtcacagggctggttcctcctgaggcccctctcagtggcttgtaggtgctgttctttccccatgtcctcacctgaggcctctctccgtggcctgtagatgccagcctctccctgtgtcctcacctgaggcctctctccgtggcttgtagatgccagcctctccctggcctgatcctcacctgaggc

SEQ ID NO: 146226 - DNA, 402 bp, Homo sapiens
cggttttcgatggctgccacctgtctcagtctgctccagctgccataacaaaacaccactctgggtggcttaaacaacagacctattttctccagttcctgaggctggaagtctaagttcaggctaccagcattgtggggttctggtgacaccctcttcctggtttgcagatggctatcttcagtggcagagagaaagctctctggtgtctccttctgttttttgggaggagtctcactttgtcacctaggttggagtgcagcggcggatctcgcctcccaggcccaagtgaatctcctgcttcagcctcctaagtagctgggattacaggcgtccaccaccatgcctggctaattttttttttttttttttgagacggagtttcgctctgtcacccaggct

SEQ ID NO: 146227 - DNA, 291 bp, Homo sapiens
taactttatttctttttgccttttaaaaaatgtcatgtaattcttcagacttggtgatatagcttgaatctgtgtccccacccaaatctcatgttaaatggtaatccccaatgtaggaggtgggacctggtgggaggtggttgtacaacattaagaatatcctaaaatgccacttaattgctcacttttaaatgaagggtaaaagatacaaagtagcagatatgtaagatgaacaagtctagtgatctaatgtaaaacatgaggactatagctaataacattgtactgtat

SEQ ID NO: 146228 - DNA, 252 bp, Homo sapiens
cagcctcctaaagtactaggattacatgcataagccactgtgcccagacttggcttcttcaaaggatgggattttgtagggttagggacacactttccctctcttactttataatttctttgcttgaaggttttttttcccaattaacatatatataacatgtatggcttttgataatgtattttataattttaaggccagatgtggtaactcacacctgtaatcccagcacttttggaaggccaaagtggg

SEQ ID NO: 146229 - DNA, 266 bp, Homo sapiens
gcataaagaaattccagcctttgtttcctaactataagcacttctgtgccatgtgtatccaacaagcatcttgggggcagctgatgcatttaggtggaggaaggaagagtgaagaccccagctaggatacttatagacaggtatctagaaagagatggattcttctgggtccttatgacagggacccaaggtccagatgatgaaattttggccaataaacaagaaaaccaggcttcccctgtgatttagaaaaggagaaaagctag

SEQ ID NO: 146230 - DNA, 560 bp, Homo sapiens
ttttgtttttcttcatgtcaatttgacttaaatctgaaactatttcaatctcaaattatgtagagatatgatcattctattctttaaaggcgtctaattttacttatattataatatggggaaaatgcagtaaattttagccaaatcatgtttgattttatcttcccactggcatttataatttactttcagtttttaaacaaagaatttgctcataatttttatttcaaggctcaattactatcatttggatataactttgtccaggacaaagagaggcatagctatctgtgatttattagtttgacactggatccccgttttcagactaaggaggatttcagactaatgaggagtggcaggattcacgcagagtaggaatggagtgagtcagggaggagagatacagcagctgagtcagggcaggaggtggagggcaggttacttagagcatctaaggccactggagttttacttttcttctgagatagacatctattggaaggatttaagcagatgatttaatgtgaggaactctgaggttgatttgagtttgtaat

SEQ ID NO: 146231 - DNA, 381 bp, Homo sapiens
tggtgggaaccagagttgtcagggtagtagagggagataaaaaacacagaagaggaaatggaatggaagaagcccgtggtactggattgtaacgggaggcatctgtataaactcataaagaatatatattattacctagcttgcccactgaagtagaagcaatgaacatactgtctagatcttggtttctcttcctaaaaggaatcaggactctggagaaatggttgattcaaagttagggcaaaaatgtgtaaggtgagacttgctcaaagaatgatggccacatgtcaagattatagagaagctggcctaaagcagttttcattagtcaaccatgggaaaaggtgaacatcaaaaagaataatgataatggactatagc

SEQ ID NO: 146232 - DNA, 250 bp, Homo sapiens
gagaagggaattcggagagaacagtctgacaataccactttcggacctgggcggaccacggagtgctcagcaaccccgggggtgtgctggacctcctggagaaggtgcaccataagcaggagagcatcatggatgcagggccggtcttggtgcactgcagtgctggaattggccggacagggacgttcattgtgattgatattcttattgacatcatcagagagaaggtgttgactgcgacgttgatgtt

SEQ ID NO: 146233 - DNA, 285 bp, Homo sapiens
ggaatggaaggatgggaggtatgaaagagatgagtcatgaatgactctatgattttggatccaatcaaccagaaggatgaaattgccatgagctaaactaggaaagactgcaggcgagcaggtttagaatgtatagtttgaggtgcatatttggcacccaagttgagatgatgaataggctggtagaagtatgagcttggaattcagagaatcctgggctggagatgtgaatgtgggagtcatcagcctacagatgatattaaaacccatgcgactggataagat

SEQ ID NO: 146234 - DNA, 231 bp, Homo sapiens
cagaacacatatttggtggtacgtagcctcacatcgccacccggaaaagtctgcatatattgaatttggaatggatcaaactgcactgagtgcaaaattgtaaattgcatcttatataaatgttttagaactagatgatggagcagatgggatctattaagagaacggggtgccagatgactgaccataaacatgctttttaataaagactctgctgagagattaactcat

SEQ ID NO: 146235 - DNA, 286 bp, Homo sapiens
tggggctgggttcgtttgaatgcacatttgtttttgttttaagaggaagatggtcatcagagttctacgttggacatgttgagcctgagctatccaggagaaatccaagaggagatatgaagtaaactattgaattaaggctgggcacagaggctcatgcctgtaatcctagcattttgggaggccaaggcgggagaatcacttgagcccaggagctcaagaccagcttgggcaatatagggaggccctgtctttacaaaaaatttaaaaattagccaggcatggt

SEQ ID NO: 146236 - DNA, 305 bp, Homo sapiens
cacagacaaaatttcaaacttgcagtcaaaaccataaggccctcattggaaataaggcaaagcaaagccagcaagaaataacagacaattaaatcagatattacagatttcaaatattagaattattagactgaaatagaataatatatttgttatgcataataaaataaataggaaaggaaaatttgactaaggaataagggactataagattggtcaggcagatttaggaaaaaatcaaatgaacatgtaggaatacaaaaattgatatttaaatttaacatctgtgttataaataggtataa

SEQ ID NO: 146237 - DNA, 474 bp, Homo sapiens
acacaagaaaatatattaattcctccttgtcttttgagatttatgggtgtgcagaggtactgtaggtcccatgtcctctagtgtatcacactgtcctgagctttaattcaggtctaagaatgtctgtcctaccctctcaaaaatattttgaatggaataaatacctcctagttactgtctctttctttttgtagataatttgcccctttggctgacattatctttcttactaaacaggagtagtttttatgacagcatttggaagatgctgatagttaattattcatccaatgtctattaaaagggagaggtggtaaaaaacaaaacaaaacaaaacaaaacaaaaaacagttactggctgggtgcagtggctcacgcctgtaatcccagtactttgggaggccaaggcgggcagatcacaaggtcaggagatcgagaccgtcctggataacacggtgaaactccgtctctact

SEQ ID NO: 146238 - DNA, 308 bp, Homo sapiens
tagttggtctcttgaactcaggggctttgtcaatatggaggagacttgttaatattgtaactggaaatgatggagttggtaaagttgaggccattattaaaagtggctatgatgatgtacaaattagtaataaatttctacttttttctgatgaaaacaatcagaaatctcaaaatttccactttgcacaggttataacaaaatagtagggattttatgtccaaactagtcataattttctgtttttattgattaaaaagtagtgatcagaaatctcagtttttcttctaattttttttttttttttt

SEQ ID NO: 146239 - DNA, 360 bp, Homo sapiens
cttccagtttcccctcctccaggcacccacacggttcatcctggaagcatttggctatttgagaaattacagaaggaaaatttttgccacaaagaaccacaatctacctaataaatatctgcatctggaaagaacttaagtaaatctctaatggagtaaaaacgtgtgacatttgcttagcagtcataaatcccctgaactcctttcctggcctgtaacgatggaactcgcccacctgtgtcttcagcaagagtcacagtcccgaagatcacataggaaagattcccctgtgctgtccgtcacccccaggttggatcagctttgccgggtcagaagccagaagccccattaacttgtggt

SEQ ID NO: 146240 - DNA, 811 bp, Homo sapiens
tcctctgcagtggggaagtcgcgtttaggaggagacagcttatcatctgattgaggatactggcttctttccacacttgcatcactgtcttcaagattttttctaacagtctccaactgcggtgggctagatgtctgaacactaccagaattggaaagttctatgcagatattctgatcagaagatggaacatggtaatcctttgaagggtcatcattcttcttagttttatgaacatttgcatatattggaatatcttgcatttttgacaagattatctgtaactgtttaagtatcctcctacggtgacctgtaggtgatattccaattttctgcagcaggctgtcatttattgctgcacagtccttcacagtagtaaaaccagactcatggaaatgtaagagatactgctccaaattaatgctcattaggaaatcttttatatccacatttacttcactgactgaggacataatggtggcttcattactaagctgagttacaaaaagtggcacgatgagacacacacacaagaagatgtacttctctactggcttttcctctatcaattgtgacagaaaagtttcttaaaatgttattttcttcacagtgactgctttacctgcttaagccttgcgctcgggtcgcggagttcgaaaagcgaggtgaggcggcgctgggaagctcagcgccggcgtctctcccagccttgggcgctcggtcctcgcccctctgccggaggcgccaggcctcctctttcccggtccccgccggctgtccgcagtcgcctctgctgcctggcggcggccgc

SEQ ID NO: 146241 - DNA, 726 bp, Homo sapiens
agacagggtcctcccacccccgcgtgggccatcccggcccagccttcccgaggccccgggtactcgccttgcgctcgggtcgcggagttcgaaaagcgagacagggtctcactttgtcacccaggctggagtgtagtgaggcaatctcagctcattgcgcctccgcctctgggtccaagctatcctcccacgtcagcctcccaggtagctgggattacaggcgcgcaccatcagccaagacatagtctcatcaccctgtcacccaggctggaatgtagtagtgcaatctcgggctctctggaaccttcaactcctggattccaggtgattctcctggcctcaggccttcctggagatagactggggattaccggtggccaggggatatttctggctggacacattcaacattccaaggggatgtagtgtatggacggtctcttaagagatgtcctgggagtggcatggtagaagggactttttatggagaactacttctccaaatcactattcacatcctggtagaagtcaagccatgaagatggcacagaaacacattccaaatactatggataccataaagtatactgtagcaatgcattggcacaccctcatttgaacatttgtctcagaagaattttgacagaagataaaattgtctggctttttatttcaattggctttcatgaaacctttatttcactggctttcatgtcacaggcccag

SEQ ID NO: 146242 - DNA, 244 bp, Homo sapiens
cgctctggcgtcctcagaccctgggccttggtgtgtcctcttagcaaccagggaaagatgtgccgatctcaactgagaaaattaaaggatagcactcaagtctgtagagaaaattccagtgcctcggttctgtaggatctcacctgtcctctgggacccaccctaaaaagtgtttcttacttgaaagtttgagtaacatgcatccgacgtataaagaggacttagaaacagaccttttatcaca

SEQ ID NO: 146243 - DNA, 258 bp, Homo sapiens
gaggagggtttaaaaacagagagaaaagaagcaagccttatatctccaggcatttctcttctgctggcatgtcaggaaggaaaggagggcaactgcctagatgttctatcaaatccaggcaaagcacccccagactgggccattccctctgaggctagcccaggcagcaaaagaaggccaagagtcactgggcagcaccaaggccagttcatctttggactccccactcccaaagccctgagcttcccaagttaggga

SEQ ID NO: 146244 - DNA, 305 bp, Homo sapiens
agtttgtgcattcctaagataactctgttccttgttctctgatcagtgactttcaggagaaaaccatttttccttcctcagaggcacagaacttttattgtctttaagcttaataattcatagaaccttgctaatcctttgtggttggattattttttcttatccatgtgtcccattgccagtcgatgttttgttcttactactttaatttccattatcgcgtgccattttattttaatttttatatattttgagacagagtctcactctgtcgcccaggctggagtgcagtggtgcaatcatgg

SEQ ID NO: 146245 - DNA, 424 bp, Homo sapiens
cccctcagaagcccatgtgggttttgtggttgtcacagccctggtcccacagggtacattgctttgaactgagttaggaactggcaaccacaaatcatcctcatccgtaaggagttgggatttcttcttctggattctgttaccaatttgtgagttgagagtaaagatattagccttttgtttgccatattggcttcaaatattttccaggtattatgttgcttttaattttggacaaggaactttatatattaagtgttaagttttatcaaattataggtgaaaatttctcttatgatttatttcatgaccattatgattagcattatcttcaaaccaaagatttgatatatattcgttcatattttcttctagttttttttgtttttgtttttccatgtaggcttttaatttacctgatatg

SEQ ID NO: 146246 - DNA, 185 bp, Homo sapiens
ccttggttcctgaggggcagggaggaagggcgcaaactcagccaggatcttgggtgtgaactcagatgccaccagtttccagctgtgtgatcatggacaggaggcttccccctgccacccctccgttttctcatccatgacctgagggctgtgaagcactttgtacctggtgggtgccgataagt

SEQ ID NO: 146247 - DNA, 169 bp, Homo sapiens
ctacagtacatgagagcccatcctctctcccccatcccttctacctcctgtgtttcctccctgattttttgtgtgttcactctttggatgcccttgcacaaaatgtgctccaaattgttccttacgtgatgaagacagaagatcattcttagcttattattacttgctg

SEQ ID NO: 146248 - DNA, 482 bp, Homo sapiens
  misc_feature (7)..(7): n is a, c, g, or t
tatcgantgccacctgcctggtcttagtatttcttaggaaaaatgaaggttggaagccagggcaaggtgggctccaccccccggtatcctatcacttcgggaagctgaggtgggaggatggcttgagcctaggagtttgagatcagtctgggcaacatggcaaaaccctgtgtattagttctcttgctgctataaataattaccgaaactgggtaatttataaagaaaagaggtttaattcactcacagttctgcatggctggggaggcctcaggaaaggtggaaggcacctcttcacagggtggcaggagagagaaatgagagctgagcgaagggggaggccccttataaaactgtcagatcaaatgagaactcactgtcataagaacagcatgggggaaaccacccctgtgattcaattatctctacctggtcccacccttgacacatgggtattgtgggatctggccagcagcccgcaa

SEQ ID NO: 146249 - DNA, 339 bp, Homo sapiens
tctttcctctctatggtaaattctggcagctgatgatcatgttataatagcattcatttgaaccctggaagcaccagactcacaggagagggttctacaaatagataaccacaaataaatccctatgatcatcctaatgtgacagagaacagaaatgtgagcttgactatgtgtccattttcattgtatcatgattttcattatatcctattaggtttggcatcatttctttaggctttaggtcctggctacagtatttattttcctgtgaaaattattcacacagtgaatctgaccctgttgagaacctccatttgaaggtttgcatggggatcaagt

SEQ ID NO: 146250 - DNA, 208 bp, Homo sapiens
cagagtttcaaatacattttataaaagaaaaatataagtgaatttttggtcttttaatttaacacataatagcaaaatgtaaccatatttttatatttcagctaaaagcaactgggcaaaatgaccccgaggattttctgtgcatctattcttaagagctacatctgggccagctgggcatggtggctcatacctgttaatcacagga

SEQ ID NO: 146251 - DNA, 763 bp, Homo sapiens
gggagtcttagctagagcaaccagccaagaaaaatacctaaagttatccaaactcaaaatgaagaagtcaaattatccctgtttgcaaatgatataatgttgaattcaaagagttttaaagacttcaccaaaaaaccattaggactgataaacaaactcagtaaagttgcaggatgcaaaatcaacatacaaagtcagtagcatttctatatgtcaacagcaaataatatgaaaaataatataagaagtaattccatttacaatagccacaaataaaattaaatacctaggaattaacttaaccaaagatcttaaagttttctacaatgaaaatgtaaagcattgatgaaagaaattgaagatgacataaaaaattgaaaaaatattccatgatcatggattgaaataatcaatacattaaaatgttcatactgtccaaaacaatctacagattcaattaatataaaaatatcaatgacattcttcacagaaataaaaaaaaatctaaaattcatgggtaaccacaaaagacccagaatagccatagctatcctaagtgtaaagaacaaaactagaggaatcacattacctgacttccaattataatacagagctatactaatcaaaacagcaaggtattggcataaaaacaaacacatacaccaaggtgacagaatagagaacccagaaacaaatcctcacatctacggtgaactcatttttgacaaaggtgccaagaacatacactggggaaaagagagtc

SEQ ID NO: 146252 - DNA, 331 bp, Homo sapiens
tccaggagattatagatgcccttagaccttcttccctggctcctcccctctgactgttgccatacagtctaactgtaacacgtcctcctttatacgttctccctgccagccacacagcagtcagaatagtatatctgaagggccctgagttcactcacctcacctatccaatacccaggctctctacaacacagtcttaccttaccttcccagccatttctaaacaccctacatcctagtcaagccaagcaggactgattgcatttccaaacacactagatactctgtgacagtgttcctctgcctggcatgccctcctttggatcttgcc

SEQ ID NO: 146253 - DNA, 356 bp, Homo sapiens
tctaatactttggggccatttaatttcgagacaaatagttttacagatttcggtggctcctaataatgactccaaatcattaaaaataagattaaattatctacattgtatttaagagggccgagtatggtatgaaatatgtatttagaaaactctccatcaaatttttttttttttttgagatggactctcgctctgtcgcccaggctggagtgcagtggcgcaatatcggctcactgcaacctctgcctgctgggttcaagcaattctcctgcctcagtctcctgagtagctgggactacaaggcgtgtgccaccatgcccgcctaattcttaatatttttagtagagatgggg

SEQ ID NO: 146254 - DNA, 679 bp, Homo sapiens
acctactcctgtgataagcattaattgtctgtagcatggtatcaagaaaatctgtctgtgaactgagtttagggctgctttttaaaaaaatctcatatcttgcattttctgaactgtttttggtgtcggttttggcatggatgatgttcatcagatgccggatcagatagcacaaatattcaagaattcgtaacccataattccatgtccatctattggtctgatcattttttgaggattctttttaagaacaagattattttcatttttaatgtcatgagcacattaatggtaacttaataatattagtacaattagatgtccatatgcgacaaaaaaaacctaacctaataacatcttagagaataatcaactcaaaatgtgtcatcgatgtaaaatataaaactataaaacttttagaagaaaaatgtatttatcatatgacccaagaagtaccactcctaggtatttaccctagagaaacaaattttgccaggcacgatgtggctcacgcttgtaaccccagcactttgggaggccgaggagggtgaatcacctgaagtcaggagttcgagaccagcctggccaacatggtgaaaccccgtctctactaaaaatatgaaaattagctgggtgtggtggcgcgcgcctgtaatcccagctactcaggaggctgagg

SEQ ID NO: 146255 - DNA, 344 bp, Homo sapiens
caaaggacatttgaggtttctgagaaatcatatggtgggtggagactttaaaacactgatctttctttactttctgtaccctcataatctttggcactaactgcagctgctgggtttagggctcagggaaaagccaccacccctcttagaacccaagaccccaggctggtatggatatggaatgtacacgtctctcttcttccccactccgctagtttaagcagagtgagcctgagtgcctgagtcctatgtctattaactttttgttgtcagctccactggtaatagtgcttcaaagaaatgaacgtcttaggatccttcttagaagcatgtcgtcacgattg

SEQ ID NO: 146256 - DNA, 443 bp, Homo sapiens
cccactaaattcctagaggcaggcagaaagtctacattctgtttatttggaattgctgacataaaagattatgcccacagaaacatgtcctgagtcttgatgaatcaagttcataccatgtaaagcctgagctactgcactggtgaaactattctgcaggcagctattgagtgacatatggtcacataaactttgtaccccacaaaggcagagactctaaagccatggaattcctgagttcaaactaggaacaatctgtctgcacagatgaagcatgcaaacacatgcccaggcccaagcatttctcttcaatgccatcttgatgccatataacgtcttaccctgaaaagaagaaagacttaattttaagtctcatactgccccccactatctagactccttcctcctgccctagtcaatgtttactaaaatccccttcatcc

SEQ ID NO: 146257 - DNA, 382 bp, Homo sapiens
ggagtcaggcagccagggtcttgagtctgagttccctcatctgtaaaactttcataaagtaagaaagcatatttaagacacccagcacaatgcctgagacaaacaggtgcttagtaaatattacctgttattatcgttatagatcataggcagccataatctaagttattcatcgtcagtgttgtaatttaagaaacaatcacaacactaagttgtaccagcggtaagtcacacaggaacttgggtggtgattagtcatccacagacatggacactgtataaatgacaattggctgtcctgtctctgggaaaaagagcaacaattataaagcctgtgagaaacaacacaaagcagtatgaagaaagttgtgggtgctttctc

SEQ ID NO: 146258 - DNA, 254 bp, Homo sapiens
tttttcttttggttttgtttgtttgtgggttgtttttaaatagttgtaatagccctgtctcctcacacctcagctttagctaggaggactggcactcctcagaggccagcatggaccagagccaagcttttgctgtgtatagttaatgcctcttgacttgcaggcagttgtagcaaacctaactctcttaggttaaagctgatggacaaagaaggcacagccccaggactttacagctctacttattccaagga

SEQ ID NO: 146259 - DNA, 444 bp, Homo sapiens
gacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctaggtttgtatagataggtgtctctgtcaatggtatatgtatcttttggtttaaagattcgtcatttcaaattcagacttcaagtttagaaagttgtatatacatgtggttagataaatatttgaaagaaaaaaatacaaagcgtgattctccccattccctgcccccccccttttattttcaaagtctcttcctgctcctaacaaacaggctttggtctgcagcaaggcctaggcatgactattcaaacagagggagaggagacagacagctgaat

SEQ ID NO: 146260 - DNA, 351 bp, Homo sapiens
catctctactaaaaatacaaaattagccaggcatggtgcgcacgcctgtaatcccagctactgaggaggctgaggcaggagaattgcttgaacccgggaggtggaggttgcagtgagcctagatcgcactattgcactccagcctgggcaagagcgaaactccgtcttaaacaaaacaaaacaacatttaacctcattatactttaattttctcctctataaaactatttcatgtcacgagtacatacatacatttgtaagctgacacattataagtgttcagtaactgttagtataatagtattatgtatattacagtgagtgaattaagatcaaattgacgtgatattt

SEQ ID NO: 146261 - DNA, 690 bp, Homo sapiens
ggcaggggaatggaggaagatactgacagggtacagaggaggtagaatggagcgagggccatctccaccgggctaggaaatggggctttggtgggccacactccattgtgctggagcactctggcatctccattggcagtggggaggggcttgtgacctatcagcatcttcaccctttctgagtttccgccgggctgggctctccagccaggagtcacaggtaccgggtggttgttcatgctgaggccttttgcttggcaaaaagttaatccatttgtgttcatttttaacctaagcaagggttggagcttgttggattcagcatctgtggaacacagtctgtagcccatgggaagacgtggacattctttcccaagttcttgaaggacggaaaggaccatgaacttgtgaggtgaccggaggattggttttgggtgtcagttttgtgtctgtcccagtgctgccacttttgctttgaaatggacggggagagctgaaggccagcatgggtttctgcacctgtttcctacagctctgctggggactgtggctcaggtggcagctgtggacacggatcctgtcagcctttgggtggccagagctccaaggccaggtgtctcttagctgcaagcagccttcactgttaatcaacaggctacacaaatctcacctctaaagaggtgaaatgtg

SEQ ID NO: 146262 - DNA, 252 bp, Homo sapiens
ccctttaccgaggaaactgaagttaagtaatttgtccaggtttgtcttattaacacttccttaatcactctacttattcaagtagcctttgaagctttgtcacaaaatcaatgtttcacaaatttctataaaatcatgacattagagaagcacctaatccagcggtccccaaactttttggcaccagggactggtttcatggaagacagtttttccatggactgggagggcagtgggcaggggttggtttca

SEQ ID NO: 146263 - DNA, 339 bp, Homo sapiens
acctgagtgacagatgagacaaatatattggcagaacttgttaaattctgtgttaaaatgctcggcccagctgatatgagtttacttactctgctgctatcagcaagtgatgctggaagagtctgcttctttccctgtttatagttttctccagtttctgactctgaaatattagggtcgcataactcattctgtgttccagtaacattttagggctccatttacctctcgtatattgttcttttctgtaacaatttttctttgctttctgcttttcacaaatggaaagtatcatgaaaccttttaaatttatatcttctaataagtcttttctagaca

SEQ ID NO: 146264 - DNA, 366 bp, Homo sapiens
actagagtaacaccatcctgctctgggctgttcttcagggcgtttacagaccttcagcagcccaagaaagaaaacccactgaaaagatcaccccaacacgtgcatgcctgagaccaccagggaaaggccttctgatgggctcagcttgacccatgagggtcgcagactcaggagcatttgctgtcaacaccacttacagggaggactagagacaaatgtccattgttagagaccctggtaagggaaggaaaagcggtgcagttgcttaaaaatgaggacatgggttcacatctgatgctgaaacacttccaagaaatgctgagttaaaaaaaaaaatacacaccgaagcccagcagccactgtgcc

SEQ ID NO: 146265 - DNA, 290 bp, Homo sapiens
aggctctgcttctgcctcactggggagtgaggatcacagaatcacaagataccataataaggatggaatgtcaaggccattcataccccagccaccctcaccctccaagaaacaggtcttgcccttcaatctctgaagtgccattcttgctaaatgatcatctttcctgcctctgcttgggccccttctggggacggtgatttcatgactctgttttagtcctcctttttagtctcctatggggcttcagtaagttcctgggtcagtcgccatttataccccaaagccgg

SEQ ID NO: 146266 - DNA, 259 bp, Homo sapiens
taccacctcagcctcccaggtagctaggacttcagacactcgccataactcccagctaatttttgcttatgttttgtagagatggggcctcactgtgttacccaggctggtcacaaactcctgggctcaagcgatccacttgcccatgaagcctcttgtaatcccataaacctcattcacaagagagcaacccctctggcctaaacacgtcttaaaggccccacatcttaataccattacattggccattaagtttcaa

SEQ ID NO: 146267 - DNA, 1125 bp, Homo sapiens
cctgctatatagcaagcagtgttgaggcacggggtacatgaagatgaataagctgcagtcctgattctccaagggttctcaggtgaatgggaggataatggaaggaaaccacagcaaagaggggtggcctttatcacttgggcaatgggaaatgttgagggggataaataatagatttttgctttaaagatttttctctaataaaagtacagaggaaattgaaagcaggatcagatagatgaatcaaggcttcttcagattcagtggtttacaaatatacctcaaaattcataaacaaaaataatacgtaaaagagaacagaaggtaacgcaataaaggtaacagagatagtgtcttcagtatataaagagatctgaaaaatttaagaaaacactagcaatgcaaagaaaaaacagacaaaagatttggaattcacgggaaaaaaagaaatggtcagtaaaaatgcaaaactgtttaagcattatattttaaaaatacatatttaaacaactacaagttactgacttcaccccattagattggagagcgtggagtaagtcagcactgacactgccattgggaatgaaaaataatgaaatccttctgaaagcaattttacaatatgtatcaagagtctccaaaaatattacatcttcaatctaaaaattctattttaaatcaattattttccctaagaaaatagaggtgaaaaagtttataagccaaaatattcaatgtaggataacttataaccaagaaaaggggaaacaacctaaaacaataataatagagtggctaaatatgttatggcctaccccatcaacagactattatatgatcattaaaaatgaaaaagagaaagtgttccctatgtgctattaactatgaaagaataagaatgatacaaaattgctttcatattataatgcccataggatcattccagtgtgtatctgtgtttgtgtagatgaatgaattctagttaggtaggcaattattcatgaacaaaggattaaaagaataaaaggaaatataccaaattgttaacagtagttattaatttactagaagttttctgcattaaaaacgacccacagaattgaacaacgagaacagttggacaca

SEQ ID NO: 146268 - DNA, 431 bp, Homo sapiens
attgccttctataaaaaaacattataaggtacttaattatatatacattccataaagtctcatgcagaattttctagaccattatggatgtggtatcctttgtttgccgcaatgtgggagataccttgtaattaattatgtagtactttgtatttttgcggtgttttatcatatattatcttttgtttcttataataaccttatggaatagatagaggtgatattaaatatacactgctaacaaatctagtatctgagaacccttctacttagtgaatattttaagaacagtggtaaaaaattaatggaaagcagggcattggggaaccattgaaacattttaaaaggggagtgatgtagtcagaagatagccaaaagaatgtatctaaaggtcaaagtggggtgaggaacactgttatagtgaatcttta

SEQ ID NO: 146269 - DNA, 371 bp, Homo sapiens
actcaggtttaggctcagcgagatatcacaatactgcgcctttgagtggcacagaactgccattgcaatgtgtgaaaactctaaagtggctatttagtgcaatgggatggatgtttgtgcagctaagtataatggacaatgaagaatgattttatctccttttgagaacataagtatactattctatatttatccctcccatctcctaatttagacagggaagaactttttctgatcagcacccacttgccaataatttcgctctacatctaaatggagaacaggagtcatataagttcacagattgaatggatggttgatttacgaagcccttgaaatgtggctgcaggccgatgctggcaaccccataa

SEQ ID NO: 146270 - DNA, 301 bp, Homo sapiens
  misc_feature (257)..(258): n is a, c, g, or t
gcatggtggcgggtgcctgtagtcccagctactcgggaggctgaagcaggagaatcatttgaatccgggaggcggaggttgcagtgagccaagattgcattactgcactccagcctggtgacagtgtgagactccgtctcacacacacacacacacacacacacacaaaataaataaataaaataaaaattattagtatggggataatcagaacagtggttgctgttctagagggaagaagattaactgaaagcacnncgaggtagaagcacccgcgagtagaaggtaccggctcgatcgt

SEQ ID NO: 146271 - DNA, 372 bp, Homo sapiens
gcatggtggcgggtgcctgtagtcccagctactcgggaggctgaagcaggagaatcatttgaatccgggaggcggaggttgcagtgagccaagattgcattactgcactccagcctggtgacagtgtgagactccgtctcacacacacacacacacacacacacacaaaataaataaataaaataaaaattattagtatggggataatcagaacagtggttgctgttctagagggaagaagattaactggaaaaggcaaggagggtggctcaggcctataatcccagaactttgggatgcctaggcaggcagatcgcttgagctcaggagttcaagaccaacccgggcaacatggtgaaacccagtctctac

SEQ ID NO: 146272 - DNA, 203 bp, Homo sapiens
atgcaataaacatatgagtgcaggtgtttttttggtagaacaatttctatacccagtaatgggattgctgccattgaatggtagctctgtattaagttctttgagaagtatccaaattgtgttccacagtggctgaactttaggactgttatgaataatgccgctgtaagcaattgtgtacagctttttgtatggatgtgtgt

SEQ ID NO: 146273 - DNA, 526 bp, Homo sapiens
aataaacttatacaatagcaaaaggtcccctcaaagcaagagctatggattcaaatatgcctctcaagcgcaagtgacagccaaaaaaggtacaaaaagtgcaagggttgcaggaggggctcaaaggagacagggagatccttacgcccaattctgccaactcaagaatgttctgctctgtgtaaatatttcactctgttgctctgccgcttagaaacagagtgggcttcaacagcccacctcatcagaaaacagctccctcatcatgtagcatccaagctagatggtaatcaggagaaccacatgtaactcccctctcctgagtcacacccagatctgcggcatgtgtcattctatccacctgcacaggcccatggaaggaaggtactcactgtgagcactgaactcctttccatgttttattgtgctttgccttgtaatctataactaaaatagacccagttttaaaatattttttacaatgcccagtcactaaaaattaatgagctgccacagtaaaaaaaaa

SEQ ID NO: 146274 - DNA, 251 bp, Homo sapiens
agacccatctctgcaaagggagtgactgtaaagaaacttccactcctgcctctgcagctggcttgtgcctacggggcaaaagctcaggcagtaggtggtaaaggcaagcccagagcccagccagccacatcagacacttcgaggaggattacggattggctctgcagtcctgcctttgaagttcccagcttttatcagaatgtctgaaccttagcgttatttcaagggagcttttctttctgtctgtaaac

SEQ ID NO: 146275 - DNA, 336 bp, Homo sapiens
ttcatatccctggcaagatctcttccccacaaaagacataaatgtatatatgtccaccaaagacatgtacaagaaagctcatagcagctttatttataatagccccaaaccataaacaacccaaatgttcattaacaatagagtgaataaattaactgtggtataatcatacaatgggatactacacaacagtgaaaacaaacaatttacaattgcaagtaacaggaggaataatggtcgggcgtggtggctcctgcttgtaattctagcactttgggaggccgaggcgggtggagcacctgaggtcgggagttcgagaccagcctgaccaacatg

SEQ ID NO: 146276 - DNA, 713 bp, Homo sapiens
cttcctcttcctagcgagaaactgcatgcggctgcaggtcctggagcttgaccacgtgtcagagatcacccaggaggtggcagcagaggtctgccgggaaggcctgaagggactggagatgctggtgctcacggcgactcccgtcacccctaaggccctactgcacttcaacagcatctgccggaacctcaagtccattgtggtccagattgggattgcggattatttcaaagagcccagcagccctgaggcccagaagctgtttgaggacatggtgacaaaactccaggctctgcgacggaggcccggcttctctaagattctgcacatcaaggtggaaggcggctgctaacccgggtagggggcggcagggcccctgccagccccacaccagggcactctctttggacctcagagggaccctggtttggactagacctttggaggccgagtgttatccctggcttctggagggggactgtcaagtctcctgtcctcctcctggagcagcagagcaacaggcctgacccagggcactgcctccccagtacaggggcttggacagaagctgccctccgacccccaccctaccccggctggagtagcctctggcacagccagtgaggagctgtcaccaccagcgcctggtgtcatcacctggaggatctgcaataaccacccagtggctcctcagctgttctggctggcctctc

SEQ ID NO: 146277 - DNA, 303 bp, Homo sapiens
caacgcgttgtatggatggatgccctgaatattctgatgatttgggttcgacttcttttcttttctacctgaggtgggtgagctacaatgactctgaataatagaatcaacattatattatctagttaatataaaatctgaataaaatctaaggaaatcttggaaagcaatattttcataaaccatatcatctgttgccgaactccccacacatacaagtactatggaaaaagtaatgtctactgcccaggagtcatcttatagaaaccacaattctagaagttgctgtacccacctggaaat

SEQ ID NO: 146278 - DNA, 700 bp, Homo sapiens
atgaagaattttttctaaattaggcatttcaacttttgtttgggtatgtggttactttttgtcccttttaattttcatcatgtttgcttcatgtttatgaacaggtgttgtttgaaaaatatcagaacatagcttttatagtgtggaaactatcagaatttacctttgaggtggatgtttatgtgctgaatactgaagaatgggagaaaggggatatgaacaacacaatgagctttagtgtggcttggaggaaaccaggcaacctggtttgctagttcattattgcagacttatttctgtaacagtttgtgaaatcagaaggtattataagaaaaactggaatgtaaccggaaaagatcctcaaaatttagcttaggatatttcaagcttctattttttccatatgaatactttttttaaaaaagagagagagattcataaataagattccaatgtttatacaaaatttttggaaactgaatactgattactgtaaagatgatatatctaccagtcagtaaagatgagctcctgtgagctttgggggagaaaattttgactagagattttgctggtaaaaatgaaaatagtcattatgaggctttggaaagaaaatgtaggaaacactgtagattgaactatgcttgaaatacaaagttgggagacactggtttttagtaatctatttaatctgaagtag

SEQ ID NO: 146279 - DNA, 241 bp, Homo sapiens
gaaagaaaggaaggaaggagaaagaaaaagaaagaaagaaagaaagaagaaagaaagaaagaaagaaagaaagaaagaaagaaagaaagaaaagaaagaaagaagaaagaaaagaaaagaaaaagaaaatagtgaaaacgtcctctcacaggcttcattgccattcctcaaaatgtagcctttttatcaggttattttctatctttatagaccttccttctttctcttatttcggccaggt

SEQ ID NO: 146280 - DNA, 216 bp, Homo sapiens
agagaaagaaagaaaaagagccttccttctttctctttctttcgaaagaaagaaagaaagaaagaaaagaaagaaagaagaaagaaaagaaaagaaaaagaaaatagtgaaaacgtcctctcacaggcttcattgccattcctcaaaatgtagcctttttatcaggttattttctatctttatagaccttccttctttctcttatttcggccaggt

SEQ ID NO: 146281 - DNA, 463 bp, Homo sapiens
cacacatatacgaggagaaaacacctggttatatagctgttttgtttgctcaattcagataaaaggttatatacctttttaatgtagttttgacttttgaactatgtagatattttatgtattcaaaaattaaataaaggagggaaaaaactaaattaaatacaaaccaaaaaaagcgaatctaggctgggtgcagtggctcacgcctgtaatcccagcactttgggaggccaaggcaggcagatcacgaagtcaggagttcgagaccagccctaccaacatggtgaaaccctgtctctactaaaaatacaaaacttagctgggcatggtggcgcatgcctataatcccagctactcaggagactgaggcaagagaatcgcttaaacccaggaggcagaggttgcagtgagccaagatcgtaccattgcactccaggtgggcgacaaagagaaactccatctc

SEQ ID NO: 146282 - DNA, 428 bp, Homo sapiens
aacactcattctttcatgtagttaccaacaaataaataggtgactttacagatcagaagagagaaaaccggttcatttatttaatttctcacaccttccctaaggagccagcaaagaaaaaataagcaggggcaaagagcccaggctgcactccacgctggcccccatgtgacgaacgagggctctgccactcttccggtctccacatggagctcacgaagccactccagaatgtgccacatgctccttccatggaaaagtcaattcatttgccacagatttccaaagcatccaaatgacaaacagagcacagccctagtcacccctcacaggaagaaggtgggcggagtggcactgatacatgctccagtgacccaaaggctgtgggatggcagcggagacttctctttcttgggagcggcaagatg

SEQ ID NO: 146283 - DNA, 260 bp, Homo sapiens
caattggagatggcttcatggagaaaaggaggaggaatatggtgtctctttgggacttgaggtcatgtaaaactgatgttagaagaaacatgtaggtccctgtctgaggcaattagaagcaagttcaaggaaatcatcttccacttaatctttgcttatgctgaatagtttgagtgaatgatgtcacagggagttgaattaccaaaatgctcacctgccttcccccatttctccctcccttcctccttccatccttcttt

SEQ ID NO: 146284 - DNA, 456 bp, Homo sapiens
ggcgggtgcctataattccagctactcaggagactgaggcaggagaattgcttgaacctgggaggtggagattgcagtgagctgaaatcgtgccattgcagtctagcctgggcaacagagcgaggctctgtctcagaaaaaaaaaaaaaaattaaaaaaaaaattgcaaaaccattaaaatgtaaaatacctttgatactagaattttgttttgtctttaggggacatatgtgggcctttgggttagaaatactttttgatacagattttaacaggatttacgatctatgattttatttgaatattacacttcaaatgatacctcgccaaaccttgtttgaaaaataaagtgatggctgggcgcagtggctcatgcctgtaattccagcactttgggaggccaaggcgggtggatcatgaggtcaggagttaaagaccgtcttggccaaggtggtg

SEQ ID NO: 146285 - DNA, 729 bp, Homo sapiens
ttcggatagcgtcgggtgttcgcccccgcggacgcagcccaccctgctttgccggcgagctgccacctcctctggcccagtgctgggcctcggtccggtagagggagcccaccggttggccccgcgcgcggccaccgccgcctcctcctgtccagtcttcggtctctaccctagccccgcggacgcagccgactaggcccggctccgcgctcggcctcctccctgctccaggtccttggcctggccccgcagacacagcgcacccgctcggcccctagcgcagacaccgccgcctcttggcgccaggtcctcggcctctcccaagtggacgcagcctggcccagaggggccccagagaactcgggcggcttgagtaacccctgatcgttgggagagaacctgggattttttcccttctttctagccaaggctcatggagagcgcagttactattctaatgcaatgacttaaaataattaagcaacataaattatgcatgttgggattaaggtgcaatgttttcccaaatataagccacgtgcttcatgaatgattaaccgaaatagttaacatgaaaaccagtaagtcagctgagaagaaattgtggatccaccgcagtggaggagcgcaggaaggcgcctacagactccctagtgctttagtccaaggtagaattgtgagggccaccagcaacacatgtaaggtgtttggaccttacccacggcaaga

SEQ ID NO: 146286 - DNA, 695 bp, Homo sapiens
ggaaaatgcaacatttgggcaagaaggcagaagtgccttcctcacttaggtcttgggagtagagccctagccaggggccacgcccttcctctacccagcttttccctccccaccttccctatcatttaaagggaccatgctcttctattcccagcactcctgtatcacttgttgcctaccacctgcgatgccctgtttgagaagcatgattagaaaaatcccagcaatcttttctgtttctagtggtgtggactcctgcttggaaggcttttcttgtgattttttttttcccccataatgtttatattctgtgttttcctattcagttataatgagttcagttcaggggagaatgaggttcaagtggactgtgcttccctgagagagcaattgagtgctctcctggtcacataggtcttgcacttctggagctctaaatggaaccctcccagcatatccaggtccttcttagagcccgactgcaggccaccctgtccttcagccgtgtgattttacggttttactgttcagcttcagcatagattctacctggaagcacaggggtgtgtggtcatcttttcttcctggaaaggtcccttttggtgaatgattgagttcccaagccaatttctgtcccagagggaggttgtttcagggactggttgggaatggcagtctccactgactccatggtg

SEQ ID NO: 146287 - DNA, 481 bp, Homo sapiens
ttctcctgcctcagcctcccgagtaactaggaccacaggcgcgtaccaccacgcccagctaatttttttgtatttttagtagagaccgtgtttcactgtgttagccaggatgatcttgatctctccacctcgtgaaccaccgcctcggccgcctgaagtgctgggatcacaggcatgagccaccacacccggcccctttaattgattttaattgttcattatccagcagatatttactgaacaccaactgtgtgccaggcactgctctgggttctgaggatacattagtgagcacaatagactatccatgctcactcttcacagttacattctggtggaggagagacagtaagcaaacaagacatgaagtcatctggaattaaatgctatgaagaaaagtgaagcagtgaagggggatgaaatgtgatggaaggtgctaatttagatgggatagtcgggaagggcctctatgaggaggaaa

SEQ ID NO: 146288 - DNA, 227 bp, Homo sapiens
ggacctcctgtaagatggctcctacgcgaccacgctaccagagaatcagctctacgtgccaccaacattgccaccaactgtccatagatcgcctgcgtgcctcagcccactgacactcgatgccggactgggccagaaggacgaccccatatttgatgcctttttgtctccctggaccagagactccatccttccctttcctcccacgctcatttctttttctttag

SEQ ID NO: 146289 - DNA, 303 bp, Homo sapiens
tgtggggtccagtccctgtctgcatggataattttagtggcattatatccccatccacctcctccctccagctggagcgacttccagccttgaattcctctccatttttgcacttgtctaaataatccctttcgagaggaggatcagtgtcactgggttgacaagaatcagccgagggggagggcaggtgaagatgactgcgtagcatccgctgagaccaagtttcaagagggaaaccaggactcccccacccttccacccacgggtcctttctcacactgctcctctgggagtgtgtaaagc

SEQ ID NO: 146290 - DNA, 629 bp, Homo sapiens
ctacctccttttcactatccctcattttcctcatatcttcattttccttatttaatttaaattgtcaacatttatcatattcactaccttgcttacattcatacccttgccctctcatacatagtacttacgttggctaaattacagccataagtaaatttaatgatctttttattcacctgactgtgttactccaacagaaagccacagtgaattagggtcactttagattttaagagggcccataatgacttctggaaatgatttccttagtcctttcattctcctgctcatccagattgggtctttagttcaaacaatgggccagctccacctgtctattgtcgtaattaaaattttattggaacagagccttaccagttccttaatgtattatctatggctacacagcaaagctgagtagctgtgacagagatcatatggcccctgaaagcctaaaatatttactttgtggcccttttaaaagcttgtcagtctttctcctaaacaggtgtttcatacattctcctttccataaacctccaacacttcccccaccctgtatcaatcactgagcaaattgaagtaatcagacgagaaattcagtaagtttgtagtacttctgctta

SEQ ID NO: 146291 - DNA, 794 bp, Homo sapiens
cacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggcca

SEQ ID NO: 146292 - DNA, 756 bp, Homo sapiens
tccttctctttagtaaccttcatccacagtgaacaagatttacccttacctttaagcagtagcggctactttatgtgaagtgaacagctgctttttttatctgcatctagacatcaagtagtccagagtcctttctaacaccctagcaatagaagtaagaatattttgaccattccatgacttgatgatacttctagtaataatactgtattattaaaaacaaacaaacctttgtgcagtggtaattgaagcagttccttgggaacatgtattaagtactttttagcagttaagtccactctctgtaggttaaggaatatttaaataaaataatgtggcaaatgagttcaagatgataaatgcgatgagaactaaaacagctttaattttatgtgggaaataaatagaggaaaagtacattacagggctcctggacttatttctttcttcaaagtgtttctcctagcgaatattattactattttttctcttaagtaaaaaatacacaaagtatgaatctacacaggataataatattgaagttaaggatgatgtctcctccttcactctccaaaatactatttacttggcttcatggaaatctctctcactccaattccaccgtgtcaactgaggtcttctgttctttctctccctatagcatattcctgttacataaatcctaaactgtgtcgtgttagtcacacactgtaacctctagataagcgcctgtccagaggttctcaatcagagcct

SEQ ID NO: 146293 - DNA, 353 bp, Homo sapiens
cttctcccctaaagcttcgtagaagcctggcaggacagcagcttagtctcatcctagaacaagatttgccagtcaaatccttccttcccagggactagacagacagtgtgaggctgtttagcaacaggtttggggcagatttcctaaatctcctttctctccaatccgtcagcctggcagaagcaacctagagatgggatttagtctcattctgacacagcacagttccagaatgatctccctgcttgctactcaagccggaatcaagccagagcctacatacaggtcccaggatccagagaggaatgaaattgctttattaatatcataaggttggggggaagggaagcatg

SEQ ID NO: 146294 - DNA, 641 bp, Homo sapiens
tttgggatgttctgcgggggcgatctgtatgagggcggaggcacgtacactggaggttccaatccagggtctgacaggcagagctcatgcctggggacataggcgtccatctgctggctgtcctgagagtcactgctgtccgctcctcccctagactgctggtgcgagctgtaagatgggggcttgaggggcctcccaaacttaggccggggaaatggggctgagcagccactcttctcagaattcctcgtggagtccaaatttggtgcgcaagtgggaggatacggtggcattttaggtgaatgtctttcatttaatggaatgggaatttccgtgcaactcaggctctcgggggaaagaactctaggcagtgagcgagacttccctttgttttgagaattcaacacatgttctccttgaatgaatgggtacaggtcttgaaacagtctctccccatctccatcagacatctgcctccctaatttccttggctggttccagctttccaggctgacgttctgccacttggcaggacctgacattcgcaattcttcttcccaaactggcttcttcatcacatgctctgaccttcctccaacttcccatggaccctccctcacgtggacaggcaggctgtgggc

SEQ ID NO: 146295 - DNA, 339 bp, Homo sapiens
tctttttcggcgaatagtctacataaccgtcctgattaggatacatcgctggcgaagaactctaggcagtgagcgagacttccctttgttttgagaattcaacacatgttctccttgaatgaatgggtacaggtcttgaaacagtctctccccatctccatcagacatctgcctccctaatttccttggctggttccagctttccaggctgacgttctgccacttggcaggacctgacattcgcaattcttcttcccaaactggcttcttcatcacatgctctgaccttcctccaacttcccatggaccctccctcacgtggacaggcaggctgtgggc

SEQ ID NO: 146296 - DNA, 102 bp, Homo sapiens
tgctctcccctgcccacctctctgtagagggagcctcctccttcctcattctggggcatgttgaagcacatgtttctcctgcccaccagaagagggagccct

SEQ ID NO: 146297 - DNA, 401 bp, Homo sapiens
tgagaagaatgtttagttcacagtatcagaatctccagctacctaattcaaggggaaggaggtaaccttaagaactcaagaacgagaatgcagctggaccaagaacagactggaagagagtggcttaatgctgtcagagagtcaggtagtgttctctctgcttctctttagacagttactttattctccccatccataaatcatctttcttagtccccagacagcagaacataactgcttataactcccaatcctttacttagggtccttgagcatattaaggccaaatccttctctattgagcctagtttcaaatttccagggaagaaacgaacactgattgggccaggttggtcaggtgcccaacccgagttcaatgtattatgtcttttgtgtagaga

SEQ ID NO: 146298 - DNA, 1516 bp, Homo sapiens
gaatattgttaaatgttttcaactaaacagaaaagataattttatctaaactacagttttatcagattttactaccacacccatataccttttggtttgcacaaaatttaattaagtttaaagccagcttttaagactcacaacacaccagcagtgcacatgtcggttgttctcaggttcagcaagtcatcacattcttgcatcatgcacagtcgcacaaacatgcacaggtcagcgacaccatttacagtctgcgccatcttgcgcgggcgcattgcacacacaataacattcacatcatctattatgcaccagcgaggcaatcatcatctcatctatcacgcacaactgtctttcatgcaatatatggcatgcacgtctaagcagctcacgagcaactggccaggttcacatggcaccaacattgacgttaattgcgattcataaaaacagtcacaccactcgtccaatacaggtgttcacgcaattacactttgtataacatctgacaggcagctgatccccaagcaacattggcgatcatcattgggatcccaatatacgcgggcacactcacgacgaaacaaccacaaacatcccacacgtggcgactcatcaaccacacctgctcgcagtgatcgattatccaattcagattcgtctccactttcatcacacttaggtcgcactccaactcacaataggttaccaccaaagaccaatttaggtgaccaccagacaaagctcgacatcctggtatcactacttggtctcgaactaacgatcatacattcgaagcaggtcgaacaacaactcgcagcagccacagctcaaccgccaaaccatacacccgcgaatccatagcaaagcacaccctacagactcctggacatggtcaaccacacgggtcacatccggcacgacaaccaccagaggctcgaatacaccatgcaacccgaaccgcaacacacagcaacccaccacggagcataatacaactaaccaaaaacatgacaagaacagcaaccaacaacaaaacgacaacaagcgaacgatgacacatcgaaccatacaatacagcacaaacgaaaagaaaaaccaccaacacacaacagacagaaaaaaactcacaacgacgagagacaacagacaacagcacacaatgaaagcgaatcacccaacgcccgacacggcgcccactaaccacaccccacctacgcaggacacggcgacagaccaaacagaacgagcacacagcaccgaccaagcccccaggaacggccggcacgcacgacacaagaagaaaacgaaacaggactacgcgccaccacgacacacgacaccccagcgacacaagtgaaggggcgccgacgacccccgcaccgccacaatgacaaggcgaagaccaccccacaacacacacaacacgcaaaccgcacacacacgaccaaacgccacgtgagaagaatccgacacactaacgcccccaccagcacgaagaagaccaggagagcca

SEQ ID NO: 146299 - DNA, 319 bp, Homo sapiens
gtgctcggtgaatactggcaggtgcgattttcatgagctctgattcttgcaaggggctggctgacttctggctccaaggagggcagtgccaggaaagcgcagctaaatgccagctgcccagatggcacggaaaacatgcactccgggtcatcgaatcccaaattcactggggttgagccccctccatcttgagtggctcaggataaaatctggagcctgtccactccacgctcactgtcaggagcctcctaatgaaccatcgaggctgtgtgtcccttctgcagtcttttgtccacccagtggccagaacgatcctccg

SEQ ID NO: 146300 - DNA, 445 bp, Homo sapiens
atgtgccttttgtgtacatctttgtaattatcaatttatgagttgaggaactaaaattattggtgtgcttttcctgagagaagagatacaggaaagtgtcacagatatttgcacttagagaaaaagtttacccagaagaacttacaccaaaatgtattgtcattattttctggaaatacatcaaaattcatataaaatgttatcttcatggttttaagcattcacctctgttctagaagataataaatacctgcaagtttttattgggctattactctgtggcagtaaatatgaaaagacccagacacatgagccatggaacacacaggaaaacaaagtatttactcatgaaaaccagtttgtttaataatgacaaaacatgttgacagtactctccagcaatactcagaatttacagttttagcgtaacatagctgattctcac

SEQ ID NO: 146301 - DNA, 343 bp, Homo sapiens
ggtggatggaaaggaacaaaaagagggattggggagtcctaaactctgacacattccaaagctgcagccaggcaagtgatctcaactctcaatgtcgatataatccagaataggtgagaaaaccaccgtttgcctactgacttctgaatatagtgggagaaatgtatgagaggtgatgcgggatgggcaaagtgcaacaaaaatacattttaagcctaagaaatcatatagtacaatggaatttagaaggcaatcacacagccatttattaggcaatacaattaataggttgtacagtctggttatttttgaaactatgggcattaaacatttttttatttat

SEQ ID NO: 146302 - DNA, 514 bp, Homo sapiens
cagttttccagcttcttctccctcctcctagtctctgtttgtggacggctttaaatggttttccaccctgggtgggccaggtgttccttgccctcattctggtaaatgcacaacctcccagcatgggcattatggccatcatgtacatgtcacagtgctgcaaagattttgtttatggccagttttggggccagtttatggccagattttgggaggcctgttcccaacaaataataatctctgaacataagaatttgactagtgttaaccactccacttctccagtacactgatacttctccctttttcttagcataacacaaaacagatacatgactacacaccatctgctctccagtgcggaacagaggaacaaaggcataagcaagcttcagaacacagtcagccatgttcaccacatctatatctagcactgcttaaaacaaagtcaatgagaaactgagaagatgagtgactaccctattttcagcacttattgtcacaagaaaagaaa

SEQ ID NO: 146303 - DNA, 417 bp, Homo sapiens
gctagattaaatcgtagaatgtgtgccagcaaagcttaaagtttccaggttagctgagggaggccatttggaaacttgtgtctgaactccaataggagagagaatgttcaagcaatgggtcttctgcccatttccctctgctttgccatcccatgggataagggaaccacctcaggttcccaatccccaaatcaatatcacagagtttagagtccaggccctcggctaaaattagaccccatagagtttctagtattaattggcccattattttaatagtaattaatgtaattagtctgtagctatgtttatttgtaatatggaggatgcctgtctgctgtacatacatctttctaagacagatcctaagctgtgttcaatttcttttccagtgtaatacatttctagtcacaggac

SEQ ID NO: 146304 - DNA, 247 bp, Homo sapiens
tctctgtatttcaatggttttctgtaatgattaaggttaggctgggacttaggggcagaggcaggatggaaagggaggggagctaactgacatgcccattgctagtaatgcaagacattctggagaaaaattagaggagggagcttcccagctaccaaagatgatggcaagtgagaaatcttttgaaagttctctgagcaaagaggtaaaaggaacagccagaagccaactattttgctacagaaag

SEQ ID NO: 146305 - DNA, 162 bp, Homo sapiens
tttccctcattttctatcatgttctttgttgttgtactgtcaagttttgaggatatgtggtttccaaatgttttctccccatctgtagcatgtcttcatccacttagtggttgttttacagacagaggtttttaattttggtgaagttcaattggtcagcct

SEQ ID NO: 146306 - DNA, 293 bp, Homo sapiens
atcttgtatactttgccacccacaactccagattttctctacaaaacgttgaaacaaataaatacacatagaaacaaaacaaaaataataacttagcacacctctctagtaaatattgttttcctcaatgctggtgtcgagaaatattttctaaactcccacagtgccctagatttttctctgttattgcacttactacaagatacagtgctttttctttcctactaccagactcttgcataaataaggcatgttttgatttaaagagacataaacacaaattgaaatattta

SEQ ID NO: 146307 - DNA, 427 bp, Homo sapiens
ctgaagaaactaaatgcacacataagccaccttccttagatatgttatctgagcaaacataaaacaatcttaaaaatcataatatactctacagattcttgactctccagctagcagtgaataaatgttcattttttcagcctaattgttttcggaccactgactagaattacagcatgaaaaggccactgtcatgttcagtatacatttttaatagacatctttaaacatttagacaaaatattatttttaaatggcaattctttaactggtaaatgtaattatctaactttataaagaaaaaaaaacctgacaatcaaaatattctgtcactgctttaacgaaacacctaaaatatcttttcagcaaatgaaatgattctttattttacgcttttaaaaatgcattagaataattgctctgcaac

SEQ ID NO: 146308 - DNA, 635 bp, Homo sapiens
agtgcctgcctctcaaagaacattggttggagtggatgatgtatcagtcgtaagaatcatgagtgatgtgaatgatgtatgatagggtgatcaatcctgaatatgacttgaacagaagagagagagctccctgtcaggggaggtaatcaaagaaagtttcacaaggaaaagggggtgaaagctgagccctgaaagataaggcagaatttaaagatgaggggagggaagcaggagtcgactaggggagggtatctcatggcaagatggaaatgtcattagtgagggacagagacaggaaggcaggtggtgttttcggtgagcagaaatgtctggactggagagggtcctaatgggaaatggaaggtcctgtgagtcagcgtcagactccagagagccttgaatgccagccgaggacccgaggatgtcagaactctccaagccctagagatcaccttgtctagcccttcctttacacacgaggaaactgagactcagaaaacttatccaaggcgacgtgggtagtcagtctctcggatagctgtcgtgttatttccaccgtgcagtggctttctaattgggtactttggaaccccaagtttccctagagagtcctcagcagtccccatatggtaagg

SEQ ID NO: 146309 - DNA, 374 bp, Homo sapiens
caacatctgtgtcatgttgtggttgccatctgttggctgtcttttccccttatgattttcctgatttttcatagctgaagtaattctgaattactggacattttgaatattatgctatgtgactctagctcttgtttaagtcccacgtaaaattttgaatttgtctttgcagcaatcaacctaattaggtccagtccacaagttcctacccaccttctgtgggctgtggtaccaatatgatatcagttttcaaagccttttaagtattattttgatttttcccaagcataccgtccaggggccagtgcagaactacttgagcagtaatgtactccacagtttggtcctcaaagcctttggtatgctgtttaggg

SEQ ID NO: 146310 - DNA, 379 bp, Homo sapiens
tatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattggatttgaaccatatttcttctgctagccaattccatcttatctacaactttttgataattattttgagaaatagatctagatcacagccttccaattcctaggccaggatactttccatttttctacacag

SEQ ID NO: 146311 - DNA, 321 bp, Homo sapiens
ctgagtctgaggctgtcgcaactcaaaaagcttttctgttcacactctgtacttagcttatgtttgaacaatctatagtgaaactcaaaaaatgggcatggatctatttatttgttcctttcttctagttctctgctcctttggctgactaaggcactgccaacctgatttggaagtaaccggtctaatttccacaagctggtttgccccttcttttctagcatgtcaatctccacccatttggtggtggctaaatttccttaggtggagtggagagaaccacacactgacaaatggagcagggggcgccaagatgcttcg

SEQ ID NO: 146312 - DNA, 498 bp, Homo sapiens
atgtgggtgtgcaggagggaagagctcccatctccggggatcttccatgacattctccatgacagcaggccaacaggaagtggcagaaccttcatgacaaagcattggagtgctgcttctagtgtgaatcctgtcatggataggaccatgtatcctgtacactctccaggtgcccagtgaatatgagcttctctgaactgactgaagaccacaagatgaaaactggaaactcgcagccttcatacaacaaggcatctggtatggaagcgttcagtgcgggcttctctggctgatacactcgccatggaccttgctatccctgagctgggaccctaatggatgtgcatgagtttgtctccaacttgtaaaaaatgtgcttttgcaagaatgagtgaatcacagactgaaagaatatatttacaatgcatacacctgacaaaggtttcacatccagaatatataaagatttcctagaaatgcgcaataaaaagacaactc

SEQ ID NO: 146313 - DNA, 175 bp, Homo sapiens
agccaccgcgcctggccaagacattggtttttaatataacatgcaagtcaccttcttaatttgataacagtgatttttttgcaaccctagaagaagaactgggcatattgggtatatagagactcagagttggccttgaagaaggtgtctttggaaattttctaggtctgtcata

SEQ ID NO: 146314 - DNA, 243 bp, Homo sapiens
aagtcagcactcaggtaccagaaggcccccagggaaccccaccttcactaaccccctattgagtacctattatgtatgggctcagcccacactaggacactagggactttggactcacatcgccctggggttccaattctagttctgctaattactagttgtgtgaccttggatgagttacctaatctctgtgaatctcacttttctcattagtattatgggggtactaatggaatgttctga

SEQ ID NO: 146315 - DNA, 570 bp, Homo sapiens
atacattttccctttggctattttacaaggacattgaggattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatcagtgcagtttttttaaccaagaataaacataagttctaatagcaaacagaaataaactccctacacattaccttctccattaaaatatgttttatgccacatgcagaa

SEQ ID NO: 146316 - DNA, 281 bp, Homo sapiens
tgctgggattacaggcgtgagccaccacacccatcccagaacttttttagtttaaattttgccaatagtggatagagtgattctgttgagatctgaatggtgccctatgtagtgaatccatttcttttttggtctggactctacttattttaatgaaacccaagatttcattagcacttctagtagcagtgtctttctacttggaacgtgttattttatggccaaacaagatcaaacacaaacaaaaacctttgggtccgtcatcttctttttattttaat

SEQ ID NO: 146317 - DNA, 126 bp, Homo sapiens
tttaatttagtctgctctaaagtcatctccacagcggtaattttgtgatattgtctataattgggaaaagtttttcctcttagttgacaaaaccctccagtttaaaaatatatattataaattact

SEQ ID NO: 146318 - DNA, 191 bp, Homo sapiens
agagaatttgaagcagttacctaatttgctcttattgtcaccattttattgaaatggaaagtaactagacaaaaagaaaccttaaaagattgtcgcctaaatctcttctcttcaaggtacaagttacccttaaactcttctctccaggtaccttacaccttagttgtgattatccagctgtcctagagcaa

SEQ ID NO: 146319 - DNA, 177 bp, Homo sapiens
agtggcctgtggtaataatccggtatacgacaatgcctcaatagcagaacaaataacaaatggcatattgttagagattttagactacaaactgccatcttgcttcaaggaacatctcataccccattcatattaccctctcaaacctgaaattatattgcaaaagcttcaaagtaa

SEQ ID NO: 146320 - DNA, 1158 bp, Homo sapiens
gacctcaggtgatccgcccatcttggcctcccaaggtgctgggaatacaggcgctctgagccaccatgcctggccctgtttattttcttaataaactcgctttcactttactccatggactcaccctgaattctttcttgtgcaagatccaagaaccgtcctttggggtctggatgaggacccctttccagtaacacttgggcaatggcagatgaaaggagaagaggccacagacagaggtctggaaaagacgcacgcaacgacatgcaaggtgttttttctattaagtcatcactgaacaaattccaaggagaaaaaggtaaaatggatgcaggaggattagaatgaagcactactgcttgtaaaacaaatcaaaactaagaacctaggaaacgataataatgctgtttaaagacttgaaggaaatctctatttccaacaacgtcaacagaaatcaaaggagaatatatttcacttttcaagagtgaaagataataaaagtcaaaccctatacaacatcaatcctgagccaaatcctatcttatctctacttttttcttctccttttcaacgtgtgtagctaaaccaggttgcaatctagagctggactcgtccagaaagcctggcaaacatccacagctgtgacaagatgctgacgagcctgttgcagtggggtcttgatgcttccactggggaggaatcaggagaatgtaagtaaaaagcaatgaaacttctgcaaataattaagtaattcacatccaccccttgaagagaaaataattcctcccttgtcactgtgacagcctcggctggctgcccagctgagaacacccagcaagcaccctctcagcaaagccaggtggggaggggagaggtcagccactgcagcctgcaggctctctgaccatgggcacctccacagcagaccctcccagccaccaaggacatctggcccaaacacagcatgaagcagaagtggcttcggccatatccaccacctctgtgcaggctgtcacacagaaccaaccccaccccagcctacgtgaagctccatgctggagccccagagcagcgggacagatcactgattcccttctatgaagcatgtgtgcctccctgcatccactcaggctccagtgaaaagcactatttggctcc

SEQ ID NO: 146321 - DNA, 431 bp, Homo sapiens
  misc_feature (18)..(18): n is a, c, g, or t
  misc_feature (26)..(26): n is a, c, g, or t
actactactactaaattngcggccgntctgacgacaagggaggaattattttctcttcaaggggtggatgtgacagcctcggctggctgcccagctgagaacacccagcaagcaccctctcagcaaagccaggtggggaggggagaggtcagccactgcagcctgcaggctctctgaccatgggcacctccacagcagaccctcccagccaccaaggacatctggcccaaacacagcatgaagcagaagtggcttcggccatatccaccacctctgtgcaggctgtcacacagaaccaaccccaccccagcctacgtgaagctccatgctggagccccagagcagcgggacagatcactgattcccttctatgaagcatgtgtgcctccctgcatccactcaggctccagtgaaaagcactatttggctcc

SEQ ID NO: 146322 - DNA, 421 bp, Homo sapiens
gcacatatgcctcagaaggcaagttagagcccttggcacaacctgctgcagccactgctggggagatacagttggcactgacccagcctcttggaggagcagcacttcaaaagagcttaatccacaattcatctcgtccacctgtgcatactcctcacccatgctgcaacatctaagcctggcaggatttgaaagggagctttttgctacatcataaaatgtctccctctttcaaaaacattcagaatgaaaccccagctggccaagctccctcctctcttacaaacacactgaatgactccagttgctgggaatatccctttcccttcttcagtcattcaaattctcctcttcctcttttggggccctgcttaagctctcagaatttgaaagtctgccccacccagctgaacagcctata

SEQ ID NO: 146323 - DNA, 304 bp, Homo sapiens
  misc_feature (155)..(155): n is a, c, g, or t
  misc_feature (207)..(207): n is a, c, g, or t
  misc_feature (221)..(221): n is a, c, g, or t
  misc_feature (239)..(239): n is a, c, g, or t
  misc_feature (242)..(242): n is a, c, g, or t
  misc_feature (252)..(252): n is a, c, g, or t
agttgatacagaaaacaccggtacgatttggcattcattcacaataactggcatcaaaagagactgtccttaaaacaggtgaatagagtttaccgtaaacgtgcagtgtattttatatttcaaaatgaacttttagaagcagtcagctccccccngatccttctctaggtctcgtagtcgatctaggtcaaatgaaaggaaatagangacagtttgcaagngaagtggtgtacaggaanttncttcatttgncaggagtatgtacagaaattcaagttttgttttgagacttcataaggcttgg

SEQ ID NO: 146324 - DNA, 876 bp, Homo sapiens
  misc_feature (865)..(865): n is a, c, g, or t
ctattggatagcaatggtctatgccaattctgcaagtagatttgttatttctcttccaatggtggcttttaaaaagcttgtagaaaatatgatctagaataacgaagaaacatgaaaatatacagcatgtctgactcagaatgaagacccttgatactgatctaatataggaacacttgtatttctcatctactgtcacttgacgttcttatcaccagttttcctagagaagagaaaatcagtcccacctctgtgaccactatgtatattcatatgtatagccatacaaacacactgtataatttacattgacttagaaccgcaattaactacatacaaatccctaacagtgtcagactgaacatcaagatctttgaacatgaaaactacctgggttcccattcaccatccaaccatcctcaactcccagcatgtatttcaatatcatagaaaagaagggccgggcatggtggctcagcctgtaatcctagcactttgggtggcgaaggcaggtagatcacctgaggtcaggagtccaggaccagcctggccaacatggcgaaaccccgtctctactaaaaatacaaaaattagggcatggtggtgcatgcctgtaatcccagctactcgggaggctgaggcaggagaatcacttgaacccaggaggtggaggttgcagtgagccgagattgcgccactgcactccagcctgggcgacaagtaagactggctcaaaaaaaaaaaaaaaaggttgatggacttacttaaggttccaagggtgaagtgggacagggacttatttgtttagacttgggttcaatgctagtagtctgttttcccatctgtaaaaggaggacactaatgnctgtttagcta

SEQ ID NO: 146325 - DNA, 912 bp, Homo sapiens
caagcaagggtgcaccccaggcccagaggtgaccacgggaccctttcaaaacaaagctttcccaggatagccctgggcagaactcctgggattgactgggcagtaatgtagttgagaggggggcctctctgcatggggctgatggacagaatcacaatctattccccaccagcctacccaccctaggtaccactctacccagtctgtgctttatagggaaggaaaaaaaaaccaggcagaacactggcttgggctattggaatcaaggacacagataagtatcatgggtgccagctacctgcaccagcctctggtggtgcctgatgggaaaactggtctgaaatgtgggttctaggttctaaccctctggagaagagcttgccctcctaaggaagagctcatttcttgtaaaactcctcccccagggtatggaaagtcccatgagaaaaaagaaacgaacaatacgcagaggagaggaaatggggtatgttctttagccttcccaaagtcttgactaagttctgccatctgccatcagcaggctgcaacccactgtgaggggtgaggaagaagcctgtggcccctgaaggtgaatcttggctgaggaaggcagcaaatgagttgaatgggaaatgtccctgaaatgagcgcctgactcaccgtccatggtggtgttgaagcaggcagccaggagggaggaggctgagaagagtgtcatagcgcaccacatggggaattggggctcaagcgctcatcgtccagccctgcccccaaagtcttcctccaccactcctcaaggcaggagtcccagaagccaataatctaggttggaccaaaagcccagacccagccatacagctctgtcttagtcctcacccatctcaggggatcctataacctttggtgtcccca

SEQ ID NO: 146326 - DNA, 616 bp, Homo sapiens
agcatcctcccactttttggattgggaagacagaagacactgtcacaatggcccttaaaccttcccaaccctagcaaagtagctggttttatgaaaacacttaattcctatgaaataaaagccacatccttagagtggcatgcaaggctttccacagtctgggtaaactcacacctcttgctaccatctctcagtgccctatccaatacattccatggtttccaacttcagtgcctttgctcccatcatttcctgtgccttaaatatctattcttcccattttcacctaaggcgtctccaagttcctcaagttcatgttcaaatgcctcatcttccaagatgctaccccgcatcctgtgggaaacacatcttcccctccttgagctcccacagcgtcacaaggcctcccatggcatctgcctctcagttatttggtgttttgtgaagaattaccccttctgttaactcctcaagagctgttgtatgccacagctcttagcaaaggtattttctgaatgcacagagaatgctccatgacatctaggtcaagaaaatattacaaaagaaaaaagaggaaatgatttcaaaatagccagaatggctgccaaattcttcc

SEQ ID NO: 146327 - DNA, 895 bp, Homo sapiens
tctgtgtggtgaggtactgacctgacaaaaatttccttaaatgtctgcagagaaaagagaaaatggtcatgtctcagtaaatctgtgatagatgctacagggaaagctgctcctgcccagaaggctgaaaccaaggaagtgtctgctccagaccagcccaaacacacaatcccaaattttggtaaaagttcctatcagccctgtgtacagccagctgtgccaagaacatagtatgctattcccaaagctgagttgggatgaggaatgagggatagtggctggtttgtactattcacttatgaatgatcaccagcgtctccctggattgctcctgtatttgttttaggtgtacagtcaggttctagagatccaaagtagttggtttcaatcattttttcccactcaatggttgcttgggtggaagtacttatacctagaacttcttgccacaccatttcgcctaaagtctctgtcttcatctgtattttttcttttttaaaaatttgttatttcatctgttttttttatgtcagatttacaaggatcttgtaactttaaaattataaaaataaatgttcggtattcttgtaatttatttttacattaaattttttattaaataatttttaaatttaagactttatcttgtattaacgtttatgtatgatgaggggtaggtggctccccaaattttattttatgttggaatttctttcggtgtgagacaagaattcaaagtaatatttctcagttgcttcccagttgttttatactacttttctgaaaaatttatataccctatttgaaatttcattgtatactaaattccttgatatattggggcctgtttcagacactttttgctggtgggccggctttcttattccttacctca

SEQ ID NO: 146328 - DNA, 411 bp, Homo sapiens
gtggcttaaacacaggcacagggcctctcccagcgcctctgaggggctgtctgggcggatgtactagatagtgctcttgagttttgtttttattccttttaagcaccacttgaagatggtgcttcagaaaggaagttccgaggtcaagtcgtgactcagggttcatgccctgatacacagctcaccctggctgcatgacagcacgtccatcactgggaattttagctgagagctgccaatatttcttttcccttcattcagagaaaatggcagcacacatagcagaagggcatgggagagggaagtctgtggaacacacaaatatgaaagtgtaaaaacatttgcattcggcactctctcctccctcatcatctttacatcgcatctttcacgtaagtactctgatggcta

SEQ ID NO: 146329 - DNA, 412 bp, Homo sapiens
tattagtatggaaaggggagttactcttctggtgtagtggtccgattgagtccatggcttcccagccttaccagaggtgataaaaatgtcaattcctttggggccaatcttgctcctccagtgtgttttagccctaatgaggtcatggttatttctagacttctgagacttactgtggctttgaattgacacaaacactaattttctgtcaaaggctagagtgatggatgttatatgcctgaattttctttgaacattttattttaaaagagatactttgggcttttcatgaaactaaaattctggaaccctagagcagtctattatatctgtcaccacaaggactttccttaaaaagctccctccataagcacttggatgtgtaaacaagatcctttcacagatctttttc

SEQ ID NO: 146330 - DNA, 440 bp, Homo sapiens
gtcttccagcccacagatggcacatgtttcaagctcagaggatgaaaggtctgaggaatatttcaacattgatttagaggcaagaaggaaagggcaatgagttacctgggtccaggaagatatcccaagaaatacggagttgctgggaagtttggtttaagaggcagaggtcaagtattaattgtatcatcatgtagaccccagcagaaaagaatagcttagagcataagctctggagtctgagtctcagggagtctgagaattctgagttcaaatcctagcctctccactcttaaggctgtgtgtgatccacggtgtaatcctgggaaaactactcagtctctaaaactcattcctcttctgggaaatggtgataaaaatacatacttctcaggggtaatccaagaattaagtgagaaaataaatctgtgaagcttagc

SEQ ID NO: 146331 - DNA, 539 bp, Homo sapiens
aagagagccaccacagattcctggggagcatcaacatttaacagggaggaaaaagaactagtagaggagccacaaagagatggccaaaagcaggagcccctggagaacatggtgtgatggaagtgtaaggaggtaaagtttgaggaaagggggcatggtctgcagtgttaaataccacagagaggtcaagaagcatgaaaagtgaaaactgccctttggatttaacacttagtgacctaatggagaaggcagggatgaggaaaagtcagattgtggtaggttgaagagataaggcaatggaaatgccaatatacactgttttttcaaaagcctggctgtgacaggaatagagtaaaataggatggtagctggaggggaccaagaagatcaagggagaaggttctttttttgtgtgttcttaaggtgggaaaaatttcagtatacccttgagagaaggagccagcagagaaaaagaagctgggacgctatgatgggaagggggacaactgatgataaaggtggtggagaaggcaggcatg

SEQ ID NO: 146332 - DNA, 787 bp, Homo sapiens
gtaggattaaaggttgtctgatcttgagatgggtaaagaatttcttgatttttttttctctttgtaaacattttttaaaaattgttttattgaggtgaaattccctaaaatattaaccattttaaagtgaacaattccatggctgttagtgtattcacagtgttgtgaaactgccacttctatctagttccaaagcattttcatcaccccaagaaaatactccatacctgtgtagcagtcagccctcccttccctcctccccccagccctgggcaacaaccaatcatggttctgtggatttgcctcttctgaatatttcatgtaaatggaatcatagaatttatgactttttatgtctcctttcacttacaatgtttttgaagtttatccattttgtagcatgtactagtatttcattcctttttgtatgtggataagattccattgtgtggatataccacatttatccattcatctgttggtggacatttgggctgcttccacctttggctattgtgaatagtgctgctgtgaacatttgtgagcttatatttgtttaggtaccagtgttcatttatttggggttagaaatttctgggtcatatggtaattttatgtttaactttttgaggaactgcccaactgtttttcgtagcaagctgtgccattttacattctcaccaacggtataagaaggttccaattcctccacattcttgccagcttttaaaaattttctccttttttaatgacagccatcctagtggttgtgaaacggtacctggtt

SEQ ID NO: 146333 - DNA, 259 bp, Homo sapiens
ggttcccattttgtagggtctacacagggaaataataagtgaacaaatgtgggctgaaagcataatggctaataatatttcccagaagagaagaaagaggtgagctgtgtctttacagacattgccaataggtaagagagggcacagaaactcaaagaagccttagatttactgaatgtaagagaaggaagaggagaaaagagatgtagatacaagattaaagattataaataaaattaccataagtgaccccaattta

SEQ ID NO: 146334 - DNA, 994 bp, Homo sapiens
aaattcaactccctcatctgagaaccttgactttccagttgccttgaagtattgggaatagtaactgtacgttttcaatttaattatttggtattttatttgactgtcttggccatgtcattttatggaagcatttttaaatagcactttttgttagtggtgtggaatttctgcggttattttttttttttgcaacagatgaagcaaaaaaaaaaaagcactcattggagaaatagtgagtgtaaaaagagatttattttgtacagacagcaaagtatcctgtgtaatgttgctgacataaagcactttgggggaaaaaagtggaaatctgttttccataaatcacacagactcttgtacatagttatatacactcacgtagagaaatgaactgcatatatcatactggatatggggccgattttactctagaggcacatctggtgcttattgtcataaatcttttaaagaattaggtacacttttttctattaatatgtatagttttgtgatttgtcacagttatgtttcatataatcataagttattttgtcttgttcatgaagtcctttttttatgtcaaaagtaaaatgaagggattgtgcacttggtacagaataaaactggaaatagagaagacgccctcctgcctaaaatcctccttcagcctgtcggtttaaaacacaatggcaaccatcattgtttgtttgtttgtttttttgttttgttttaccatcagcctcttacatactgggaatggtaattataattaaaggcagatgatgcgggagggaatgttcaagtccagctttaaaatgctgcattgctttgggccagagctgtagcctggatttaattatagatatgaggaggaaatggcagtaaaaatgaatgtctccctgagtcctttacatgttgggagtgtccataaataaaacatgaagttttatttcatcagatttaattaaagcttttatacatgttaaaaaagtta

SEQ ID NO: 146335 - DNA, 149 bp, Homo sapiens
ccaattaatttgtacagaaacatttgtagtatctgtgtggctggccctcttctccaaagattttgccagctttcagccacagacctagttttcccttcccaagaatctcagcaacaacagtcatctttgatattgccaaaggcccccct

SEQ ID NO: 146336 - DNA, 543 bp, Homo sapiens
caaagtctttaaggaaatggggggactgccccggtgtctggaggcaccatctgaccacagcttctcatcattgcactcatctttaggttcttggatgtaagttgatgtagaaatacgtctgcctagcacctagctttggccaggggttgatggcataaatggggaggcaatagtagctaatatgtatatgcatgtatattctgtgtctgccacctgctgataactttacagacattaccttcttatatcctcaaaacaactctaaagagtgagtagaatgattaaccccattttatggatgaagcttcctactgaagctgttgtctaattctggagactgtgattttatttatttatttttttcagatgaagcctctctctgttgcccacgctggagtgcattggcatgatcataacttagtgccacctcgacctcctggcctcaggagatctttccgcctcagtctcctatagctgggaccacaggcacgtgccaccatgcttggctaatattttcaatttttttgtagagatggggtctca

SEQ ID NO: 146337 - DNA, 432 bp, Homo sapiens
gcaagcctttcaccagtttttctgttggggtgtttacctttttctcattgcaaattctttgaggccaggttttaaagagtttcttctggggaaatcatttatgttcatgtttaccaggtaccttgaaggggcctctaccaacttgagaatattttaaataaaagtttggtgtgtatgttttctattacatcaggagtgtaaatttcaaacctttaagtgctggcttacagttatgaattcttagggcatactttccttgcttgagctgaggcaggcacttttcaaaaatcttcctttccacaagggagatacaaagatatttttagggttagttgtcatcatttgttctgttacctgtttcattttaaagagtctttaattttttccttaaagtaacagttttctcaaaaaacattttcttaatctgtatta

SEQ ID NO: 146338 - DNA, 230 bp, Homo sapiens
atatggtatgtttacggagtgaatggacacaaacacgaagcagaacttatatcagacccaaactggcttttaaagagctcggttcctccacatttatggccacaagacgtcccctaagtcagagctaactgtggatacttccagcagtaatgtctcctgacttgctggcaccgagttgcagtgactccacctcactgccctcccaggctgtctgcgtgtgcacacacttc

SEQ ID NO: 146339 - DNA, 189 bp, Homo sapiens
ttaatttaaaaaactatactggctaacaatttagcgaacttggtgcgggaaatggcacagtaacagcttcatctcttcctaccaagagaggtaggaattataacattttaaatttctgtgttggaaaatttattcattttaagattttttgctgttacttaaattttactgaacttagtttattcctga

SEQ ID NO: 146340 - DNA, 358 bp, Homo sapiens
tccggatttgctgtaaaaggaagagaaatacaaactactggctgcagaagctgtataagatttggaaggaaaatgaggtgcagtgatgttaacaagcagagacaaaggctttccaccctacctcagattgcatcctctcctcagcctgaagaagggagcacagaaggagagaaagagagagaaaggaagtagttactatggaggtgaagaagtcaggtcccagtggcagggtaggaaatgtgaagaagcatgactcagaggtgcagagaggctgaaactcttgtttcctggccctggctcctcacaggactcggctcagatctatactagggtttcaataaaagatttctttggagct

SEQ ID NO: 146341 - DNA, 398 bp, Homo sapiens
tccgcggcctttcgaaagcgcttcccgccgcactccccgggccgagcgggggctgcggcttcatcctcccggggcctcctagcctcctcaggccgtctcgtcggggtgggcctctctgggagtgtagactctggtttcaccagggagaccgcggtccccagggttccaggcttccttgcctcccttgcccagccttttctcaccgtggcgtaacctaactcagcccgttcaggctcacgttaattcttctcacgagcttttctctacaggattctcttaagcctttctccttttcggtggagctcagtgcttccaagattagatcgggagttttcttcatgaggtcaagatgtgttttttttgggggggaggcaaaattctgctactaattgaagaag

SEQ ID NO: 146342 - DNA, 721 bp, Homo sapiens
gttgtggcagactggcatctagtggccagcgataaaggtgcagactagtgtccacacctaagtggggacagtgcaggctgtaatgtccatacctagtggggacatcaatggggtatttgtcagagaagctccatggcatagtttggacattgtttctggctgtgcaggttcaaacccagagtctggctctcccaaagattatctgagttattctattattttacaaagtttgaaatagccattagatacccttacaaacttatcatttttgtgattgattttaagtctactgaaaatgtcaaaagaaatccaaaactgattgctagtaactaggccaggtgtggtggctcacacctgtaatcccagcactttggggccggggcaggcagattgcttgagctcaggagttcgagaccagcctgggcaacatggcaaaactccatatttacaaaaaatacaaaaaattagccggacatgatggtgtgtgcctgttgtccccgctactagaaggctcagaaagaaggatcacttgagcctgggaggcggaggttgcagtgagccaagactgtgccactgcactccaacctgggcaacagagaccccagctcaaaaaaataaaattagtgttaacttgtactgtttagccacattcattaagtttttaattttaactctactatcgcacaaccaggaatgtacaagagatctggagcctgatttg

SEQ ID NO: 146343 - DNA, 579 bp, Homo sapiens
caggaaggttctacccagactgtcagatggatatggccctgctgatgccctgattttggacatctagcctccagaacagtgaaaaaataaatttccattgttttaagccaccattctttgttacagcagccataagaaactaatacattgagttctgatattgagcattttgcattatttgacaacacttgttattacagaaacctacggcctgcacaaatcaaattgcaaactccttgacagccaaaagtgctttctttgtctttggccttcccactttaaaagtacatgtttactcacatacacatattttgattctttgtgtaacaagtcatttctttggtggttaaggatataccatgtataaggatagtgcctgcttatgcatgataacaaatcaataaataggttaggctcatatagtccaagtgacagtgtgttcaggaatattttttgtgtgtatttttaaagtagttggacacctaagcaaactagctagataagcctctgttcttgtctcttctttctctttctttctttctttctttctttctttctttctttctttctttctttttc

SEQ ID NO: 146344 - DNA, 379 bp, Homo sapiens
cagtaaagacgaccatacaaagtttaggggctttagtgggctatagttcaggtagctgtgctgtgataatgcgcaatagctgcacagttgggtatttgtattggcagagatttgttcgctcttgatacgtgctgggagtcaatgatggaggaccgctgaagggctatgctgttgagacgatgtgtgtgtgctgctaaacttggctttggtcattgtgatgcactaagctcagtctatattgcaacaatcttcccagttaagtgacccatgtgccatttatcaggacacatattagaaagatgctgtcctaatttcagttaatgctaagtgtagccaaagaaactcaaatgaatgccacagctctatttcactgcttttc

SEQ ID NO: 146345 - DNA, 267 bp, Homo sapiens
gccaccttaatattttgctgttgttacattttcagatgttttaatttactcattgatgcattcatatggatctcttaccatctgcaggatatgtttgctgttaaattataaagattgtaggccctctttcttaggcataaacctaacataggcacagtcacccagaaaaatgtaagcataaacctttttttttgaaaaagagtcttgctctgttgcccaagctgttgtacagtggtgcaatcatagcttactgcagtctcgacctcc

SEQ ID NO: 146346 - DNA, 546 bp, Homo sapiens
tgctgggattacaggcatgagccactgcacctggccaaaatatggtaattctaataggtcacattcaggtgtattttttttaatggtctaatataacattaaaagtatttgtgaaaaattccattttggtattttaagcataatctatccaaaaggaacattaaaaaataataataaaaggggaatgtgaggtttaggtttttaagatgttcagtatttttaggtaagagtgttgtagtagtttgctagggctgccatgacaaaataccacagacccagtggcttaaacagtactttcctcacaattctgaaggctagaaggtcaaggtgttggcagggttggttccttctgaagcctctttcttggcttgcagatggctctccttctctgtccacagtgatcttccctctgtgtgtgtctgtcctaatcttcttataagggcaccattcatattggattagggcccacctgtatactcagtttacctcagttacctctttaaggccctgtcttcaaatacagtcacattctgaggtaatgggggt

SEQ ID NO: 146347 - DNA, 191 bp, Homo sapiens
gactgtatttggagatggagcctttgaagaggtgatttaactgaggccgttagggtaggccctaatccagtctgattggtgtccttataagagaggagattgggacacacatcagggacatgcgtgcacagagagaagaccacatgaggacacagacagtggccacccacaagccaaggagagagtcctta

SEQ ID NO: 146348 - DNA, 700 bp, Homo sapiens
ctgcttctggccatatcatccactccctaatctaggcgatgctgggagtccccttaggccagtgtcagggtagcgtgggatagaggccatgctgaaaacgcagagcttcatgatggctaaaaggagctgtcactcaccaggcactaagaccagttgatggtggtaaaagctagcaaaacagaaagggaaatatttacctaaattgtccactaggtgccaagtacaaagtgctgtcccatatattacctttatcatcatgacaagcacttgagatggtaattaacaactccactttaagtctgagaataatgaagcaactgacccaaggctccaaagacagtgaatggcagagatgagattcaaacccaggtctccctgactcgaaagcccacgctttcccccaacaccatgttcttttccttccctgtcagaaagggaaataccaaaaacaaatgagggtatgtatgagggtttggctggagccccagtcagccaaagtctgattccaagtggactgcagggtccgtgttatctcccttgggcacaatctcaaaagcccagaattccgcgccttgctaaccttccatcccagtcttagtgagaagctaaactaacttctgggcctcaattacagcagattaaaaggcaacaaatggtgctgatatctctcctctagtattcccaataagccatgcaacag

SEQ ID NO: 146349 - DNA, 318 bp, Homo sapiens
aggcaacacatctgttggtttatcatcaaacatgaagcaataggaaggaatcaatagaatttggagaagagtaaaacatactcatttagtccttttagaatacaaaaaaatcactgtctagctttaagaaaagtttatttatgagttactttttgagacacagaaagcctttttcaaagagaggatattagaaatgatattcaagacctcaggccctaccgaaaatttatttttttgctcaagttaatagaaaccattctaaaagtaaacaccagtcttgtggtcctctgaggcccgaggatcctcagtgggaggaag

SEQ ID NO: 146350 - DNA, 389 bp, Homo sapiens
gtggggagaaatccccacacctttttctgtgttgcatggtttgtttgagactaggaaaaacattttcattttcctatctctactgtaactacagacagaactaaagccccctacatatggccctaatacacctttcccacccattccaactgttagagccatctcagctaaggtaccaagcattgtggagcaaagataagtcatcttcactgtgctctgcctgaattcttgcggtgcaaaattatgagcataataaaatggtggttgtttatgccaccatgtcttggggtcagaaatagataaatgaaacgcctggctagtgttctggcagtcttcagtggcaatctggtcaaaccccaggctcaattaagattgtgctccaatgccca

SEQ ID NO: 146351 - DNA, 405 bp, Homo sapiens
ttctaagccagcaaaattgtatctccgaccattcctctgtagtcactttgtccttggactctcctcttctgcctccttccttcacttttaagcacacttgtgactatcatgggcccacccagccaacccagaataatctctctatcttagggtcagctgattagcaaccttaattccagcttcaaccttatttctcctttgctgcataacctgacatattcagaggttctaggtatgaagacatggacatctttagggatggaggtgttattttgcttatcacatctggcttcaattcttccttagcatgtctgtgaccttaatcattctgttggttaattgtttgtcttacctgctaggatgtaagatcctgggaatcttcagcctgctatcataggtaaaatc

SEQ ID NO: 146352 - DNA, 768 bp, Homo sapiens
taaatgaggggctggactgcctatatattttctagaaaatgtagtcttaatgagtcactgttatggttggaaatgtatcctatccctcaagtatgctggggaagaaaagtggttaagacatactagattctatgatactccagaactgcactgctcaacacagtggctactggccacatgaggctatagagcacttgaaatttagctactcccaactgagaggtgctatgagtataaaattcatatcaggtttcaaagacttactcctccaaaaaagggtgtaaaataagtcattaataacttttgtaacgttgactacatgttgaaataatactttgtattaggtcaaataacatgccattaaaatggatttcacctcttcttactttcttagtatggtttctagaaaacttaaaattacatacatggtttgcatttgtggcacaccttatatttctattgcacagtgctgctctagagcagctctctagagcacttgttagaaatgcaaacccttgggccccagctcagacctactgagtcagaaactccagtagggcccagcaatctgtggcaaacaagttctccagctagtcctggctcacactgacattaagctctccaccaagaaggtaagctctaaagcactgaaaataagatccagagcataacgggatctcaataagttttgttaaatgatttaatcttgatggttcctgttaagctcaaaattattctgtccatcagtcagtcagtgagagagaaagt

SEQ ID NO: 146353 - DNA, 105 bp, Homo sapiens
ctgttaaaagaaaaccagaacccaggatgtagagctggcagtgcctgacggcgcgtctgacgcggagttgggtggggtagagagtagggggcggtagtcgggggt

SEQ ID NO: 146354 - DNA, 235 bp, Homo sapiens
cacagtgggcctgactgtgacaaattagcagggtgatgtggccttctaccttactgcttttatagttgtattttatatagcagataattttgtgaggggatatttgagaggttgggaggcagggaaggcgtttctcacttgagaaatgacaagagacccaaagagggggttaatgggcaagagctgggccttaggaaccctgcctcactaggccatacccaagctgtcctgcctg

SEQ ID NO: 146355 - DNA, 301 bp, Homo sapiens
aatgcataggctgaagattgaggactcctttcattattgtgaatttaagtgatggcttcaatgtttaaatttgagtgaggagtggttaattttagtgatttagagtgatgagttattattttccccaagtgtttattcttaggaaaaagcatatatttggagagcttggagaaagttacacattttttttcgagtagccacttatctaacaggaaagtgatgtatttctcagaactctcccttgctcacccctggaaatgtcaagtacttttttctttctgatttctcattgtcactgcct

SEQ ID NO: 146356 - DNA, 360 bp, Homo sapiens
aaaaagttaaaatgttgctattgctatcattaaaagctttttgtttgggtctgtagagatagcttctcactttctatctggagaagcgttcctggaccttcctcgagggcagcgaggagaggcgttaggccacgtggacttctgtgggcctgcctaggccgtgaactcccaggcccactccctctagggtgatgacttgtgtgtgaacacggatgtcagtttcatttagaatcaactcacatggaatctgtagctcacaagaaatgtggttacagaatatgcttagtaatgcttggcatgttcatttctttttttttaaggaaagactggaaaaatctgagcctgaaaggcttcatctgg

SEQ ID NO: 146357 - DNA, 646 bp, Homo sapiens
ggacgttcacgcccgcacctttccggcctgtggcggtttcagccccagaccgtctgcctccggaggatttctggccatccaagaacaaacttccgaatctccaaatttccaagccttggaattgtcaaacccactcaagttgagtcaacaatgacccacagcacctaccagaaatacttccctcaattgcaagacttggcatttaaaactggaagattcttaccacatgtgctcctgggctttgcggacttgattgtttccatctaggcttttgacctgtgtcacaaagaagtaggatctaggttttaggatatataacgaacatctacaaatccgaagaggacaaacaatacacttggcaatagacattgggtacaaataggtaattcacagcagaagaaacctaaaatggtcaatatgtataatatatgaaaagataacccaatctctttactgctcagggaaatgtaaaattaaaacaacagtgagatataataccattttacatctaccagatgttgtgcttcatatttttatcactggagcttagtagagggtggacactcaataaatgtctgtggtcattctaggttgtggtttctggggtgttttagatgagctctccataattaaagagatacaaatt

SEQ ID NO: 146358 - DNA, 289 bp, Homo sapiens
gcccagaatgacccagattatcagaatgacttttgagtaatattaatgcttattattttcagttcttgagttctgaggtggtttggatttagcagtagctaatacaagaggacataaagaactaaacctagtccctacccacaaggactgcacaatgacaacctattgaagtttaaaatcttcaacagatcaacctctgatcttaatagaatgtagagtcctaacagagggcaggcttgacatttttcacatgtctctctggtgccatcctcctctcttctctatcttg

SEQ ID NO: 146359 - DNA, 505 bp, Homo sapiens
ctattttaaagtgaaaaggtaagaataacccatatgaaacaattagaaaatataaagcagctggtgttgttagggatagcaggattttagaggagggagaaatcagcaggcctcatggtaatcatagaaaaaccatccgagaagtaagacctaagctgggactcaaagaattggtatgtggggaatagacataaacaagggagaaatatgatgaaatcatctgaatagaaatgaacatggtgttttgggggagtagtgaaatgactttactcggtgaaatggatggtttgagcaggaaaggagggagaagctggtaggatagtaaagcaaagctgttgtgtgaacccaagaatataaggattcatcagcatgttatagggggcatttattaattcatcctgaaagtatttattgagggcatattatgttccaggcacaaattaaacaaaacttttccccttatgaaatttatatttaatgaaggaaaatagacaccccccccaac

SEQ ID NO: 146360 - DNA, 446 bp, Homo sapiens
taagccctgctctctcctggacagacgccagtctcctgtctgcaaacgtccctgccattcagaactcagtccttcctggtgaatccccctcccagctcctcaccaactctgctgtccactgccacttctggtcccatgaggccccagccaaggctggccagtctccctggacccaccctatatccgttctccacagacaaggtccatcagggtaagtctattccagttttctccaatcttggcattttgcagtatctaattagcttcattcccttatttgtgcctcatctcctttctgtgacgttaagataatcccgtttccctaatcctatcactattctggcttattgccaggcatcctcatttgaaaagtgagagtgctgaagccagagcaaggctgtacgacgaggatatggcagaacctggacttccgtggccagacagga

SEQ ID NO: 146361 - DNA, 386 bp, Homo sapiens
gtgatggaaagtgtggaaatagaggggggataaagtaattcaatgacagagataagtggcaaatgattatcgtatgctaaactcagactccaaaatccctttgggaaaaactcctgtaatgtcaagtagaaagtttagccttggcttcctcagtgagatatattaagacttttaaggcactgagagcgcatgaagggtctcccttttagagaccaacatgaacatccaaatactcaaaggtacttcaaagcttaacagacctggttacgacttctgggcctctgaagtttttactccactcacaaagtaacaatgtatgtattaatactactaccattactataaagacaacaataattacaactatcactgccagtattgcccct

SEQ ID NO: 146362 - DNA, 692 bp, Homo sapiens
aagaaaaaggaaactatgagttccactcctgtttttttctttttttagacagggtctcactctgttgcccaggctgtagtgcagtggcatgatcacagcttacggcagcttcaacctcccaggctcaagtaatccccccacctcagtcttccaaatagctgggactacaggggcgtgcaccacacccagctaattaaaaaaagaaaaatttgtaaagataggatctcactatgttgtccaggctgatctcgaactcctgggctcaagtgatcctcccaccttggcctctcaaagcactgggattacaggcgcaagccacaatgcctggctgtgtttcacttctaattctaccctgatcattctgcccagggctaactgcaggaaaaggacccagaaactcccaggtggccaggaaagcattctttcttactcaattcttgtgcatgttcccagcttttccttatgcagctacaagcacatcaaaagaacatgcatcactcccccacctctcacccacattgttttatgttttgctcttttcacttaacaatatgttctggaatttttccaaccagtacctcattgttttatttggcttcataatattccattgtgcggctataccatagattatttagttggtctcccatcatttgactcttgggttattttgagccttttcctcttaacat

SEQ ID NO: 146363 - DNA, 291 bp, Homo sapiens
ctggaatggaaatagtcacaattttaagggaattgcaggtaagaggtccctgacaaggtagtcttcaaagtatacatgaaagccccttcatgaggaacatttgccatgtccagagagcattgatacttcattgtacagcaccaggtaacagagcacttttatactcccctcagttccaaccctggtggggtgaaaaacctctgttcctgggatagggagggggaaagagacccaacatgggccatttcacgctgagacttaaaaatcagtcttcctaaggcaaatctagtt

SEQ ID NO: 146364 - DNA, 751 bp, Homo sapiens
gagggatcgtgtgatgcagtcggtcgcacggctcttttccgtggctctgacattcgatcctgatttaatcattctggagtgttttcaactatttttggcagctgctccaagtaaggattttgacacttgttttgctttttggtttaaggaaaaaagaacaagcattatacctctcttaaataataacatgtatctaaaataatgtcctgttttgtgaatatcccctggatgcatgttgaaaacgtagatacctggcctgggaaataggatctctgtgaagggtcctgggcatctgcattttacagtccccctcctgctgctatttaggctcactaagttacaaaaccacagctttaatggctctgcctctgtagcagggaagatgctcttgaagatgcaaattttatacttggtcgttgtgaatttgtaacattattaaaaacttattttttatggaggggaagaggcagtattttaaatgatagcaaaagaaaattaaagtcaagtactaaattacccctaattttcctcattatcctttaattattaacgttcagggcacagcactgaggaagttttctgttagtgcctatacagttctcacttccaggatttacccaaatttgttcaaatggtactattatattaccctggccccttggagtaggtttgattttctaaggtgtagaatactctagatctctttgagtgtaaaaaggtactttgttttgtttgtcctttctctgtgttt

SEQ ID NO: 146365 - DNA, 177 bp, Homo sapiens
ttgtctttatccttcatggtgctgagctccgcacaagccagaattgggtcttcctcgacctctgacaagtagcagagactctggtgcttctggtcactgcctgcacgcccggtggtccagccaccccacctgccttctccctagagacttctcccagtctcgctctagctgtgtccc

SEQ ID NO: 146366 - DNA, 850 bp, Homo sapiens
ctaatgcaaagttctatattggcttaattttgagatcatttataattaaagaaccgggccttatagtaatacatcttaatattatcacacctttaaaaggctgatggttgtatatgcaaaaagttctcaattagcattgcctattgactctacattattaattaccataaagtttatctttctggccattttcattagaaaggtttatggtcagttgttgagactcttcagattgattttgtgtaaactcgtggatgtgatggttgaaaatacagtccttaaatatgtagctacttttatagtgaactttacaaaacttgtttaaactacgtacacacttaacagtctcctgtaaatgagaggaggtgcaaaatattactggcccttttggaaaaggaacacagtacagatcactttccatagatagccaaccaatgtgaactctgtaggccgcattccaggaactcttatgaatggctgcaattgtgagctgtcatctgtggccaaaagactgttgaaaacctgattctaaggatcctttggtggcagatatttctatgtcttgttaatggttttatttgtgtggtttgctaatgatcactgataaaatattatacattgtgaatgttaagtggtgtgtcctggtatgtgccataaatacacattttgtttgtacatttatatatattttaaaccaaattctgctgctttttttacttgaagtttaagtgagaggattaagtaaatgtataccaggaggcagaactgtctcagtcttcgacctctgttgtatgaaagtctcactgaattgaagtctctaaagatggaaatttcttacttgaatctctgt

SEQ ID NO: 146367 - DNA, 177 bp, Homo sapiens
cagaggggccagacactgcatagggtcggcgcccttcagccccagggccccggaaccccctgccttggaatagcctcctggagcctcctcctcagcctctcccctcctttccccttagccccagtgtgcagcagcccaggtcagggccctgagtgcctggatgccccctgcctccca

SEQ ID NO: 146368 - DNA, 95 bp, Homo sapiens
taaatttccaccggtgccgaggcctcagtggagcctggctggcggcttgttagagcctgcagcctacctgtcctgcataggaatgaagccgggag

SEQ ID NO: 146369 - DNA, 629 bp, Homo sapiens
tggcaagtcatcttcctttccccccacactggggaagccaggcccctccttggccccttgattcttctttcctttcctccctcctcttctcagtttgctctctcccttctgtctgctttctccccttccctctccccaccttgtccccagattagaggtctaaagatagagtctccaggcccacttcaggtgggtggttttgggtttgcttgaggccacctagaattagaaagtctagagtcttcctcataagaggctcactctggtgacttataatcaactgcttatgtttattggcttactgtgtgccaggccctgtgctaagcgctttacatgccttatgtcttttaatccttacaactaccaagtgaggcagagatgatgatccccgtcgtattacaggaggctaaataacttgcccaaggcctacgcagtcctcagccagcaagtggcacagctgggatttcaatctagatctgtccgaagcccaccggtactcttgagtctttcctatatggcctgtgacagagcctgcgggagcatttaggtgtccacagaggggcatgcatttgctcaaattcagagaacaaattcttgactctgaaagaagggcttccaatcgaggaatc

SEQ ID NO: 146370 - DNA, 391 bp, Homo sapiens
tagagatggggtttcaccatgttggccaggctggtctcgaactcctgacctcgtgatccaccctcctcggcctcccaaagtgctgggattacaggcgtgagccaccacacctggccgataatttctgtattttaaggtaaattgattagcagccttaactccatttgtaagcttaattctcacttgccatgtagcatgatatatttatagattcctgaaattaggacatggacaccttttggggcttatcattctgcctaccagttattctttacacctggtactaagttgttatcctggaatctccctttactgtcattctggggagattcccttccagtctctctagtagtagaaggcccattttctctatctcatgtcttctactttc

SEQ ID NO: 146371 - DNA, 276 bp, Homo sapiens
atcaccaacagtgccaccatcatcaaatcatgatcagcatcgaccaacacgatgattcccactaccactatcacattaatagcaccactaccatcctaccgtgcccagcgagacaactgccatcacggtcactatgaccaacaccatattaccaccgctgccactaatatgcctcattgctatgccaataatcactaacagcattaccaccacactccaactaaccaatgctgctgccatcattactgccatgatctgtactaccaccactgccac

SEQ ID NO: 146372 - DNA, 271 bp, Homo sapiens
taatcgtcagcctctagaatgcctggagtgagaaaacagaatattgttcttttctgtttatattatttcatactgagttaatacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacc

SEQ ID NO: 146373 - DNA, 206 bp, Homo sapiens
aagttcgttttgctcctgcataattctgaggcctccccagccatgtagaactgtaagtccaattaaacctttttttgttctctatatgtagttcttatttatggcttcctgttcctgtttcatggttgcattgcttttttgtctctgagaatattaattagcttctttgaagttttattctgcctcctgcattgtgtcttcctcca

SEQ ID NO: 146374 - DNA, 893 bp, Homo sapiens
gggtgcttgcctgagtttagaagtaaagtggacgctgagtgtcagatttccggtctaagtcatagccgtgccttggtttagtgagaggttaaatttagctaaatataaaatataaacctatttccttgaggacggcatagcttagtggttctgaccttatcagtggaaattcttttataaattttcctttcttgatgaatttatctgtgggcatcaatttgggaattatagtcgtgcaccaaataatgacgttttcatcaacaacagatcacatataggacagtggtctgataagactataatactgtgtttttactgtaccttttctatgttagttatagttagatgcacaaatatttcctgttgtgttgcaactgcctacagtattcagtacggtaacatgctggacaggtttgtggcccaggagcaataggctctaccatatggcctaggcgtgtagtaggctgtgccatctaggtttgtataagtgcactctatgacgttcacaccgtgacgaaatcagctagggatgcatttctcaggcagtatccccatctttaagtgatggatgactgtagttgcatgccttgtttttaattgcagtactggttgccgtagtccaaatagatgagaactgtatacgaatgaagtttggggggctccacgtgggcaattttaaacataaggttaatggccgtgtttgaaactgtgtttctctcgggtaacggttggccccctccttggcttttttaacacaatggctattctctcagagggcggaagaacaggcatttttccatgttttgtgtggttggtttcacccctctctagggcgaaatggctcgggcccatggtactcgtcccgtgaataacggcgcaagaacctccgccgc

SEQ ID NO: 146375 - DNA, 554 bp, Homo sapiens
cctttgcttctctttcttctctttatttctttgtagaggcagggttttctctttgttgctcaggctggtctctaattcctggcctcaagagatcctcctgcctcggcctcccaaagtgctgggattacaggtgtgaactcctgtgcctggcctcattgtttaataaatgaggaaaccaggcgaggttaagagtagaggctggagtgacaggaatgaatggcttcttgaaaggaagagatcttaatttgggttttggagagtggactgggcttaggtaggtcatgagaggaaggcaagagggtaaattgtattgagtaccttttactagacactgagaaaaccactttgcttggagcgtggagggcaggtgagactccatctttttacttctctggacttgtagagtgcttctagcctttccatttatttagttccttaattatatctttttgactggaaattggagtctacaaactcagtcttatgctttgctcctcaaactagacttggagtgattattgctttggtaacatagaagaacaccgagcagctgg

SEQ ID NO: 146376 - DNA, 507 bp, Homo sapiens
gtaacaggaactttcactaatgctgaaaatacaaaccagtacagcaagtttggaaggcagtttgacaattctacatcaagctaaacatagtcagatcatatattccatcaatcataattcctaggcatttggcttatttatttgaaaattcattttcacccaaaagcctgtacatgaatgtttatatcagctttctgcataattgccaaaaatcagaatcaacaaaatggccttcaacaagtaaatggaaaaaccaactgtgatatatttatacaacagaatattattctgcgattaaacaaaaatgagctatcaagccatgaaaagatagaataaatattaaatgcatgttctgaatgtaaaaatttagtctgaaagtctatatattcaatgaattcaatcatatgacatcctgtaaaggacaaaatgatagagacataaaaagatcaaaatggttgcttggagtctgaagtagggagttaggtttaataggtggagcacagggca

SEQ ID NO: 146377 - DNA, 325 bp, Homo sapiens
cctgattcccaatctaataatgaagagggaccagaacactctaaaaggagtgaggggacaaagatatgcaatattctctttccatttgctttaaacttgacttctgtgaggttctctgtcaatctgtgtcttgttctctgtgtctgtcgctggtacctagtgtagtccctgtggatagttgcccttcccctagctgcctccccagctctctgtagtgtaattctcctattccaacgtctgtctttagcacgttttccctttatatagtccttgtacagagttgcttcatcatattaatattgataataataataattaaaacatg

SEQ ID NO: 146378 - DNA, 211 bp, Homo sapiens
  misc_feature (42)..(42): n is a, c, g, or t
gcggccgcctactactactactactgctcgaattcaagcttntaacgatgtacggggacatgaaacaaattaaaactctaaagtctctaaacatctttacctctattgttggaaattatgcagagatgtaatacgctacacagtgaattgtaaaacatagtgccgataattttaaaaagtcaaaaaaaaattaaacaaaggaaaagcaaaa

SEQ ID NO: 146379 - DNA, 737 bp, Homo sapiens
taggggaactgacttggtcagggcagtgggagacaactgccctgtgtaagagttgattgagctcagatcagaaaaatgaatgggcattatcaagggggaaggacaaggaagcttattttgtgtgtctgggaggacagggcaggggtagagtttgagaagtggactgtggccaaccacatagggtctcacaggccacatgaaggagtttggactttattctaagaccatgcaaagtcttgaagaattttaagtagggggtgacaggacctaatttgtcagatgtgcattttgcaaatattagctacatgaaagggcaatgtggagagtgaattagagaagacaagcgtggatgaggaaagacctggtgggggcttaaagataatggggattggaagagggtggtagtggggtggaggtagggaaaaatagtggatttgagaaataagtaaggagtacaattggcagggcgcatgatggatcaacctgtacgcaggagtgtgatgtttttcttctgacaccaaattgtttggggtttttcccacactaaccactaattctccagcttgccaacaccaactgggtatcccgcaattcaattcaattctgaaatgtcagtcacgaggcccaggcccccaggctgccacatttctgtttgatttggctacaaattcgggggtgcccatgacaccccgagattcaatttgccagaatgactcacagaactcaggaaagcactt

SEQ ID NO: 146380 - DNA, 211 bp, Homo sapiens
cttaggtgatcctcctgccttagcctcctaagtacctaggactccaggcatgtaccaccatgcccggctaatttttaaagtttttccagtggtaatgtcttgctttgttgtctagtctggtcttaaactcctgaccccaagcaacccttccacctagacgtcgctttccacctagacgtcgctttccacctagacgtcgctttccacctag

SEQ ID NO: 146381 - DNA, 412 bp, Homo sapiens
gtgttccaatgcaagtgtcaggcctgaggatgaagagagataaattaaactggtgtggatgagaattccagtttcatcacccattagcaattggtacttcagggagtcatgcaactttataacccagtttcagagtgttcaaagtgtagcattcagcatagtgccagcacatagtaagtgcttattataagctagctgctttcattactgttattactgctgagaatgtgtcttctctcctaggggtatataaacagcggatagagaattccagatcctgaggtcatcacaaggtctcacaagatcaaggaaaatcaaggaaagcagatagaaagccccattaacagaaaggagggaaatgggtgaagactgaagcaacagatatgactgccaggacactttgcatccagag

SEQ ID NO: 146382 - DNA, 579 bp, Homo sapiens
cgtgacgcgtgggtcgacccacgcgatcggacccacgcgtgcggcgagattccaccgcgggtacgcggcggcccccgatgtgacaccgacggtgctgggggtaaggggggtgttgggggtgcagagtgtggcccaaaagtgtgccctaaaggcagatcagatatggtgcccaagttaaagactctagtctgacctttctaccacctgcatgcctacctaggtatggcctaaaggcgggagaaatgtgtgcctttgcagaacaggtggctctgagacctctgaaagaggtgacttacacttaagattttcacaactcgtgggcgtgaattttcattaaaaagcctcacttactagtgaaggatcgtatatatgtaataaaacaggtctaagaggtatacaattctaaggtaaaaataattacatatatattaaaataccccatttctttttaaaggtcttataaaaatttagtaagttaatgttctatatttcactcacgcaacaactacaatatttattgagcacttactatgtgccaggcactgagctaggcacaaaaaatacctgggtgacttcata

SEQ ID NO: 146383 - DNA, 575 bp, Homo sapiens
tgggggaagagaccacatccaggaaccatgaatatgtaatgatggatttgtgccacaggagggtggttcttggagccatcacccacacagggtcacgaaggtggctgaactgggaagaacctgcaccagggaagtcagcccgatagtcatactgtgaatagaactttagtttcagtgaagcatccacttgtcacattaagttaatgtgattcacttaaatggttattgtttgggggtaaatttgatttgtaaactttgggggaaggctgtaaaattatctaataagctatagctcaaatatattttaaaaccctcagtggcttctcattaccctttagaacagagtctaagccacttagtaggccaaaaagaccatacattatctgaccactgattagcttttcaagctcatcttctgtcggttcagttttttgttgttgttgttgcaggcatgaagacctctgtcctgttcctcacacaaaccaagtcaagcttgctcctgattcacagactttaacacttgctccctctgtcctccatcttcacagggctaactacttttgaagattcgtatc

SEQ ID NO: 146384 - DNA, 199 bp, Homo sapiens
gccaagtcattgctgagctgggataggagccaggagtctggggttcgaggcgcagctctgcccctcggctgctgtgggacctgagcaaggacactctctctctctctgagcttgaggtgcctcatttggaaaaggaatgggttggagggaatggtcctgtcgcctgttgcagttgtatgcagtgatgctaatggaagat

SEQ ID NO: 146385 - DNA, 336 bp, Homo sapiens
cagatccagtggagacaaggaacagaatacaatgcttgtcctgggggagactgctcttcctagtattccatctccagatacttttcctctgcctggccctcaggcattcgtttttgaatagattggcagtgtcttcccctagttccccttttttccttccatgcattctccttgggtgatctcatctactcctgcagctttaacttctgctgtgggtttcatactctctcgtcctttcctcacttccgggttcccactcttttcttggtcttcatctagaattggtcaagcttagaaatctttagctccaacgttccaccactggatgagggcatg

SEQ ID NO: 146386 - DNA, 396 bp, Homo sapiens
ataggggtcttacactgaaggagtatgggaaatagcaactcttgtaaaaataagctggtcagtgggtggtaggtaagctgagggaaaagatttatgagcaacatcctgttctgggatcactgctggggacggaagagggggagaaactgctatataaatcacgaaggcagctcaggaaataaagtctgccattggagggtctcagggggacccttcttggatatcttttgcataacacatgggtgaaggagaatcaacaggtgtcacttttctcagcccatgtggggggttggtgctgggttgggataattcatctttcataagggaaaaaaggagcagaagatgacagagtgagatggcacagtgggccccagagtcatctctagttttgtaatt

SEQ ID NO: 146387 - DNA, 394 bp, Homo sapiens
cagcggaacaagcaagtacaaaactagagatgactctggggcccactgtgccatctcactcatcatgacttgatatgcatgagaactaggagcttgtgttaggtagagtgaaggataagctatcagagaaggcttctgagaagagtgctatataaatcacgaaggcagctcaggaaataaagtctgccattggagggtctcagggggacccttcttggatatcttttgcataacacatgggtgaaggagaatcaacaggtgtcacttttctcagcccatgtggggggttggtgctgggttgggataattcatctttcataagggaaaaaaggagcagaagatgacagagtgagatggcacagtgggccccagagtcatctctagttttgtaatt

SEQ ID NO: 146388 - DNA, 272 bp, Homo sapiens
atgtgtaaaaggaaatcttagcagctgcaactgtagcagagttcttcacagttctctgcttcagaaattatcttttggctgcattggttttggctgcctttctgctcaaacaagcaaacactccccttgatccatccagcatcatgacttgatatgcatgagaactaggagcttgtgttaggtagagtgaaggataagctatcagagaaggcttctgagaagagctgcatttgttagagtttagataatggtaaggggtcttcagctggagc

SEQ ID NO: 146389 - DNA, 267 bp, Homo sapiens
catggctttattttgtgtgcttgtgttccccttaagaagttcccattagccctcttttgtgacagtaaatgtactgttctttgaacattcttttgtgcctcagattgtgaatgccaacttgttgctttgatcttaaacctctatatggtgaagagtatcattctgtaatatgagacttgttgcttttctgtccttccagatggaagaagataagggttcagtcagctcagcatatgaatttgctgaaagccagcacagaggggagga

SEQ ID NO: 146390 - DNA, 323 bp, Homo sapiens
  misc_feature (23)..(23): n is a, c, g, or t
tgagtggtaccgtacgaatactngggaaggtaggtcatgtttcctaagagtggatttgcattgataccaagaccccgtagaaagagcatgaaaatgttatttcacttgataaaaccttattgcaatttactgttatgaagtgtctgtttgaagttgaaacaagttctaggtaagccctttgttaagcaaccagaaaatagacagggagaaagcagttagactggaatgctgattagagtcattaattagtaccatgaaagtcccgcagagttaccttccattggaaacctagatgactgcagaattaaaggctttggtggggg

SEQ ID NO: 146391 - DNA, 350 bp, Homo sapiens
aaggctgggaggctgagaagcagggcggtgtgtgggggggtgttgcacacatatctatgataagaacacgattacaaagactctctgaagagctcttacccacccatgcctgtaagaagaacttttgtcaaagacttcccaaactgctacatgaatcacaatgatagctagccagatgtacaacaacacctgcctgacacactgtcttcactaatgaactggcttcaactcctgtgataagcccctgtaaccaatattctctgtttcaaggcaaattatgtgtccttctccctgttgcctttaaaagcttccccttgcctcagcctcttcagttatgcctatggtcccaa

SEQ ID NO: 146392 - DNA, 179 bp, Homo sapiens
agagccagaacgcagggcctggcaggctgtgcctgataaaaaaggctttgacttttattcctgggaaggtgaagagctgctggctctgagcagaggagtgacatgattatacctacctcttaacaggattctttgattcatagtgtgctgcttttggggtaagaaagggaaggatatat

SEQ ID NO: 146393 - DNA, 206 bp, Homo sapiens
ctcttctatgtatagcatgtgttttctatcagagtgcttttaagactttccctttatcacaggttttgaataatttgattgtgctgtgtgggtttgaaactttcatcaaacttgaaataattttagtcatcattttttcaaatattttctctgccccttcccactctcatccttctgagtgattctgattaaacataaataaatcc

SEQ ID NO: 146394 - DNA, 702 bp, Homo sapiens
ctttataccacccacaactagtatggtgtttgtgcgatcctgtaaggaagcatcaggggacagaggccaaacagaagacttctcttctttgcctctttgtacttacaatcttctcatcttccatccctctgcccatggactcctaagctactggcagaaaattatgtccacacccccaaaaaaaaataaaaaaagaaaaagaaaaagccaaaaaaaaaagaaaccacagaaaacacaaaacagaacataaacataaagaaacaaacaaaacaaagaaacaacaacaccagaacataatagataacaaacaaataagataggagaaagaataaataggagtaaggagggcggagcggcgaccgtaccagagccctcggctgatgaggcgtggttgtcacaagcatagcaactctctagttcaaactaaaagtggcccaccagaagcctcttaaatccccttagtaaatgtagactgtttagtccaaagaggaacagcgtctataaggacactaggaaaaaaccttgtagagagagtccacacatttagggagccatagtaggcctaaaagcagccaccaattaagaacagcgttcaagctcaactaccactacctagaaaatcccgagagacatataactgaactcctcacagccaagtggaccaactctatcacctatagaagaactaatgtaagttaagcg

SEQ ID NO: 146395 - DNA, 547 bp, Homo sapiens
tcaggctcggtacccagtcttacccttactgtgatcccattgtggaaaattcactcccgccatgaaaccagagctctagcggttgggggagctgtatctgctttgattctgtgtcctctttaatccccagcacagtgcttccttcctagtgaaagcttggcagaatttgagtggaactgagtataaaatgtggaaggaatcttggggcccagagggaggagtccaaataggagatggaatcagggtgcataaggatgcccagatgatgcatttgatgagatgtgggtgtcagacagaagatgagaggttcaggacctgagtaagaaccattgtggaccacacaggacccagatggggcagaggaagtgggatctggggctgagtggaactgtggctgggatctcagccagctgccaaagctgtagtctagtgcgggttggtgtagagtatccattgggtaggacaattttggggagtctttcctcctgcggggttggttggggcactgcttagcagcaggaaggaggccagacagatggggagctct

SEQ ID NO: 146396 - DNA, 661 bp, Homo sapiens
atactactgtatgccaggtactaactacatcagacaactggaatatagtatggaataaaatagtcaagtctctgctctcatagagtctctggggtaaggggagaggtgtggagagacaataaatataaagaatgtgtattatatcagatgaataaatgcattgaaggaaaatatagcaggataagagggtagagattgatgaaagaagttcaattttagataattaagaaaaatgaaaatattgacagttgaaatggaaactgtttaccaatataaaaaatagtgaagaaaattgttcattaaatgtgatttttctatgtgatagttcatgtaggagtattttgtatataaatttaaatttaaccatttaaagtacttaaattgtcttttctattattctaaatagttttagttaaagatgtttgttgatttgaagtatttcattggttctcccttattttgttatttatttatttattttgagacagaattttgctcttgttgcccaggcttcagtgtaatggcacgatatcggcttactgcaacctctgccttccaggagaatggcgtgaatgcgggaggcggagcttgcagtaagccgagatcgcgccactgcactccagcctgggcgacagagtgagactctgtctcacacaaaaag

SEQ ID NO: 146397 - DNA, 215 bp, Homo sapiens
gaaaagcaatgtaactagaatagccgaaactattgtgaagaataaagtggaaggaatcattctaaccgatgacaagacttactacataactacagtaacaaggacttgtgtagagtggtggacacatacatcatcacaacagaacagaaacctggagacagacacacaaatatgcccaaataattttttttaattacaaagatacaaaagcaatt

SEQ ID NO: 146398 - DNA, 468 bp, Homo sapiens
taagctagaacagtcttgttagaggcaatctggccctttctgtcaaaactacaaacccatatattctttgttccaacctttcaacctcagaaacttgcccttcagagaccctcacccacgtgcagaatgatggatatacgaggctatccacagcagcaacaggtaaaggtaacagagaaagattagaagcaacctttatgcccattggtgaaatgagtggggcaggcattaaacaggaggaggatgaggagggacaagacggggcgctgacctgggataaactttctaggtgacaggtggcttccataatagatccagcccagctccccgtcttgtccctcctcatcctccctccagccaggccagcccctctcagcccccaaactccaggcagcagcctcacctctgtttcccccatctggtccacgttctgtctgtgcaaatccaccaggcctccacggcccagcg

SEQ ID NO: 146399 - DNA, 280 bp, Homo sapiens
acggggtcgcggctgggcagaggcgctcttcacatctcagacagggcggcggggcagaggcgctccccacatcctagacgggatgacggctgggaagaggcgctactcacttcccagactgggcagccgggcagaggggctcctcacatcccagacgatgggcggccaggcagaggcgctcctcacttcctagacggggtggcagccgtgcagaggctgcaatctctgcactttgggaggccaaggcaggcggctgggaggtggaggttgtagcgagccg

SEQ ID NO: 146400 - DNA, 546 bp, Homo sapiens
aaagggggtggttctggcagggagactgttggggtgggagaatgcagaagacacctcactacttcagaacagagaggagctgatatctcagtccaggatcacagtactggaatcctcaggtaatcagttaacccagcaattgtgccccaggtgtataactaacaaataggggtgcacaggtcactagaagatttgcacaaaatggaaactactgaaatgcccatcaacagcagaattgtggtccactttcttagaatctaactgctctgccttgtctttcttttcagcatcttcctcagactccttcttgatcttcattccctgcgtgctcccactatttccagctgcaggggcaccgacctgcccagggtgcatgtaacttggagaataataaggatcatagctgtggtaatagggagaatgggactctttcagttgagatgattgtgctgcagttgaagaatgcccttttacaacactgtccttactagaaataatatctgatggggaactggcctttgatctcataccctccgacctgctgcc

SEQ ID NO: 146401 - DNA, 181 bp, Homo sapiens
aacaacttaatcactctagcctttaacatcccataaattgacaatatagaagaatcaatgaacccttccccaaaacatgcactaatttccccactcacaccctgctcagttgctatctgagtaagaggggacaaaaatcaaaccacaccaccagagaaacggcatgaaaaagagacaagaa

SEQ ID NO: 146402 - DNA, 497 bp, Homo sapiens
ggggtccgagaggatccggagaggacaggaggaagtcgatcctgctggggctgacagagcagccttcacaggggacacagagctacaacaaacagttctaaacatagctaatcaatcatgaaacaaagaacaggaagccagaggtttgtggcctgggcagctgactgaagcaaaaggggaaaggtctgtgcttggccttgtcaccaccaaacaagaactcacttctacaagcgccccaattccttgcaaagactaataacccgcctgtttctgctccagatcccatcctgtcacgcccacacttggtggccttcaattcaagccactcgctgcacccataaggcccaaatcagccacagtggcaccagtttacccagctgtgcaggagaggggcaggaaagccagcgtgccagagggtggggacaggcaggcttctccagcaggagggcttctcagagcaatccaggagctgttagcccaatctgcccctccctcgt

SEQ ID NO: 146403 - DNA, 425 bp, Homo sapiens
tttttttctcccagaaaacatatgtgattattttctgtaatggcagctgaatgggggtttagatcattgcatatccagtaggaggaaattaaaatttaattatcagaaggtttcctgaaataacatgccttttttcaagcattgaagtaaaaatgactataaacctcttttgattatatgataaattagatcttttaccattaaaaaaaattaacagattttattttttaagtcagttttaggtttacagcaaaatttgggaagtacggagttcctgcctatctcccctgtgccacacacacagtcttcctcttggtagcaatattgaacctggcccaggaaattgttgaagactttgtcgggggtcattccatctgtggcaccagtaaattctgtcattgttatctctttctgccaggattact

SEQ ID NO: 146404 - DNA, 669 bp, Homo sapiens
gataaaatcagaaagatacttacatttttagtactaaagcaaagaaataaggtaaagttaaaatgaattagttttctcattttaatataaacataattcctatattcaggacttctaggaacttttttccccactgctttctttttttttttttttttaaatagagactggggtctcaactatgttgcccaggctggtcttgaactcctggcctcaggcagtcctccctttttggcctcccaaagtgctggtattaccagcatgagccactgtgcctggcctccccactaccttcaatggaagtttcttcattttccttaactctagaccacaagatgggatcttcagtaacagggttagttagggggaggataaagagaagattgatactctttcctctttttccctgtgcagatggtacttagaggaactagtaagtcagcagataagctgacaggcctgatttttatgtgtttgatttcatctgctttattattatttttactcttgaaccaataatatacagtagtcactaattatgtcaccctctccagtggtgtgtcttggtcaatgatgtagttccatctagtggtgacaaggacaactacaagttacatatttgctgtaggaaaatttttcccctcaaaaggggactgaaaccaaaagtta

SEQ ID NO: 146405 - DNA, 129 bp, Homo sapiens
tattttaaagttccagttcttttttccccctattaaactctagactccttaaggataagatccatatctgatttccaacatgtattgaaatctccacctctagagacatctgagatcagtccagccaca

SEQ ID NO: 146406 - DNA, 568 bp, Homo sapiens
taattacagccatacaggcacaatcatacatatatacaatacagccaagcacacgtgatctcacacacaaccacacatgtgaccatgcacatgcatatacacacacaatcacaggcacacatgatcatacacagtcacacatatacaatcatgtttggatacaatacacatcatcatgcacatacacacgtacattaatacgcacgcccgcatcaccgtatgcacagataatcacatgcaaatatccatgtgaactcatgtccgtgtaagacgcatgatcgtgtgtgcacacatcgcatgcagatatccatgtgaactcgtgcccgggtaagacgcatgatcgtgtgtgcacacatcgcatgcagatatccatgtgaactcgtgcccgggtaagacgcatgatcgtgtgtgcacacatcgcatgcagatatccatgtgaactcgtgcccgggtaagacgcatgatcgtgtgtgcacacatcgcgtgcagatatccatgtgaactcgtgcccgtgtaagacgcatgatcgtgtgtgcacacatcgcgtgcagatatccatgtgaactcg

SEQ ID NO: 146407 - DNA, 428 bp, Homo sapiens
cagtcaagtgtacatttagagaatagcacataaaactgccagagcattttataagcagctgttttcttccttagtgtgtgtgcatgtgtgtgtgatgtatacaaagagagagataattgtatttttgtattttcttttaaataatttttaaaattgacccttttcctgagacaaattgccagaatagtttgtatttagagatggtacctctaagagtaaggttgctggttgctgagcaattgacttgaaaacttttaaaattcaaattttaattccactactcaaaagaattgccatgttttaaaaaagagaattggtgccataagttagttgtctatgtttgaaaatgaagaagatatgcaacgtcatggcctggtcacttacccgcagccctgagttgtaggcacatcatatgtgagaatgaggat

SEQ ID NO: 146408 - DNA, 1974 bp, Homo sapiens
  misc_feature (1248)..(1248): n is a, c, g, or t
aaagtgaatagaattgttttcttactcaaaacactgtttaacatgacacttggctcctttctttgcatctctgagctcttgtaagatttgagaaacaattacattcaagggcagtatgcttaacctactgacatttgaactacaaagcaaagatgttcagattttcctgaaggatcaagtctttcaggccacagaattttctgtcctagttttttaatacagtagtccccccatatctgcaattttcctttccacattcaattacgcatggtcagctgtagtctaaaaatattaaatggaaaattccagaaataaacaattcataagttttaaattacacactattctgagtagcatccatgatgtgaattcttgctttgtgcggcatattcatgcttaaattctccccacccattagtcacttagtagccatctcagttgtcacggactgtcactgtatctcagtgcttgttttcaagtaacctttatcttactaatggccccaaagcacaagtgtaatgatgctagcaattcagatatgccagagaagctgtaaagtgctttcttaaagcgaaaaggtaaaagttattaatttaagcaagggaataaaaatcatatgctaaggttgctaagatcgagggtgagaatgactcttcctgctgtacaagatgatcatccccagagcacatagccgtcagactttccaaggtcaatacaaaagaaagaatcttaaagacagctagagaaagggtcatataactcatcatgctaacagcagacttctcagcagaaactttacaagtcagaagagattgggggactgtttttagcattcttaaagaaaagaaaagaaatcctggctgggcacggcggctcacacctgtaatcccagcactttgggaggccaaggtaggcagattgcttgaactcaggagtttgagaccagtctgggcaacatgatgaaaccctgttcctacaaaaaatacaacaattagctagctgggtgtggtggtgtgcgcctgtagtcccagccactccggaggctgaggcaagagaatcgctttagtctgggaggcagaggttgcagtgatctgacatctcaccacggtattccaccttgggcaacagaacaagatcctgtttaaaacaaaaacaaacaaaaaaacaggccaggcgcggtggctcacacctgtaatcctagcactttgggaggctgaggtgagtggatcacctgaggtcaggagttcnagaccagcctggccaacatggtgaaaccccatctccactaaaaatacaaaaattagccgggcgtggtggcaggtgcctataatctcagctactcaggaggctgaggcaggagtattgctggaacccaggaggcagaggtttcagtgagccgagattgcaccattgcactccagcctgggcaacaacagcaagactctgtctcaaaacaaaaaaacaaaaaccaaaaaaccatagtgagacccagtctctttaagaaaaaaaataaaaaagaaaaatcctaaccaagaattccatatcctgccaaactaagctacatgagcaaagaagaaataaaatctttcccagacaagcaactgctaaaagaatttgttatcaccagactggccctacaagagagtcttgagagttctaaacatggaaatgaaagaatggtgacacctgctaccacaaaaatacacataagcacatagcccacagaccctgtaaagcaactacacaatccaaactacagagcaaccagctaatgacaccatgttaggaataaagcctcatgtctcaatattaaccttgaatgtaaacaacctaaacaccccacctaaaagacttggagtggcaaattggattaaaaacaagacccagccttctgctgtcttcaagagacctctctcacatgtaacaggactcataggttcaaagtaaagggatagggaaaaaaatctatcacac

SEQ ID NO: 146409 - DNA, 425 bp, Homo sapiens
ggggaaggaatggggaacggatgcttactgagagctactctgtgccaagtactgtcccatcctttttacctacatcctcacaagatgggtaatattagcctcatttaaatccaaggaaactgaggctcattgaggttaaccagcctgctgaaagttatcctgccagatgcaaatggaagtctaaatggataaatatgtatgttttccaccaaatccctcaatgccacactgacaagcatggtactaggatgtagagaaagtaagatgattatagagacatcctttccttaaggaggtcatcatataacacagaagttgcaataaatggacaattatagaacttctaataggtgggcaccctttcaataagtagctgaccacgcacagcctccctctgctgctatgacactgtccttatgcagagg

SEQ ID NO: 146410 - DNA, 124 bp, Homo sapiens
gtggagccctttgcatagctcactgaattggggcagcaaccctggggctggggactaccattatctccaccagcccagcaaagaggggaggagggtacagccgagacccagctgcagtatgtgg

SEQ ID NO: 146411 - DNA, 430 bp, Homo sapiens
tgagacaggagaatcgcttgaacccaggaggcagtggtttcagtgagccaagatcgtgccattgcaccacttcagcctgggccacagagtgagactttgtctcaaaaaaaaaaaaacaaaaaaaaaaacgcttagagcagagcccagcagggtaggcctcaggtaagcatccatcactctccttagcatcagctcatgggccggttgtgaatattagaggcagaaaggcatgcaaactgcagagctcggctcctgggggaaagttccctgtgaacgttagcatggttagtaaggagcaggtagaggaaagaaagaaccaaagaaagaacagaaacacgaccagagataatagaatctcacagaattgccatggcctcagtccctggttgggattctgattcgctaatggaccaccaggctcatcccatct

SEQ ID NO: 146412 - DNA, 406 bp, Homo sapiens
gcagggagggaaggaggggtcatgagggtctcagtaggtcccaaggggcttgaaggggccttggtggagggttcagaggatctcaggggctcatcttgttggggggactctcagggtctcagcaggtttggcatggtccggtgggggggcagtggggtcctgcagtcctcatgcgggtcccaggggtcctagagcttttctaggtttcagtgagggctcttaggtctgtggtgccctggcaatatcttgaacggggtcctcagggcatcccaggggcacagtgagtcctcagcatcccggaaaagaactcagtggggtctgaagggaaggctcccagggacctggggggctcagtggcattgtggttgttccctaaggtcccaggggttcagtgggtgctgggcgg

SEQ ID NO: 146413 - DNA, 415 bp, Homo sapiens
taacggcgatggttctagcatctctgttttctgcttttttatcccccctggcagagaagaaactttgaagctcatcactttgtgggcctaggctggaggcatcggggcacctcagtaggcccaggggctactgggcattcctccactgcaccatccctggcagggcaggcgggaatggggttctcctaatgtcaggattccccgcaggacgagggcgcatctggcctcccttggtctcgggggtgaacttcacagaaatggaaagtttatcgtgaatgaggaaagggcagtaaaacccaaccccatttactgggtggggagaaagctgccacccagggtgtccaaatcagctgggaaaggtcacgccctttgggtggtcactgggccttgggaacggggccagaacccagccagg

SEQ ID NO: 146414 - DNA, 479 bp, Homo sapiens
ttctgcaaacaccagattcatagacttactagcagcttgcaccctcattgtggaaaacctataggtattcaacatcagcccagcccatgaggacaactgtggaggttagaccctgcaacttcacaggtgcagagctgcccaaggccttgggagcccaggcctcatacccttgtgctctgaatgtgggatctggattcaaaaaaatggtttggaactgtaggattcaatgactggctgttggatttttgactcctatggggtttgtaagtcccatctgtgttttgttcttctttctggctaatttcttccttttggctgggaatacttacccaatgtgtgtacaatcactgtactttggtagtagttaacttactttgtatttcagaggctcaggggcagaagagaccccagccttgtctcagaagagactttgggctttggacatttcagtaaatgctggaatgagttaagagattggg

SEQ ID NO: 146415 - DNA, 514 bp, Homo sapiens
cataaaagggattgctatctgagaaacaggtacgtcaacagagacgctgactgataggcagataagtcaaaaccacccctgcagcgtctacccctctccctaagtgctaactgcatattctcatatgggaaaccctatatggaatacaaagtcttaaggctaatttatactctcccttgacgcagactagcccattaaaaactgacctgtcacctcacagcattacaaaaggggaggagccaaaacaatcaactgtggggatgacatgtcacacaccaaaggcccaaatcttctctacgagtgacctttgtcacacgagacacaaagaaaatacgtgactcacgacgaaaggggaaaagggaggtagccactaacgtggagagacatgggcacagcttgcagcaccctggggggtgtcaagtgggctcactgaggctaggatgcagggtgcaggaacactcctatcttctgcatggatgagctccttggaagacctccacagagagtgcctggg

SEQ ID NO: 146416 - DNA, 446 bp, Homo sapiens
acgcctgtaatcccagcactttgagaggccaaggcaggtggatcacctgaggttaggagtttgagaccagcctgacctcaggtgatctgcccacctcggatgctgcatgtttttaaacatgtttttctaaccctggcgcccttgaagaccaggttctgcataaacaggaggtcctgtcacaggcctttccgctcagctcagcatgaggaggagaatcaacctgttcctcccctggccacgcccaagacgaggcaggtgactcaatggaaagagccagaccgggtgacaggagctaccccgtccctccccagcctcccaggccggctgcagggccaagtcacttcccgcctgagcctccttcctcttcttttaaggggaagccacgcccccagtccgcttgtagtcgggaaatgacggggcagctcaggctggctggggctgtgttt

SEQ ID NO: 146417 - DNA, 271 bp, Homo sapiens
aagatatattcctaatttttaaagaagaatgtagagatacttaaacaagacaatgaaggtggtagaaagattattaccatccccaaagtgtttgctcattaaaacattttgtgattttctctgccaatatcatacctgtatggataattgttttcctatccacacagttatgagagtgagaagatggaatataaaagatggaacaagagggaatctgtgtggtgaccacagtaatcacaggctggttgggatcctaaactcggccacagca

SEQ ID NO: 146418 - DNA, 489 bp, Homo sapiens
cagtaaaaggaatttctaaaaattgcttcttagccacagactttgttaaaaagttcctgttttaactgctttaggcttctggctgtcttctttttaagaacattctagaattatcataataattccttattccagataaattacaatttaattactacttttaaaaatgcttgaattattggaatccatgggcaatacatcttcacatgtcccttattcatatgctaagcaagttttatttttgctttttttttgcatttaaataatatttctctgaacattctgtctcagaaattgatgtttaaattcttaaaaataatttgtattgtaagaagtggctatctagctcttgaacaagtcataaaaatcctttgatgtgtgaatattcttctacctaagacctgaaatgttggcgaagtaaatatgttgttccaattttggtcaaagtaagaaacagagaataaaaagttaataagaatagcttcttgt

SEQ ID NO: 146419 - DNA, 327 bp, Homo sapiens
acctgggtcccagattcagggatttcagtccagagtaatttcaaaaaagagtgccaggcacagcatgaagccggcaacaactacccccttgtatattaatagcaaaaaatgaatagtaagaatactttttaagaattttttaaatattgaaaaaaatgtagctttatacaaattttacttcaaggtcattgtttttctccttttgtcacggaaacggtcctggactgccccacctgcagactggctttttgcagcaactgacccgtgtagtcagccaagcagtccacaatatttcaccaccacggcaggagctccatgtgaacgtcc

SEQ ID NO: 146420 - DNA, 560 bp, Homo sapiens
ttgaatgatgatgtaaaggttttccggcttggctagttaggtgattgtgacctcccaaccaagacagggagtataagagaatgagaaggtttgagagaaaagattagaattattttgaccattctggggttgagatttctgtgggtggtgacatatgatagcaagtttactgggccaaggccccatccagaggcagtcacagacctgagggctcttaagtatagaaggggcactagaggcatgggtctggacaagctcacctgggaaccaaggcagaggcaggatgagaagaagaaaatatgggaaatgatagcatttaaggaatggctagaagaagataattcagcaaatgacacacaaaaaaaaatggccagagaagttagaacagaaacagatggctgtggtgtaatgcaagctctgagaggacagggccatatctcggcttacttcgtatcctcggttcctggcccagggcctaccatgctgataaaatgtgagctcagcatcaataaaaatgtgctgagtcccagtttatgagtttacagaaggaaatggcggtc

SEQ ID NO: 146421 - DNA, 274 bp, Homo sapiens
tttaatcgccgtccgctgggagagaatgatgactcgccccacgcaccctgtgggtaatggctgtgggaatcgtttctttattcataaaccaggcttctcctattgcagagacagtgagtgatgtggtgttgtaaacagcgaggggagaaacaggggtcatgaattcatctgatgccttgcagaatttgcattttattgatagttttttgtctgttcaagttcgaaatctgctgccttataatgggtccctttgcccaccagcggtcgacggacg

SEQ ID NO: 146422 - DNA, 219 bp, Homo sapiens
accccgccttcttttgcatagcactgatcagcagctggcgttttatttatgcatatctaattatctaaccacctccagctctcttgtgcaatgctgtatcctcagtgtaacagacagaaattattctataaacatctgtggaataaatgaataactggttctataaacatcatgctgatggccgggtgcagtggctcgcacctgtaatcatagcagttt

SEQ ID NO: 146423 - DNA, 400 bp, Homo sapiens
ggctttgcgcctgtccaagtggcacacgtccctggaagggacccgctgctgcagtactccccagaatggcttgggcttattctcaggcatccagatgctgtacttactaacaggtctagaatctgaaatgccatgaaaatgccaagaatgtggcaaggaggctctcccaggccaggcagcaggcccagcaggccatggtatctcaccctttgattcactcagcaggtcctctgtgctaaagcaccttgcctacactagctctctgactctccccaacaactcggcaaggtaattactatttattcccattttctacatgaggaaactgcagctcagagaggttaagacacttgccacaggttgtacagtactggcatccagggtctgcgttatgccaaat

SEQ ID NO: 146424 - DNA, 188 bp, Homo sapiens
tataaatgaccaacaacatagaaatggataaataaacagcaatgcttcccctctgtggactatcacaaccactaagaattgcagttaagaagcatttagaacaacatgatgaaatgtataaagacagggaaaaataagcaatgtgccaaatgggcgtatggcaatgatctctatgtgggacaaacacc

SEQ ID NO: 146425 - DNA, 747 bp, Homo sapiens
atgacagacgtggggaggaaaggctgagcgaggcaatgtcctgactcactctggcgcttccctctttcccatctgggctccagagtctctgccctcattccccttcaccaggttgctcaaccctccatcagactgttaggtcaagggtggacaaacagaccaaccgggatctggatggcccctgggcagtactgacttcccctaccgttcccatggcaagaaaagggagtgattccactagcagactcccctaccctgcagtgagacagcctgtaggaaggtgagactcagaccccaaggtttctgcttttgctttgttccttcgagatctccgttcccccatgggagagaaacctctctgtcccacctgccctcccctcccatcagctttcagattctccagctgctcctcttctgagactcacccagtctcatgcctccattagcctcaactcccgacccatggcctgtggtgagaggtgctaacaacatgacctgctttcatcttgaccttcccagcccacccagagaaaagggaatcttggctaaaaaaaggctggaagaggggagaaccctggcactgcgggtggggctgggaggagcccaggcaaccttactggtgagaatctcatggctcttcaaggtgaatatgatgatgatttccctggggtttctttcaatactcagaagccgccccgagttggaaagcacatgcatacttggggaggccaggggaggaaaaggggg

SEQ ID NO: 146426 - DNA, 680 bp, Homo sapiens
gtgggtaccggggaaggaaggaacacatatgcacaggccacacaggagagctccgagagcgaatgtgatgtgctggagcctggcaggaaatgtggtgggtaggaaagtcaagtggagggcactggatggagggcatggacaggataagaagattttattttatcctgctgatgtatctatttgggagcaaagatgtctgttctgaccactctggtagtggactgagtacattgtaggaagagagtaaaatgaacaaaccaaccaccaggctccacggaaaaaccgaggtttttcattccatgttttcattcaaatggttttgttcccagaggtggtccaggaaaagcctttgcattcacatcagctacattgtgaatttttttcaggtataactcacataccataaaatttgccattttaaagtgtacaattcacctggttttaaggatgttcaaaaaattgtgcacattgcactactaattccagaacatttccaccatccccaaagaaaccccacacccattagcactgcctcctcgttccctccccccacagccccactaatctactttctgtctatgggtttgccaattctggacgtgtcatataaatggaatcatacaacatgtggtcttcagtgactggcttctttcacttagcagaatgtctgcaagggtcac

SEQ ID NO: 146427 - DNA, 400 bp, Homo sapiens
tggatggctttctttcatttttcaagtaggaattgagtgcaaagataacaactgtcctcaagaagaaacaaacaacgcaaaggaagtcatcttaacattattctcttttcttcaccttttaaatctcttttgctctgccttctaactcttcctttcaccacccaattcctcttgtaacacgtaaaatgactacaaagtcatacactgttcaaaccacaaataagaaacaatccttttcttttatagctatcaatagaatggatgtattctcaattatattttccaggcttagtctctcccttttttctttctcttctgtttcacacaggactgttatccagttttccaacaaattcccaggttactttctttgttacacaactgtgtatgctcaaataat

SEQ ID NO: 146428 - DNA, 545 bp, Homo sapiens
cttagagaagtagttgcatgggaatggtatatttggttatggaaaccaaataaggttcaaaggttagatgacgatgccctaatagaacaatacaagattttcacctgctgttatgtaagaaaaagattttaaggtcaagtaaatttaggaaattctgacttaaacagattaaaagtatcttttactacagtatttcacagtctttcatatgataatatgcatgaaaaactccaagaagagatcatggtgtttagaatatcccaaatttagctggccgcataatttttttacagtaaattttatgggattcacatgctattatacactggataatgctgatcagaaaccaacattaaacttctcttgttcgtggtgaggcgcggtggctcatgcctgtaatcccaacactttgggagggcaaagcgcgtggatcacaaggtcaagagatcgagaccatcctggccaacatggtgaaaccctgtctctactaaaaatacaaaaattagctgcgctgggactacaggcatgtggtcgacgcggccgga

SEQ ID NO: 146429 - DNA, 287 bp, Homo sapiens
ttttctatatgatgtatgtaaagaatttggcaagagatgatgtttggaaaaaataaagaatggctattgtagagatcttaaggaaagaaactacagttaagtagtgctttgtaatcagaatatgaagtaagtactgaaagtggatggagtggctgttgtcagcatgttatactttatacatttcattcataaatttggactgtagataaaagtaaactttttttttatttactcttgaacaacagtttttttttttccacttagacttgcatctgctccactgaaca

SEQ ID NO: 146430 - DNA, 381 bp, Homo sapiens
gaagcatctgcagcatataaaaatataacattgctttcagcttctgaggcttctatgcctcaagccaaaaggtaatgagttccctcaaaaatatttccttctctttctttaaaaaaatgatttgggggacgggggcaaaacaaaagcaatttataccaccttacccagggatgaagagtaaccatgcatcatgcctgcttttaatggtctcactttcttttacctgtctttccctccaggaccaggattctattcctgtcccaactccacctccatccaacgtcattcccccaaaggcctgctcttcagctcactgggttaaaggcattctgagtacacaagcttttcattactgcttagatttcttttctgctgaccatg

SEQ ID NO: 146431 - DNA, 312 bp, Homo sapiens
gtaagctccaagaggacagggaccatgtttgttttgcttatcattgtaccctagcacccaacagtgatggcacatggtaggcactcaaatactggtttcttccactttctatggtttattctgttcctttttaaatgcaaaggctccatttcttttgttttgttttgttttgagacaggatctcactctgttgcccaggctggagtgcagtggcatgatcatggctcacctcagcctcaacctcctgggctcaggttgattctcccaccttggcctcctagggattacagtccctccttgggactacaggca

SEQ ID NO: 146432 - DNA, 555 bp, Homo sapiens
accccctcatgtatccagggaccaggctacttctccccagccagggagccccgtccctgtgggcatcactgaccacacgcagttctggaatcctgtgtttgccctcctagacgtggggtcctgccccctctggctctgccatttctctccatgctgcccctgcggccacaatcaaggcttggccatgacttgctcctccctgggctcactcctcagctgccagcgccttttttgatgaccaggtcagccactgctcctcccctgctcacacactatccatgactccccatcctggcactcaaggcctagcaggaacaaacaccaaagagcattctcttcttccaatgctttcccacctctagccctttgcacatgccagtccttccacaaggtgcatccttctgcctgcctggatgaaccctgaaacatccttctcagaaaaggttcatgatggactggatgaggaagcctttctcacacctcagagaagatgctgcatagctttccagaccctgctgatcccgcacagcacgaggatggtgaggagggagcatt

SEQ ID NO: 146433 - DNA, 190 bp, Homo sapiens
taccctgtggcagccagggctcagcactccagctcagatttcgagtctcgcccgccccagcctgacccctgccacccatcactgttggttgtcaccttggaccccggacagcttgcccattcaacaccaagcctgtggtttgggggcttcactgcagcctctgtgtgttaaagggatgccccaatacctt

SEQ ID NO: 146434 - DNA, 293 bp, Homo sapiens
cttgctatagtttcagtgtcccctccaaaactcatgttgagatttaattgccattgtgactatattaacaggcgagaccttggacaggtggttaagtcatgagagttctgccttcataaatggattaatgccattatcatgggagtgggctcctgataaaaggaggaagctcgaccccattccctgtctgtctcttgcactcatttgcccttccattatgggatgatgcgtcatgaaagccctcaccagatgccagcaccaggttcttggacttcgtggccttcagaactgtg

SEQ ID NO: 146435 - DNA, 322 bp, Homo sapiens
tacagtgtagggccattgactgactctagtagtggatgaggacaactcacagagagaaatctgacaatccatgtttagcagagggaaggaagccagaaatagttactaataagtgcaagacttcagttttgttggttttttgttttttactcccagcaagctaaatttgacaataatgtagctcaatttctccccatctcattttgttaatctctataatcttgccccagaaaagccatttgtaccccagctcagaaaattctgtattcatttgtcttcataagattgtaaaaatttcaaaactgtctgttcatgataatta

SEQ ID NO: 146436 - DNA, 793 bp, Homo sapiens
aaattataaagacatcaacatttttgatcatataataagtactggcttacagctaagtggttccaaatactggtaattaaaacaatgatgtatacgttaaagattgcaaaacttaaaagcagatttttatgggaacttttttcgaaaggatacatgaccaccttcttaaatagtatgactttacatagactctttttctggtccttactgctcctcccacaacagggaagcccgatcagttctgtcagtataaggttttcttctatttgcccttagtttagatctccatcatcaattccacttactattgtaataccttcagctggagcctgtgtctttctccattcctttttaatacattcgtatttcccagccccagaacccttgaaattaactcttccatgagttttcattgctgaagaaaaaccaaacattcttgtaaaaacatttaagaacttccatagtcttgttcatattgtttacctatcttctacacaaggcgtgtccttgggtaagttatttaacttcaatttaccttacctgtaaaatggaacaaataatatctccttaagattgctctacgaattaattgacacattatgtgtgatgtacttaaaggaataataaatgcataatatgaggtcagtggacgccattttctgttataatcatttttgttatctaatttggggaaactattcatctgtcatatactattgatcctttggcacttaaataaatgtgaaatcctccaggaattttcctgtgattctccttgtaagaattaaatgct

SEQ ID NO: 146437 - DNA, 358 bp, Homo sapiens
tcgctaagcccagaagagaaaagtctgtgcagatacaaaatatgtagcagcaactggtcttctaaaaagacagaaacagaaggggttcttgcctttttaaagtgatggatctttcccatctccttgcccacattctctcctacatatcagatgattactttctttgcttatttaattcagccatctcactctgacccatggacattatatcagccaggtcaactgaaggatcactctggattagtgtggtggtttcagtcttttagaggctatgcttcagaaagtttcacagatgcttacttaatattagttgtacttttagcgtctcttggttttggaaaactgctatgaatctgat

SEQ ID NO: 146438 - DNA, 605 bp, Homo sapiens
caaggcctgaacaaatatgttaaagtgcttattcccagttggcaagataatgggagttttttcttctttttatttctattttctaacttaccagcaatgagcacataaggcagttatgtcccatcagcccaggagtttgagaccagtctgggcaacatggcaaaaccctgtctctacaaaaatgagctgggcttggtgtcatgtgcctgtggtcccagctaaccaggaggctgagatgggaggattgccagaggctgcagtgagtcacgattgcaccactgcactccagcatgggagacagaggaagaccctgccccaaaaacaaaacaagaaacaaagaaataaaacaagaaaaaaattatttgaggatgctcctaattagcattaactagttcttagtgttacatggttctttaaaaggaacggtttcaaagtacagtgccctgaactatcaaccttaatatgattttgagagctgggttctcaggctgaaggtgcccctgatggattcagatgagatggaacgatggtccctccctcagtacagatcctgcttctaggccatcattcatattctgaatctgacaggcaggtatttcaaggaa

SEQ ID NO: 146439 - DNA, 288 bp, Homo sapiens
tctcagcctcctaaagtgctgtgattacaggcatgagccgtggtgcccggccatgacattggttttgattttataatgaataaataggaagaaaggaggagagctgcctttgagactggctctgaagacaaaattatttttgcaaaaacccaaagattggtgaacttcagagttcacataggctatggttttatatatattagctcattaaaactaaaccatgaagagtaatagaaatggaagcttacaggggttataacttttccaaggtctcctagctagtttttg

SEQ ID NO: 146440 - DNA, 277 bp, Homo sapiens
taaaaccaccgccatctgggaagtagccaaggaaagagaggtgtcttactggcaggccaaactgatggctggtatccacttggaatcaactttctgtgatgtggatggatagctggacaggggagggaactcctcagagattgctcaccctgggcaggaaatcggaaaagatgttctaataatgaggctgtgatcattagaaccatggccctgtaatcacacaattaattgtcttgcacacatttagccttatagcactgaaagcagcttaggcttt

SEQ ID NO: 146441 - DNA, 410 bp, Homo sapiens
tccattttctcccaacacttaaagcaagaggtataagaattctgtgggtttaggccgggcacagtggctcacacctgtaatcccagcactttgggaggccgaggcaggtggatcacctgaggtggggagttcgagaccagcctgaccaacatggagaaaccccatctatactaaaaaaaatacaaaattagctgggcgtggtggcacatgcctgtaaccccagctactcatggggctgaggcaggagaatcacttgaatctaggagacagagcttgctttgagccaaggtcgcgccattgcactgcagcctgggcaacaagagcgaaactctgtctcaaaaaaataaaaaaaattctgtgggtttttcctctagtgtcagcatagtagtcatggcctttcatgggtctgc

SEQ ID NO: 146442 - DNA, 485 bp, Homo sapiens
ccccacatgttagaggaaaggcatggggggaggtgactggatcatggcggtggatttctctcttgctgttctcatgatagtgagtaagttctcaaaagatctgatagttttaaggtgtggcaattccccccttgctcttttactctctcttgccaccatgtaagatgtgtcttgcttctccttcaccttctgccatgattgtaagtttccccagccctgcagaactgtgagtcaattaaacctctttttctttataaattacccattctcaagtagttctttatagcactgtgaagatacaataaccaacacttatacaatacaataaccaacacttaactagtattaatgatatacccctattaagcaaaaggatttcttgagtgaagtaaacccaataaccagtatttcttttcaaaaacatctataaaaatactaggtttctataaaattttccagataccacttgatagtcattcaattga

SEQ ID NO: 146443 - DNA, 395 bp, Homo sapiens
ctgttggggttggggaatggcaactgcccatctgcattgtctgaggaaggggatctgggggtctgtcttagtattgccttcacctgtctacattgccatcaaatcctgagtccttaggggattccacactgtaactcagcttgccaggttaggatttagcttaattcattctgtttttattttctaaaatttgttgctgttttctctgaattcataagaaagttttaaaaggtttgaaagaaaagcaatacagagaagcttaactctaacatgaaaaatttataactaatggcaacattgggaaaaagcaagattggcagcatatgaaagtaagaacattgcacaaatgggcatatttagtcagaattcttaggagatgaactgctaaacatcgg

SEQ ID NO: 146444 - DNA, 530 bp, Homo sapiens
gaaaagcaagaaatgaaacccaattctggccaacatttgggaaaagggaggtgagactttgaactaagagaagatgttgggattctgtgaggtagtctgtgtttgaatggaactatcatttactgatttgttgcttgatgatccttataatttcaattgcacctcacctttacaattagtttttcagtttctgtgagatcaggaattatacctcctaccactttttatgcagcctaattttccctccctagaacataagataaagtggattttgacagcgccaagacataggaagtacttgttgactttgctgcttcattgattcctgcatcatcattatcatcataagcatccttagcaagtcagtagccataataaggcccagcactgcgtgcagctcaggacaaagggaattaattcatggacaagcaccttgctctatggcagtaaaagcagacatatgaacataaggaaaaatcactgcttaaagagtaaggtcaagagtgcagcttgcaggctgctacactgcc

SEQ ID NO: 146445 - DNA, 180 bp, Homo sapiens
tggcaatcatgtttcaaatgtgaagtaaaatatttatcttctatggtcaattccctttaaaaggtatcaaagacagaggaatacaacaggtcagtggtagagactgtaattagtctccaattcacatgtatatcatatctttataattacacatttaagaaatatgaactcacatatctt

SEQ ID NO: 146446 - DNA, 165 bp, Homo sapiens
gctcccgctcacactttccctgaatacatgacctccagctctttaggccaataccctggggtcagtcttgcctctatcctttcctacagactctcatctgaatcatcagcaaactccactctttcagtgtcagaaataatgattctgtttttctcctttgaccca

SEQ ID NO: 146447 - DNA, 344 bp, Homo sapiens
cgccagggccaaccttggagaccttgcccagatggggccttcgccgagccagggctcgatggagaaactatgtattctgagctgtttatttaagcacagggtggttcctaatggagccatcagaccttgctcattggctaatagtttaattgggcccatctggaggacgctgtggcgagaactgtccctgctctgatattggcagggaggcaatttgtcattctgtggccagtgactggcactcccatccccaaagccacacagaagccgggccgtctgtctcacgaggggagagcggaacatctgaagcgttgtgtgttcaccttggcacagaaggagaaacg

SEQ ID NO: 146448 - DNA, 181 bp, Homo sapiens
ctggggaggacagtcatcaaagtcagagactgggccctgagcgatgagccctgggctttccattcttcatcccaaaaatgctgcctgtgctccatgatgtgtcaagctctccccaaggcactggagatacagcagggaatgaacggacaaaaattccactttcatggagcacaccatgtag

SEQ ID NO: 146449 - DNA, 191 bp, Homo sapiens
attttcatggttacacacacacacacacacacacacgcacaacactgattggtcctagaaaaagaaacaaaataattttttaattattattaccaatatgtaccatctacttgagaggctttccttcaatctaatgaatcaaaattgtaaaatattttaaagtgaaaggggtataaagaaaattatgttta

SEQ ID NO: 146450 - DNA, 307 bp, Homo sapiens
gagacaggaagttccggagggcagtttgggatgccgccagcagagtggctgccgctgacctgttcgctgtattgcgatgggttcaggacacactaccccaaaatacaccttggcgactgaatgtcttcagctggagaaacctgagaaggagcatgtgcaggaaggactttttgaccgtcccctgaagcaggtcggaagcccctggtgcgagaagcgccctgctggtacctggaggaaaggagcatcttatcgcgagaccatggagcggggttggaacgacatgcctggctcaggtccccgctcactc

SEQ ID NO: 146451 - DNA, 172 bp, Homo sapiens
ccagaattaagacagcattaaagaaactgaagacaagcagttgggatcctcaggatgggaaagcacgggtaaacgggcaggagacctctgggcgccatttctgaaccgggcagctgggtagatagatggcggtgtcttcccttggcctgatggaacagggagggggtggcag

SEQ ID NO: 146452 - DNA, 201 bp, Homo sapiens
acagattacacgtttatgtcttgatgtgtggttaaatttgtattataatcagtggaatataaaccagtattgtggaacagattatccataaataataaaactgtgctcagacacaaaattaattcctatatggattaaagatttaatgtgtaaaagtaaaaaatgtcaaatctttctagaaaaatataggaggatgtgttc

SEQ ID NO: 146453 - DNA, 633 bp, Homo sapiens
ttgacctctaatgatatttattgttttgtaaatccattttgtgtgattttattatagctcctcagctctcttctgattcctgtttgcatgatatattgttttccatcattcgaactggttaccatttgcatggtatactgttttccatcattttactttcaacttacttctttctgtaagtctaaaatgtgtcttatagacaacctgtacttggatgtaccttttttatccaggcaaataatccttgccttttgattggaatatttagttcatttacatttaacagaattaataatatggttggatttatttctgctattttactatttgttttccatatgtcttacatcttttttgttccactttctcctttattgccctcttctgtttcagcaagtatttttcagtgtgtcattttaattcctgttaattttttgctattaaaaaaattgtaattggttgctgtagggattgtatgcatcagtcttcttcaggttagtactgactcagttctggtaaaatagggcaactttgccccgctgtagctccattttcacttccttatgttataaatccaagaatacaaggaaataattattgctttccacaggtttgtcttttaaggacatatag

SEQ ID NO: 146454 - DNA, 591 bp, Homo sapiens
actgaaaaatgggccatcagaattacgggagatgagcaaaactggagtgcaataggaagtgtaagtttctcctgacctggttattttaaaggagccctgtggggagtccaatatatactttcccaaatatgaatcacaggagttccaccacacagactaagcaggaggcaaaggaggatggcaaggaagtgtggcaaatactgctggagagattcatggtgctagatgtgatgatggatgttgaattttggacttctgccaatgttcttgcctccattccttcacgcatgctgttgcctctatgttccctcccctctgttagctgcagtaattcctggtcagcctttaggtctcagctcaaatatcacctcttccaggagacttcttgccttcccagacctgcttgggtgacttgcctctgtgctctgcagtagtctggcatggcatgtgttgtccctgtttttctggccctttttattttttgagacggagcctggctctgtcgcccaggctggaatgcagtggcaccatctcagctcacttacctcactgcaatctctgcctcccaggttcaggtgattctcctgcctc

SEQ ID NO: 146455 - DNA, 541 bp, Homo sapiens
cctccatcagagatctctgctcaactccgagtagctgggatcatcacgtacaggagttgaaaaagatcatctagcaaagccttttttcccagctacatactaggaattacaagcacaaaatggagaaaaactagaatgcatcctgcggtggtttttgttgttgttgtttttcttgagatggagtttcgctcttgtcacccaggcaggagtgaaatggtgcaatctgggcccactgtaaccttcacctcctgggttcaagcgattctcctgcctcagcctcctgagtagctgggattacaggtgtgtgccatcacacccagctaatttttgtatttttagtagagaccaggtttcaccatattggccaggctgctctcgaactcctgacctcaagtgatccatccacctcggcctcccaaagtgctgggattacaggtgtgagccactgtgcccagcctattatattttgagcaagagtctcactctgtcacccaggctggatggagtgcagtggcacaatcttggctcactgcaacctttg

SEQ ID NO: 146456 - DNA, 427 bp, Homo sapiens
tgatacaatcaacgcacctagcccagcacaggtagactccaggtgctcaataaatggcagcgattagcatgattaggatttcctctctgctgtgtgaactggaccaaaagtttcccaggctttaattggtccctctcccaacctgagattgggacgggtggccacgtctacatgtcctcccaaataaatggccacccacagtggtggcaggtggaattagaatgttagccgggtgtgcctccccataatggagttcattttttatacaactgggaacttttttaataaagaggtgaaataatctcattgccgccactgccgagcacaggacgcattaggcggctccccagtgagctgtttaattttattaattttgccaaaaaggtacagctccccttcactagagatcctccagggagaaaggggg

SEQ ID NO: 146457 - DNA, 359 bp, Homo sapiens
tagaatggaatctttatagcagtcagaaggtgttttgggattagtgaggccttcaggtcattgccgtgtgtagcagcccttccgaaggactaggatcacggcagtagccacagacctgggcaagggttgattgtgtggagccttagacattaaaggcataggaaactgagttgaagccttagcagccttggaagtttctttgcttttcttcctccactaaaaccttgattttttttaaccttatatagttgttacttgttttcttgtaaagactgtggctcagtcaaatgtgtggttccatggcagtaaattatcaaataatagtgattaatatttactgaggctttactgtaggccag

SEQ ID NO: 146458 - DNA, 329 bp, Homo sapiens
tcccaattagatagtttttaattattttaccccatagcaaacacataagtagcaacaggtgccccttccaaaatcacctgcaaaacaacagagggaggctggagcagcagaatgggtcagggctttggactcaggtggagattttattattattttttgatacagtctcactctgtcgcccaggctgaagtgcagtggcacgatcttggctcactgcagcctctgcctctcgggttcaagcgattctcatgcctcagcctcctgagtagctaggattacaggtgtgtgtcaccacgcctggctaatttttatatttttagtagagatgg

SEQ ID NO: 146459 - DNA, 183 bp, Homo sapiens
tgcctgggagaggctgagaaaccttcttgcttgggggaggtggggcactgctagaattaatcgcttcacagaccagcccatccaggactcctcaaatttggcaaaaaagccattcattcattcattcatttatgtagagacgagggggatctggctatattgcctagattggtctcaaattcc

SEQ ID NO: 146460 - DNA, 243 bp, Homo sapiens
ctgcacacctggacaacctggttctgtaaaccacgcctttccctgttttgctattgccaaccagatttcaggttctgccactgagtcctcctacagcaacagcagaccacagccgcccacctccagacagcccccggtctcactggccacagacttgctccttagaggcaaggccactggcaggctctcagttcctctacggaatgtgaaacgtgcctcatctccccagccgggaaagaaact

SEQ ID NO: 146461 - DNA, 209 bp, Homo sapiens
ctggtgatttccaggaagtgacctcacaatgactcaagctaccacatactgttcattgtgaaatgccagttgaagcatatgtcctgtgagcttaggggtgctacaagttgaccactgcagcagtaaagatgattctgaagaatggcatgggatggatcctttcgaatgcacttgagcagcggtctccaaccacagggccacagagctgg

SEQ ID NO: 146462 - DNA, 1290 bp, Homo sapiens
cctgccggctctggactagccgctcagcaccagggcggaaggaagacgaggcgaggcaagcgccaagcttccatccggacttcaaggccagtggctgggtctggttttctcaacacggcctcctagtctccttcccgcttgggcatctgtttttcttatatagaccctgaagccgcccgtgatgttctgtaagcaggttccgcttcagaatcagaggtacttaagagggaacctggatgctagacctgcccttgctgctggcctcagtttctttacctgtaaaacagggattttggaactgttaaattaaatcaaacttaaaagaattacaacttaaagctgctggaactttacatgatcccgagccttgagaggaatgtggctatgcagcctgagtcatgtggcatgcagatgcaacctctgcctttttccgctgtaaataattaagaagaccaagtagcatccaagagtcacctaagctgaagattcccttgagaacaagtactgtcctgtggtttcatggcctttcttccatttgtggttcttgccaagcggaatttaaatgacatcttatcaagatggataaaccctagtttcccagtgctggaatatagaaaatggatggacaagtaaatcccactcagcacccatagcccaggcatggggacctcaacacatttgagccgcagagatcacctttcattgtgaatagctctgagatgatacttctggttgaatgtctttttgtcacttccggctggatctaccatgaaagatttctgaatccaggaagagagattgactgggcaacatgttattcagaaacaggaccttgccctgtcactcaggatggagttcagtggtccaatcatggctcattgtagcctcaaactcccaggctcaagcaatcctaccacgtcagtcttcccagtagctgacagggtctcactctgtcgcccaggctggagtgcagtggcatgatcttggctcactgtagtgtagacttcccagcctcaagggatcctcccaccccagactcccaagtagctggaattacaggtctcatgctctcactcaggctgcagtacagtggcacaacctctactcactgcagcctctacctgccaggctcaagcaattctcctgacttagcctcccgagtagctgggattacaggggtgctacaagttgaccactgcagcagtaaagatgattctgaagaatggcatgggatggatcctttcgaatgcacttgagcagcggtctccaaccacagggccacagagctgg

SEQ ID NO: 146463 - DNA, 2807 bp, Homo sapiens
  misc_feature (2683)..(2683): n is a, c, g, or t
  misc_feature (2800)..(2800): n is a, c, g, or t
cttggcctctgtttatttgcaaaaacgagtaaagtgttacctacctgcaagtggttcagtgcgtgccggggtgtcaggctgcaggtatgtgagcttgttcaaggcttgtcttacccacatggctgtttttctaggcctcgggccagtgctcctttaaaaagtgatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgcatattttgatgaaaattggctaaacagaatcaaaactgaagtaggagataattggaggctaaagataagcaatttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacaggctgagaacagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggctggtgaatcaaagacttctggaagtacagtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagagaaagaatatgagaaaacaaagagtcagagagagatggaagagaaatatattgttagtgcctggtacaatatgggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgngcctgtgtgttaccatgctaagaatgtctttgtttaaagggaattaatctttttatgatgtattaatctgtgttttcaattgttttccaagtacagttcaaataacttgcatatttnctataca

SEQ ID NO: 146464 - DNA, 676 bp, Homo sapiens
ttgaccacaaaactagccacacagctgatctgtatcaccttccactcattttaacatcagtgtacgtaacagaatcgtacattgttaccgctttgacttcctttgttcgacattctgtgagatctattcatgtggttgagtatatcattagttcatttttttattgataggtagtgttctatttgttaattcttatttttagaacttcatttttttgcaacaagattttgcatggtaaaacctttgcaaagttatctaaatattcctagaaaaaatgtataccctctctttatgcaggtctatctaaactaaatgactactttttcaaacagaggaatttttttgtctttattttttacttattttttaaatatattaaatttgtgttttgtcttttcatatatgtttcatatcacttgcatgcaatgcaagtgtaatccaaatataaggaactcagatctttaatttgaactggaaaaaattacagaagcagtagtaggtgatgtttacctgtttgttacagagagaagctgcatgaggccaataatgaactacagaagaagagagccattattgaagatctcgagccaagatttaacaacagctcctcttcgacgaattacacgaagcttaccaacgaatgggcacgctgatgcacctgcatgaccgattcacc

SEQ ID NO: 146465 - DNA, 377 bp, Homo sapiens
gctgggggtgacggtgcggagccgctgccagcgctgggcgagagtcggcggccggatccgaggagcaggcgggcctgaggccgagtcagctgcgcgggcccccggatcccccgacagagcggcggcggtgtctggccaggcggtaggcgctgcctggccgcggcggggaagatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgctccctcacaattcacctgtcattttaatgataacagctgttctttttggggggg

SEQ ID NO: 146466 - DNA, 2010 bp, Homo sapiens
gctgggggtgacggtgcggagccgctgccagcgctgggcgagagtcggcggccggatccgaggagcaggcgggcctgaggccgagtcagctgcgcgggcccccggatcccccgacagagcggcggcggtgtctggccaggcggtaggcgctgcctggccgcggcggggaagatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgcatattttgatgaaaattggctaaacagaatcaaaactgaagtaggagataattggaggctaaagataagcaatttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacaggctgagaacagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggctggtgaatcaaagacttctggaagtacagtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagt

SEQ ID NO: 146467 - DNA, 2874 bp, Homo sapiens
  misc_feature (2750)..(2750): n is a, c, g, or t
  misc_feature (2867)..(2867): n is a, c, g, or t
gctgggggtgacggtgcggagccgctgccagcgctgggcgagagtcggcggccggatccgaggagcaggcgggcctgaggccgagtcagctgcgcgggcccccggatcccccgacagagcggcggcggtgtctggccaggcggtaggcgctgcctggccgcggcggggaagatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgcatattttgatgaaaattggctaaacagaatcaaaactgaagtaggagataattggaggctaaagataagcaatttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacaggctgagaacagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggtacttgtgcccataaatttccctcttactacggcttttgctgtatcccatagatttcggctggtgaatcaaagacttctggaagtacagtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagagaaagaatatgagaaaacaaagagtcagagagagatggaagagaaatatattgttagtgcctggtacaatatgggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgngcctgtgtgttaccatgctaagaatgtctttgtttaaagggaattaatctttttatgatgtattaatctgtgttttcaattgttttccaagtacagttcaaataacttgcatatttnctataca

SEQ ID NO: 146468 - DNA, 2393 bp, Homo sapiens
  misc_feature (2269)..(2269): n is a, c, g, or t
  misc_feature (2386)..(2386): n is a, c, g, or t
gctgggggtgacggtgcggagccgctgccagcgctgggcgagagtcggcggccggatccgaggagcaggcgggcctgaggccgagtcagctgcgcgggcccccggatcccccgacagagcggcggcggtgtctggccaggcggtaggcgctgcctggccgcggcggggaagatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgcatattttgatgaaaattggctaaacagaatcaaaactgaagtaggagataattggaggctaaagataagcaatttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagagaaagaatatgagaaaacaaagagtcagagagagatggaagagaaatatattgttagtgcctggtacaatatgggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgngcctgtgtgttaccatgctaagaatgtctttgtttaaagggaattaatctttttatgatgtattaatctgtgttttcaattgttttccaagtacagttcaaataacttgcatatttnctataca

SEQ ID NO: 146469 - DNA, 2025 bp, Homo sapiens
  misc_feature (1901)..(1901): n is a, c, g, or t
  misc_feature (2018)..(2018): n is a, c, g, or t
gctgggggtgacggtgcggagccgctgccagcgctgggcgagagtcggcggccggatccgaggagcaggcgggcctgaggccgagtcagctgcgcgggcccccggatcccccgacagagcggcggcggtgtctggccaggcggtaggcgctgcctggccgcggcggggaagatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgcatattttgatgaaaattggctaaacagaatcaaaactgaagtaggagataattggaggctaaagataagcaatttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacaggctgagaacagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggctggtgaatcaaagacttctggaagtacagtcacaagttgaagaattacaaaaatctttacaggatcaattaaaaatgttgtataatagtgtaatacttttctttgtatgaaaatgtcctcttcttcaaaggtataggctttgtaatgaattagattttctgccaataattgatatacaatttatattctttattgngcctgtgtgttaccatgctaagaatgtctttgtttaaagggaattaatctttttatgatgtattaatctgtgttttcaattgttttccaagtacagttcaaataacttgcatatttnctataca

SEQ ID NO: 146470 - DNA, 666 bp, Homo sapiens
cagaatctctcccccccccctctttttttcccttcagatccagacatttaatgtggatgcaccatgccagaccgtggaagatttaacgaatggggttgtgatggcccaggttcttcaaaagatgtaagaataaattgcttatctttatgtgtattcttatgcatggatatttgttaggttgaaaacatggattaaaaaagtacttacatgaaacgtgtgtagagtaagagttgtaggcggcagcagcactagttttaatggaatgtacttattaggtatagattgggttgcaagtttaataagggctgtgattgtgttagtactctaatggttttagcagaattattcttgtattttttggcatatgcttggcagaaattttcttgttagtggccagattttgctgttacaggggtatctaagatgcttactccatttttctttaggattttgctgaaatatcatctcatcagtggcacctgccctgagtacccatataaaatagcaacgacaattcccttatactttctatcccacttaagcttttgtgttcttctttcaagtttgtgacaccatctgatataccatatatttggttgttcattcatctgccccaacatccccaaacacatatacacagaatgtaaactccacatggagccaggg

SEQ ID NO: 146471 - DNA, 2166 bp, Homo sapiens
gctgggggtgacggtgcggagccgctgccagcgctgggcgagagtcggcggccggatccgaggagcaggcgggcctgaggccgagtcagctgcgcgggcccccggatcccccgacagagcggcggcggtgtctggccaggcggtaggcgctgcctggccgcggcggggaagatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgcatattttgatgaaaattggctaaacagaatcaaaactgaagtaggagataattggaggctaaagataagcaatttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacaggctgagaacagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggctggtgaatcaaagacttctggaagtacagtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagaggtagtttactatactgtacaataaaataattgtgttttgattttaatgttt

SEQ ID NO: 146472 - DNA, 1106 bp, Homo sapiens
  misc_feature (982)..(982): n is a, c, g, or t
  misc_feature (1099)..(1099): n is a, c, g, or t
tcgatctgaggatccctacgccaggtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagagaaagaatatgagaaaacaaagagtcagagagagatggaagagaaatatattgttagtgcctggtacaatatgggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgngcctgtgtgttaccatgctaagaatgtctttgtttaaagggaattaatctttttatgatgtattaatctgtgttttcaattgttttccaagtacagttcaaataacttgcatatttnctataca

SEQ ID NO: 146473 - DNA, 312 bp, Homo sapiens
tcaggagggcagccaggtacgagcgcattgcagacattagagtaagtgctcttgagaggctggaagcactttgttgcccaaggcttctaagaccagagagatgctaagtgcttctatattgaaaagagtgagcattcctaatttgttaggtccctgctatcttttaaattctccaaccctaagagaagaaaagccctattctcctccagaggtcaggttgggtatcatcccagggaagccgagcttttatgctgtgtgcgcccatgtgttagtgtgtatttatctagcgggaggagctggaagctgtaggtg

SEQ ID NO: 146474 - DNA, 319 bp, Homo sapiens
atgggacataaagcaaccagatccaacaaacaggataatccatatccacgaaatagagaaaatagataaatctgaataagactttttaaaaggaggattagaaccctcagagaaaagaacagactaataaccatgataagaattgaaagaatcagcagttaggaaattagaataagcaaataagaaaaatgcaaaacgtgaaacacaaataaatatgctctaatatgtttcataggtattttaaaaattgttagagcataaaagaataggcaagcaaacaagataagatttttaaaaataaaatatggctattggaata

SEQ ID NO: 146475 - DNA, 531 bp, Homo sapiens
agattctattccagagcaaatttaaaatcataaagattatctaatctggccaagtgtggtggctcatgcctgtaatcccagcactttgggaggctgaggcaggtggatcacttaaggccaggagttcaaggtcaccctgggcagcatggtgagaccccacctctgacaaaaaaataaaaaccttaaccaggtttggtagcatgtgcctatagccctagctattcgggaagctgaagcaggaggatcacttgagctcaggagctccaggctgcaatgagctatgatcgcaccactgtcctccagcctgggcaacaaagtgagaccctctctctatttttttctcccaaagagctgggattataggtgtgtgccaccatgcccaactaaagttactttttttttttttttttgaggtagggtcttactctgtttctcaggctggaatgcagtggtatgatcacagctcactacaaccttgacctcctgggctcaagcaatcctcccgcctcagcctcccgagtagctgagacc

SEQ ID NO: 146476 - DNA, 580 bp, Homo sapiens
gaagggcactttggaggtaattcactatgcctatcagtgaacctgtgcaagcaggtttctttgtgagtgggtgtttggggcacaaattatagtcagattttgttagaagtgaaagagggaaagccctactgattgagggatacacgttttggggtgccccaaggtcttctggccatcttatatacagccagcaaaggttgcagatgtacttggtggcagcagtcaccccatctatcagcctcacactgacgtggccttcaatgttgagggtgaacagtgagacagaggcctactggggagcagaatgtgctaggcttgtggttaattatgtgaactcacctttatggcaagtgttggttcatgacgtagaagataatagtcaaagactctgaaactatggataagggcaggagtactcagctatccaagaaatgacctctcttatgtttgaaacaatatgtaggccagaatgctccagacattcagcctgtctgtaggggattctcgaagtgatatactttcagatacatctgtgccaaaaatactatttctgaggcttgagatctgagcagctaaaggg

SEQ ID NO: 146477 - DNA, 360 bp, Homo sapiens
atttttagtagagatagggtttcaccatgttggtcaggctggttttgaactcgaccttatgatccacctgcctccgcctcccaatgttctgggattacaggtgtgagccaccgcccccggcctgttcaagatgttataacaaaatgccttagactgggtaatttgtgaacaacagaaatttatttcttacagtcctagaggctgggaagtccaagagtcagcttgccagcagattgtgtgtctggtgagggcctcttccttataagtggcaccttctatgtgtcctcacgtggcagaagggacaaacaagctcctttggacctcttttgtaatggcacaatgccattcatgagggcagag

SEQ ID NO: 146478 - DNA, 627 bp, Homo sapiens
tttctttttaaagatgagtatatatgtactaagtaatgctctcattacatgagtcccttctaactacaggctgatacatctttcaggaaaactgagaacctaatatttaagtgaggcctattttaaatgagctatactgtgggtggtagtgtttgttaccttatgtaagacttaggtttgtcttagactgaaaaactcttattcttaatatttaaaatatccatgatggtagaaattttgtgggaaattttcttttttaatcaatagttacagttcttcagtaaacacaggtatgtatgcttttgtggtgtcagtgtcagtctaaatctatgggtgaagcagttagtccataagacaaaaaattatttgcctagtggattccctttacctctttttaagaagctcagagatctgtaatcattaatttactaaggattttttaaaatattattttagtcacttttaaacctgaaaatttctcttttgatttagatttttgaagtgaggcttgagcatacacaagtaaagctgggagtttcattcttcatatgggatttatgactaaatatttctagcattttgaagaagataaacattttgaactgaagtatataacaaaaaaaggaa

SEQ ID NO: 146479 - DNA, 404 bp, Homo sapiens
gccagaaagaatttggtacattcagaactgaaaggcggccaatgaggttagaacatagaaaccaagaggtaaagtggtaacaggttgaagagggaagcagaaactcgattttattgtaggtcatcttagagtttagattttaacttcagtggccaatcactgaagagtattaggcaggggattaataagatctaaaccatgttttttaaaagactggggtgtaggcgtggtaagtagaagcagagggaccagttaaggagggaattgtaatgatccatgaaagagacaacagtgtcttgattgaaacagagccagctaaatgcaggcagttgcatggaatctcaaggaaattaagaggaggaattgactagacttggtaatagagagaatgtgtgaaatgtgag

SEQ ID NO: 146480 - DNA, 409 bp, Homo sapiens
ctcttctcttgtcctttagggccccggcaatctcaatagacccatattctctaagtgctgctttgaagtcttaaccagcagctggagagcaagtccctgggatgtgagtggcctccccattctttcctcctctcacgtgaccctaggagagtgggttgagagaactcagcagctccaggacatcagttcgatgctttggactaacatggctatctcttcagtagcagaattcagacgcacggattcccaactccaggggcaggtgctgttccggcacctggcaggcctagcagagctgctcccagagtcccggcggcaggagtacatgcagaactgtgagcagctgctgcttgggagcagccaggccttccagcatgtgggccagacacttggggacatggctggtcag

SEQ ID NO: 146481 - DNA, 467 bp, Homo sapiens
atcagccatgagttggtgattattgaagctgggtaatcaacgcgtggaagttcattatgttagtctgtctagtccctctactttaggtacgcttggaactttccataataaaaagttcaaaaagacaaaagaagcaatgataggcctacagctacttcagatctagatgaagctccactagagatggctagcaaggatcttagcccgttgctggtgcaggtggggcctgcctgagggtgcatcaggccctaggaaatatttcctccacagaattttcactgttgccaaacgtctgaatcaaccaatcttagcctgcagtggcagccaatggtgcccatgctttgcagcatctactgggacctcaggaccacctgctcttgtcctctaaagaggcagtacccaggagcctcctgaggccatgattgcttgcacaggttagcacagaaggcttgagtccagctctgagc

SEQ ID NO: 146482 - DNA, 821 bp, Homo sapiens
cttctgtttggatgggtgcacagccagagcagaatcttatggcattttggctctgccattggctctaaagaacgctaagtattcacaagcatactccacaggtggaagagcaaatcagagggcagctctggccagacagcaagtcaaatacctgagggcagcagctcccagttgcttatggattcactaagaaccaaatatagattacaattattcataacaataccactggtaaaagtaaaacttaatcccagcaaacaacccattaaaatgtggagctgcaaattttgatctggggaaactgttagacatgttgctcaccagtgaaacttagaaagggagaagctgttatcaggaaatttaatatagaccaaaaaatagtcagtgagccaaatccttgctgttatataggagagaatggattcaattaaaataattccagtaaaatgaaaatacaaagtaatcaggaacaatgtcactgtttagtgtagaagattaatcaaagaattggccgggtgtggtggcttgcacctgtaatcccagcaccttgggaggctgaggcgggcggatcacaaggtcaggagattgagaccatcctggccaacatggtgaaaccccatctctactaaaaatacaaaaaattagctgggcgtgtggcgagcacctataatccaagctactcgggaggctgaagcaggaaaatcgcttgaacccaggaggcagaggttgcagcaagccgagattacaccacaccactgcactccagcctgggcgacagagcaagactctgtctaaaaaaaacaaaaaacaaaacaaaacaa

SEQ ID NO: 146483 - DNA, 186 bp, Homo sapiens
tccacctcggcctcccaaagtgctgggattacagtatgagccatcctgcctggcctgttttaatttttagagataaggtcttgctgtgttgccaggctaccttggttgaatttttaatgttaaggcaacctggcatttctgagataagtatcatttgataatgctgcacaatcttttttatatgtt

SEQ ID NO: 146484 - DNA, 459 bp, Homo sapiens
ccttctttcaaaaagcagctcttaaaattggacttcatgaattcactaacaacttgtcatggattagtctattccattgctttcctttagcaatttcctccagcagtttcacttcctgcaagagcaaagttcctgcccagcacagggcttcagactcagcatcgatgcctgccttccaccggcaccctgagccacagcaccctgtccattcctcctggactcccctcctgccctctgcattgaagaaagtcctgacctcattctgggaccctacagaagaccctggcattctccaccctggccacacttggaatttcctgggggagctttgtaaaaaatgcagctgccctggcctcactgtagaacttggagccaatcatgagagcagggtccaagcaggaggctctcgggaacctcccctgtgactctgaggcacagccctgctgggcaacagctcag

SEQ ID NO: 146485 - DNA, 742 bp, Homo sapiens
aaatgcaacagcagtggtaataagttctatgaaggacaaatgcagaggaaatgaggaacttacatgggtgggggtaggaggaaggtgtcagggaagcctctctgaagaatgacctagagggcaggtgggagctacccaagcagattccaggcaccttgggtggaccaggatggccacccaggatggccttttcccaggctgtgcccagcaagttccatcagttcaggaagcaaacagctggaggcacctgtgcagacccatcctgacctcatgaaaccatgcctactcctggcatttgtgaatgtccatctctacaaactcaactgatgccagtatgggctatagagagggtcacatcagtctcagtttgcccaggatagcctcagtttgcccctgttttggtgctttattaacagcacccttttggatagtagtaaataatgtagtcacctggctcagagacttgtccacaagctcactgcatccaaacatcacaggaccatcctagagatggtcaagaaggagggtcactttcatacctgtcagaaaagcccagatggcttaaaaaatttccccaggtactccaagaaggggcccagtatttgaagtttctatgcactgaccaaatcaactgatctttcacaaatacacacccaacctcaagctagtatttcctttctaacattttccacccccatcaattattagttacctgtctcttgctctggcctatggtatctat

SEQ ID NO: 146486 - DNA, 451 bp, Homo sapiens
taagggctcagtatagagcagaagctgaggctcagaaagattaagtaacttgttgagggccacccatgtaataagtggccaaatgggacctgtgtctagtctggtccagccctcccacctcaccaccagccttcttttgttggtggtcacctccttctctagcttcctgctctgagcacactcacaggcgcaaccagatacttgggaacacagatgccctcaagtgcagatttgccaggtacagccttgcatcatagtcgctaatcacattgtgattagcaatcttgaaactgggaaggttgagtcaagcaggcttaagagaggaagtgagtctcataaaaaaatctgcatcagagaaggcagggcttgagttttggaaagagcgggcaggaagggtatttcaggtatgtaatatgacgtgaaggtgggggagagaaagccaaactaactt

SEQ ID NO: 146487 - DNA, 214 bp, Homo sapiens
ccctgccagaggctcgcctggcccagcctcggaatctctgagaggcaaccaccattccagacgtgcctcccagagcagctgagaggccttctgcctgcaggacaaacagacatagcgatgtccaccttctttgcattcaagctgctgcctgaaagttcttcctggagtctcattttattccctcctgctgcagccagaaccacaaatatcggcc

SEQ ID NO: 146488 - DNA, 315 bp, Homo sapiens
acacaaccaccaagagttgtcagtttgcaaacctagaaaagtataccattgtaatatcagttcatctcccgcttttccagagctactcagaagcgtggtggatgcttagtgaaatgaccagaggtgtgaagctgccagacctttacccagatcaacttctttgactcagggtacaaatgaacaacgtagtctgacagctcacctaaaagttatttggaatgattttatattgagagatttttttaaagcctaaatttagattcatcagagcatatcaaggttgagatatgtgaaaggcagtgctatatgggaggg

SEQ ID NO: 146489 - DNA, 328 bp, Homo sapiens
gtttggggttcggctgccgggaagaggcgcgggtagaagcgggggctctcctcagagctcgacgcatttttactttccctctcatttctctgaccgaagctgggtgtcgggctttcgcctctagcgactggtggaattgcctgcatccgggccccgggcttcccggcggcggcggcggcggcggcggcgcagggacaagggatggggatctggcctcttccttgctttcccgccctcagtacccgagctgtctccttcccggggacccgctgggagcgctgccgctgcgggctcgagaaaagggagcctcgggtactgagaggcctcg

SEQ ID NO: 146490 - DNA, 212 bp, Homo sapiens
aaggtaataggcagcctggtcatcaatcctagttgtgggaaggtttagagaagagagaagcagcaacttggccttagaagaacatgtatataaaatgcttagtaaagggcaaattattgaagttattctacatatagtcactaaataagactgaatatagtcactctgctgggcatgggggaaggttctccagagttggcgtttttcttcat

SEQ ID NO: 146491 - DNA, 115 bp, Homo sapiens
tgtcttgattatgaggaggtctcatgcgaggtagctttgcttagccctctcatactctttatttacaatgaaaaatctttaaattgaatttgtggttctgatatttataaatgat

SEQ ID NO: 146492 - DNA, 180 bp, Homo sapiens
ccaccttggcctctcaaagtgctaggattacaagtgtgaaccactgcacctggctacttcccccaatttctatataaatttgtatattcctagtccagattcttgttttatttatatttcattgaatttattgtaaacgacttcagattctctagaaaactgaagtttaaaatgttagat

SEQ ID NO: 146493 - DNA, 389 bp, Homo sapiens
aacatcccacacctgaagtatcaacatctagaatgtgcaaagaatgtatgttaatcaaccacaacaaggggcagaacctcgtagaaaaaatattcaaagcacaggaacaatccatggaaggagaaaatctaaagacttaaagtagatgaagagctgctcaacctaacttgaagtcaaagaaatacaaattaaaatacaaagatgtcacttcactcccatctctactaaaaatacaaaaattagctgggtgtggtggtggctgcctgtaatccaggtattcaggagactgagacaggagaatcttttgaacccgggaggtgaaggttgcagtgagccgagatcgcaccactgcactccagtctgggtgacaagagcaaaactccatctaa

SEQ ID NO: 146494 - DNA, 588 bp, Homo sapiens
  misc_feature (46)..(46): n is a, c, g, or t
tagctgattcctgagggtccaccgacgtcgcagccgggtctggatngtggcaaaaggtaaatccctactaggcaaacaccacagtattaatcgtttccaaaaagatccactgatgcatactaaaaataataggtgaaagtttgaggaaaaatagggtatctgcatattcaaatatcagacgcatctttgcccttggtgactgtattgccttgaagaaaccattagctttcttgatcctaggttgcctatctgtaaatgagtgggttgcactatgtgactcccagggtctcttctagctctcatactcccatgggagtgactgtactttccatgtaattatcaggagtgtaacttcttccttttccttatctttgcctccccttccttcttttctttccattctcttccataacaggattccctaggaagagaatttaaggatgctctctatgagaaaaaaagatggagaaagaagtgaaggaaaaagagaaaatgcaattcctagtattaactggtgtctgggttgttaggcagtagaaaagagagaaagacagccgggtgcggtggctcatgcctgtaatcccagca

SEQ ID NO: 146495 - DNA, 399 bp, Homo sapiens
tgccaccctgactgtacctgttgagttgacgtaggtggtgaacaccctgggagcatggcagatatttggcaggatacttgcccatggctggaattcccagtggtgacattggtgttaagtgggccatttctgttgattcagcaggaggacgtggcagcccaagatgtcaatagctgatgggaggcagatagtaatggggagaggacatggctgtgggatgggacagcactttgttcccaagtctactctgaaattgcccacagctagctaaaccatgttggacttaggacatttctcagtttcaattttaggttgtagtccctaaattcaaaaagtggactactgtatcttgacaggaattcttttacagaatttgatacccagaaaggggtgtgagcc

SEQ ID NO: 146496 - DNA, 224 bp, Homo sapiens
caacagttcaacatctaatgagtaaataaagacagtatggtatatacacacaataaaatactatttatttttaaaaaagaaaattctattatgttcaattacatggattaacttggagaacattatatttcttgaaataagccaggcacagaaagattaaaatttcatacttttgcctacacatggattctataaaacttaatttcattgaagcagagagtaaa

SEQ ID NO: 146497 - DNA, 255 bp, Homo sapiens
attaaatgaaagtcatttatggaaaggagctagaaacagtgctgggcacaaaggagggctgacaaatggcagtgaccgctaattaatcccggccagtgttcttcaccccctctgccttgcctgttgtctttcctcttccaagagaggctaagcacctggccagggcagagtgcggatttgaacccagggccgtctgactgcacagagaccaaggctgactgctgccaccacgtggaggctgcagagctggtggcc

SEQ ID NO: 146498 - DNA, 413 bp, Homo sapiens
gttccagctggctcgcccaatgtgcagagtcaaccactgaggcccagaagaggcaaggatgcgtctgggccccagcaaggcccaggtggaggtgagactggggcccgggtctttcattctctccatggtgccctcttggctgactgagccacggcccgtttctacctccttccctggagcagagggcgtgcaggggaccctcgtggggagccagtgctcccctgcactccatatccaatcctccctccagacacttggctcagctatcaccctcttctcctttatcctggcccctcccctccaccaaacacagtggttgctcctgtcccaaaggatatgctgcccttaacttgaagaaaggggggaagttaaacatcaacacaacccaaacaacccacatgctgcgtctcctc

SEQ ID NO: 146499 - DNA, 558 bp, Homo sapiens
aatgaggataacactttcatttattgtctctaacacttatttatttatttttgagacagggtcttgctgtgtcactcaggctggagtgcagtggcatggacgtggctcactgcagcctcaacttcctgggctcaagcagttctcccacctcagcctctgaagtagttgggactacaggacgcactaccagatccagctaatttttaatttttgtgtagagatggggtctcactatattgcccaggttggtctctaacattttaatcctgtgacactggacattccagggtgctcttggaggtactcaagaattgtcttcagggacgagcgaggtggctcacgcctgtaatcccaactttgggagactgaggtgggcaaattacttgaggtcaggagttcgagactagcctggccaacatggtgaaacctcatctctactaaaatacaaaaattagccgggcatggtggcgggcacctataatcccagctactcgggaggctgagacacgagaatcacttgaacgtgggagacggaggttgcagtgagctgagattatg

SEQ ID NO: 146500 - DNA, 206 bp, Homo sapiens
tgacacctgggaacttccccttctttccctggagctcagtgtcgtacttctaaaaaatgctgtattttaaccagcatttatatgtgtgtatggaggggtccctgtctgttcagtctaccatctcgaccagaagatcccttctggccagtcctcacacgtttgtctttactgcccctaccccaagaagccgccccttggggaccgtg

SEQ ID NO: 146501 - DNA, 694 bp, Homo sapiens
ccgggggaatgaaaagctaaacttaaagcatctctgccccccattccctttttataagacagagtcttgttctattgcccaagcttgggtgcagtggtgtgatcatagctcactgcagccttgaactcctgggttcaagcaatcatctcacctcagtctcctgagtagctgggactacaggcacaagctatcacacctggctaattttctttcttttttttttttttttggtagaaatggggtctcactttgttgcctgggatagttttgaactccagggctcaagcaagcctcccaccttggcctcccaaagatgggattacaggtgtgagccactgcacctgatctttttattccaattttttgcaaagctaaaaaactttactgtcctggaatcttccagcttcaacttttcctaaagtatacactactttgttttagttagacttgtgggaacccttgggaacaaatttattaaaaatcctatgtttataaagaaaacatagttttaaaaagtgcattataaactacaaataattttggtatgaatattattattcccttctagttagaatgaaactttggggaatggacttcaaaatttctgcaatatttgtagcctgatatccaaataaaaatcaatgattagttaactactagtgttcctcaacccatcctgtccttcttaaccaac

SEQ ID NO: 146502 - DNA, 300 bp, Homo sapiens
ttcctggcacagagtaaatgtctgttcaatggatgcttctctcatgaatcctctccccaaccacatgatcctgctttttctcctcaaacattaatttctttgctcttccatggagccctctttttagtccctcctgttcctttcctctgagccaaaacttgtccaactttaagtccttgccaaatatcacctccatcatgatctcacagcaggctgaagactcactgtcttctctgagctcccggattgctgatttcctgaatcacttttgtagccttcattctttgccagttatcttcc

SEQ ID NO: 146503 - DNA, 355 bp, Homo sapiens
gagcaagcacagtgggagcaggaaggaagagggagagggtgcttcgcccttagagcagggtttctcagcttggcactgtgatgtttctgctggtgttgtagaggcctgtcccatgcattggaggatgtttatcagcatccttggcttctgccctctagataccagtagccagtgtggcaaccaaaaatgtctctgggcattggcagatgtcctatggggtaccaaagccgtctctgtttgagaaccagttgcagtggagtgggaggggtggttcttgggaggaaggctttccagaggagtatctgtgcatgttctgaaaggtgattaggcccaagcaaaggtgtgaggtgtctag

SEQ ID NO: 146504 - DNA, 598 bp, Homo sapiens
taagaacaactgctaggctggtttttattgaacatggtttggaaatctctcgaacaaatgattcctgagacccaccccaattccaatgctatcattttgtgagttttattattcatctgaattcttacaactggtgtttggtaaccagaagaaacctgcaaggtgatgctcatttggacccaagcagtggtgaaattgctgactgaatcaaatagtgtaaatagatccacagaagaagaagtataatgaacctgaaattgctaaaccccttttaaggaaaattttcctagcataatatatgaagatggtccctctctttgttgcccaggctggagtgcagtggtgcgatcttgactcactgcaacctctacctcctggattcaagtgattctcctgcctcctgtagtcccaagtagctgggactacaggcacccgccaccaagtccagctaatttttgtatttttagtagagatggggtttcaccgtattggccaagctagtcttgaagtcctgacctcaagtgatctgcccccctcggcctctcaaagtgctgggattacaggcgtgagccactccactgagcctggccttttaatc

SEQ ID NO: 146505 - DNA, 784 bp, Homo sapiens
gacagtgactcgggagagaggatagaaggtggagagacatggagattgtcaggaaaacaactcagaaagccaccatatcaacctatgtgagaattggcaaaggcctgagagtagcagaccctgcaggtgcataagaacatggctttgtttgacaagacagaaagataaaagataaagagcaacaaggataactggcatttctagtagaacattcaaagagatgttaatgtcattaaccatgttaaggaataaaagagaaacagtgtttgtgttttaatcactttttcccccggagtgagagggaggctgaaagtcctagttttaaaaataatttctggctttaagttatctgtggaataccatgtttatgctccaggaggtcctctgaaatctgagactggtcttcaaaaggcatgtgaatgacagttacagatataagatttgagatgctttctaaaagtaggtaatttcacagccagaaaggcaaagatggaatccaaattcagtttccaaataaaatcagcctaggagggatagaggaatgagataagcagcaaaaagatgatgtcaacaaacccaaaattagaattctaaatctaataccaatagtggtgtctacacacactcacaaatcacgaaacctgtcaaatgatcagtgtaccaatgggcatgctcaacagcatacccatgaaaaacaggaggaaaaggaagggcagccaaggagcaagtcggtgccaatgacgactacatgtgacgtgactgtaaaggccagaccacaacctcc

SEQ ID NO: 146506 - DNA, 255 bp, Homo sapiens
ataaagtctagtcttaacagtattgcaccaatgtcaatttccctggtgttgatattggactacaattatatgacatttttaaatagttgttccatatttcgaattacatgattatattgagtctaaaccatggtcttttgaaattttttacaattcttagtgacgttggatttctcaggtttgtttggtgtaatacagtctataaagtgaatccctgggatctcctcctgtcgggcagtgtaatgtgaggtattt

SEQ ID NO: 146507 - DNA, 277 bp, Homo sapiens
aaagaattgttcagagtgccacagtgtgaaaccgaaaccccacatcagggagcccttggcttctagcagaacccgaacagacatcctcggggagcaaggtcaattgccaccttgttgtgacctgcttggggaactgcctgtcatcggctggcagcccagccacagatcactagccaaaaatggcacaactgttgaccgaatcagagagaaacattcaggtcagcaccaggaaaggtttcgaagcagggcgaggcacagagctccacatgccgggtgt

SEQ ID NO: 146508 - DNA, 293 bp, Homo sapiens
aaatccaagactaatattataaagttcacatcctttccaactcccctcaatgcacctgagcagtaagagtgcaatggttacacaaacaatagtacattcaatgtattatgtagccactatagtatttataagaaaaatgcttatgttaaataaaaatacagaatcgtatatagaccaaaacatttacagaaaaaagaaatgaaccaaaatgttagcgatgactttctctggaagtgggactataaataaaaagtaaggaggagtggggattactctagtctgaaatttccatg

SEQ ID NO: 146509 - DNA, 245 bp, Homo sapiens
gtactcccttctgtggggcagagctctctcctcctcctctggacccatctctccccagcgtcactcctgagtcttccaaatctctggctatccccattacttctcctcctcacatggatgtactcatccttaaaaagtacccctcccggagccccttcctttttgatctacatccaaactgctcaaagagttgttctcacgcatcttcatgtcttcatctccccatcagtcctcagcccactgca

SEQ ID NO: 146510 - DNA, 711 bp, Homo sapiens
ttttcttgtgtttttgccaggtattggtatcaggatgatagaggtttcatagaatgagttaggaaggaatatctcttcttcgattttgaaaaaattgtttcaataggattggtaccagctctttgcagagcttatttaaaaggctgtttattgggctgcatctctaggggtcctgcttcattaggtctctggtggattcagggatctgtaactttaatacagagaattctaatgcaagtgaatcacagctcatcctttgagaaatacatcccaagaatgtaatagtaaaactacagtggcatttgttgagcaatatttcattgaatcctcacaacaaaactgtgtggaggagctgctattttacatatgaggaagctgaggcccacaacaattaagtaacttgcttaagatcatgatgaggctgggcacggtggctcatgcctgtaattccagcattttgggaagctgtggcaggcagatcacttgaggtcaggagtttgagaccagtctggccaacatggtgaaaccccatctctactataaattcaaaatttagctgggtgtgttggcacatgcctgtagtcctagctacttgggagcctgaggcaggagaatcgctttaacctgggagacagaggttgcagtcagccaagaccacgccccgccactgcactccagcctgggtgagagagtaagcctctgtctcaaaaa

SEQ ID NO: 146511 - DNA, 322 bp, Homo sapiens
ctgaagtcatttttcaggtctaggaatcttttggtggaatatttagggttttctttgtatagaatcatattgtcagtgaaggaagataatttgacttcctcttttcctcttttgatgtcttttctttctttctcttgcctgattgctctggctaagatttccaatactatgttgaataggagtggtgagagtacacattcttgtcttgttcccattgcaggagaatcgctttaacctgggagacagaggttgcagtcagccaagaccacgccccgccactgcactccagcctgggtgagagagtaagcctctgtctcaaaaa

SEQ ID NO: 146512 - DNA, 396 bp, Homo sapiens
aatcgctccctccatctttttcctctctcccagagcactgaccccttctcagtgcggcacccaagacccaccccagcgtcctggccggctcatgctaccacgcccaccctggccccactgcttggaatctagcctggcaaaactgcgtcctctcctctgaaaaacccgctttcctgtctgtccggctatgtcttccccaggctgggggctccttagggtcccagcagctcccagcaccggactggcatagagggtgtgtttggcaaattgagtcggggcgtctgacatgctctgtctgtgtgtggcgggaaaggccatcagccctgcctcagttaggaagcagccacctgattgaactccagcctcagtctcctcaactgtgaaattggaggaaaa

SEQ ID NO: 146513 - DNA, 540 bp, Homo sapiens
gagtatgtcggggagctgatctctgatgctgaggctgatgtgagagaggatgattcttacctcttcgacttagacacaaaggatggagaggcgtactgcatagatgcccgttactatggcaacatcagccgcttcatcaaccacctgtgtgaccgcaacatcattcctctctcccagagcactgaccccttctcagtgcggcacccaagacccaccccagcgtcctggccggctcatgctaccacgcccaccctggccccactgcttggaatctagcctggcaaaactgcgtcctctcctctgaaaaacccgctttcctgtctgtccggctatgtcttccccaggctgggggctccttagggtcccagcagctcccagcaccggactggcatagagggtgtgtttggcaaattgagtcggggcgtctgacatgctctgtctgtgtgtggcgggaaaggccatcagccctgcctcagttaggaagcagccacctgattgaactccagcctcagtctcctcaactgtgaaattggaggaaaa

SEQ ID NO: 146514 - DNA, 561 bp, Homo sapiens
aaatataagcgtgaactcatttgttgttcttttaccgtagacacattttctacctctgccccagtagcagtagacacatcaagcacctagaaagtggtctctaatacatgaaaaccatgaattcatagtgatggtttcaaagccaaaaccaaccaacaaacacatgtaattggtcactcttggaggtacctagggcactaactcctaacactgggaatggacacttgaaggaagatcagtaattatcctgtcttttctctacaaattgcaattcagggaaaccttgttgattagggaaagttctttacataagaattcctgcaagtaagtgagtaaagaatgacagtttaagaattgtcccagcctggccaacatagtgaaaccccatctctaaaaatacaaaaaattagccaggcatgatgatgggtgcctgtaatcccagctactcaggaggctgaggcaggagagttgcttgaacctgggagacggaggttgcagtgagccgagagtgcgccactgcactccagcctgggcaacaagagtgagactctgtctcaaaaa

SEQ ID NO: 146515 - DNA, 327 bp, Homo sapiens
cctaactgagacaacactagtgaaatgaccccacccacctacacctccagagaggaggaggatgagcatgtacagcaggggggacacccacaaagaacaaacaattcatttacctgttcgttctcatctccctaattataaattaaattgatcctccagacagtgttttatatgaaggaagaagccaccttttttacagaggacctgaaaccgtcaaccatcttcacacattctttttctttcttttaaagtataattaggtatttccatcttccttgcttttttctccaaatgaaatgctaatgggagccttattttacccacttc

SEQ ID NO: 146516 - DNA, 718 bp, Homo sapiens
gttagatttttttttttaagcagaattgtgttctgatagttcaaacagtgctgctataatgaataaccatgcttatgtacagtgtatatctgagataaattccttagaggtgggtttattgattcaaagaatagataaatttataattcttataattacaaattgttcctcaatagcgtgtatcaatttttgctctccatgtgtagtatatatgaatgccttttttttttgccacatatggtggttcacatgtataatcccaatgctttgggagactgaggcaggaggatcacttgagtccaggagattgagaccagcctggacaacatagtgagactctgtctccctatacacacagaaaaagagtgcctttttttctgatcacttttgaacaaggctaaaggattacctctatgtatggggctaataagtactaaaatactaaatttgatttcagttaggttgcatttgataggacaaaagtaaaatagtactagagagcagaagtatgaaactgtaaattgctgagaaatcagctctagagttgtataaattattagaattgagccaggtgcagtggtgtgtgtgtgcctgtagtcccagttactcaggtgcttgaggcaggaggatcgtttggggctaggagtttgtatccagcctgggcaatgtggcaagaccctgtctctaaaaaaacaggaagattaaaaaaaaaaaaaag

SEQ ID NO: 146517 - DNA, 375 bp, Homo sapiens
cagaatccccagaccctgcttggagaacaagcctagcttgttgagggcctagctgcacgttccctggcccacttatggagttgggggactcaaatgcattggtattaaaatcaatggagacagcaattctggaccacagccttgacactagaggattgttttctcccaaacagatagtagtcatatattcatttcaaacagcacagtggagcggagaaagacttgttaccagttaagatcagattcatcttaaccatgaaaatgaattatagatgtatccctgcattcaggtgtttaaaaacatttaagtgttttttcataacttcttttggttttcccacacttctgagtttatgtgccaggactagtaactag

SEQ ID NO: 146518 - DNA, 325 bp, Homo sapiens
actcttgagggtaaaatgtctgcctgccagatgcctgaccttgggcaactgatttaatctttgtgtctcattttctcatctgcaaagtgggtctaatcattgtacctacctcatagtgttttcgtgagcattaggtaaatgaattaatgtatgcaaagtcattagaacggtgcctggcacataacaggctcctatttggaatgtcagctgttaataatagcaataataataattacgtcatttcagataggagaccctgttatattttgccataatgggtcacattcagttgcagggtgtttgttcagaggggatggtggggggt

SEQ ID NO: 146519 - DNA, 120 bp, Homo sapiens
gaccctattattgcaccaaggaactagtgatctgcttgttgctgccacagcacatatcagtctgtgtactctgtgaagaggcatagacccctgggacatgaccccatcatatgggctggt

SEQ ID NO: 146520 - DNA, 454 bp, Homo sapiens
tgccgtcctggaatggagccctctgcagctgccttcaatctgggcctgttaggggagcgctggctttgatgtgtgagcgcaacattctgcttctatactcagaaaggagccggccttgaatccgttccaatgtgggcaagtgattacaaacgccctgtcttcagcacagagaggagcacatggtcctggtctccccgtgggtctgtggtcctggcaggtggtggctgcgggggacggcagtcgtgtcagtgttccctggggtagttgctgtccctgaggagagggaagaatatctcgcggcacacagtgtggctgcctgccggaagcctcactatggtgttttaatcctcgagagagcctgtgagcccattttagagataaagagagcagatccaaagagaaatcaaaagctagtaactggccagggaccctggtagccttctggcgtacactg

SEQ ID NO: 146521 - DNA, 287 bp, Homo sapiens
gcagctgaccacataccctttccccagtctcctttgtcttcacctttcaaggatcctgagctgggatgggggagaagtttcaactttaaagcaagaagttatgggactgaataatttagttactaaatgcgtactatgtggtttaaagtgaccggaagattgctgatattactaagtgtgaccagaaagtcatagacttgctctaaatttcatctggggcagaggaagatctggcttccccgggcagatgaaaaagaacagtgggaaatcaaataaatttgcttgtg

SEQ ID NO: 146522 - DNA, 2993 bp, Homo sapiens
  misc_feature (128)..(128): n is a, c, g, or t
  misc_feature (134)..(135): n is a, c, g, or t
  misc_feature (140)..(140): n is a, c, g, or t
  misc_feature (157)..(158): n is a, c, g, or t
  misc_feature (163)..(164): n is a, c, g, or t
tcgtcgcgcgctcgctcgctcgctcctcgcctcgctctcccctttaaacgcccacttcgtatggggaaagaggacaacttgaagtcaagttgcaattaacttccgcggcagcgcagctccggcgccgncggcgnnacggnataggcagaagccgccnntctgnnaagtccgacgccggcgcgcccgcccggggagccgttcttggtttcaggcccgcactcgacagccaccgccgcccccaacgtccatgcctgagtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttattt

SEQ ID NO: 146523 - DNA, 2923 bp, Homo sapiens
tacggctaggtacgaggctggggtaaatcggccgaggaggcaactggtaaccacctcatttggggatgtttctgccttgctagcagtgccagagagaacttcatcattgtcacctcatcaaagactactttttcagacatctcctgtagggctagattcagagagcagcttctgatatttggagggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttattt

SEQ ID NO: 146524 - DNA, 1259 bp, Homo sapiens
ggagttttgcttgtttttacgatttccccccaacgaatcacttgtcagatcaattttatcttcttcctcctccctgcttcccactctcccctcctccccatcgcaaaccccgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttattttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacaggtacttagcatagaatgtaataaataataagacatcatgggcaaccctgatttgaggtttgatggagctccctggtttaaagcaactggtatctgaagcaagaatctgccaaaaatgcaaagtgacttgaccactggtgaccttttaaaatatgcctgattc

SEQ ID NO: 146525 - DNA, 3172 bp, Homo sapiens
ggagttttgcttgtttttacgatttccccccaacgaatcacttgtcagatcaattttatcttcttcctcctccctgcttcccactctcccctcctccccatcgcaaaccccgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttattttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttattt

SEQ ID NO: 146526 - DNA, 1362 bp, Homo sapiens
ggagttttgcttgtttttacgatttccccccaacgaatcacttgtcagatcaattttatcttcttcctcctccctgcttcccactctcccctcctccccatcgcaaaccccgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttattttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagcatcctgggatctcaaatatgttggacaatttatttattaatggaaaaataaattttaaaaagaaactacctcgtgctcctgaagcttagcttcagtactgctctcctgaaacatgacagtcatttccgtaggaattaaatacacttaggtgtttagttgatgttcagtctgtattataaatgatattggagcaacaattacaaatctatcatgttatacaaatgtgtttttaataaactgtactttatttcacagtttttggac

SEQ ID NO: 146527 - DNA, 393 bp, Homo sapiens
aagaatcgagctcggtaccgacgggatactgatctgcccaaggaaaagcagcaatggtggcagagtctagactagaactaaggacttaatccaatggtagtcccactacagtagactgtcttggttcttgagctacaggaagaattagagacctggcctcagaggagttcaccaacaagtaaactctaagcagtcaggaagcccttttgcatgtggatctgggcttttctctttatctgagactctgtcaaacattatctagactggctgaaataaatctatttcttttcccaaagtctaatgtggttttgcccaactcactgaacctcaaggcatacagtcaaagataaaaatgtctcctggatcagtatcccatcggtatccaacagtatc

SEQ ID NO: 146528 - DNA, 150 bp, Homo sapiens
gttactttgtccccatgcctatttaagtgtgtggagatttttccccccatttacaaagatgaaatagactccatgggctgcttggaacacatttaacttatctataggtttcaaaagcacagcaggtccagggcatgaaaaaggcaggca

SEQ ID NO: 146529 - DNA, 449 bp, Homo sapiens
atctttgagaggttgagaactgtcattcctggatagaactcccttgattgtcagctgtcctcacaaaagcagaacattgtacaaagtactgaacagggtaacctggaaacagacctctgtctccctcaattactcagccaaggtaagcccagcctgctgggtaagacactgaagtgacctggctcttaagtaggcaagagaggcctcatgtataagaggatggactttggagtcagagacacccaagtttattctcagctttgccacacactataagcctggtggtctcaggcaggctgcttagctctgtaagcctcagtttcctcatatgtaatatggtggtaatgataggacctacctggggcttttgtgaaagcaaaattgaagagagtatatatatcacttgatataatgatgtaaagaagcctctcagtaaatagtagcttttg

SEQ ID NO: 146530 - DNA, 155 bp, Homo sapiens
aacaacaacaactacaacaaacagttcggtgaaagctaagattttggctgttttgttcatttttgtatccccagtgcctgtaagcatgttttgcacataatgggggctcaaacgtttgttgcagaagtgcctcttacaacacgtgccacttacaa

SEQ ID NO: 146531 - DNA, 203 bp, Homo sapiens
ctgcacttcctaggtgtctatatatccaaaccaggaggggaagggaataaacaaacagatggaaagggaaggagatcagtcatggttttccattttttaccttactagctgatctcacccctacaacccaccctttaacatgctctctttccacaactcccatcttaaagaatggatagctgtcgacatttgcttttgcatat

SEQ ID NO: 146532 - DNA, 350 bp, Homo sapiens
gcttggggtgatgaggaagctggggggaggcaagagaggaccctgcctctcctgaggagtgagcagagccagggcagtccctggggtccagggccaagatttcctgctgacccctgcaggagctgggagggcagagcctcagcctccactatgttgggggaagggctcccgggcccccggcacctggacacccacctgtccagagcctacagagaccctgcgtccccacacagcagctcctcacaccagagttctggtgcccagcactcctcagcagcagtgaggccacaggcagggcacaggcctctgtccctacgccaggtcctcccctaaaagggcagtggcagcag

SEQ ID NO: 146533 - DNA, 193 bp, Homo sapiens
ttatttgtccttggcccaatctctcccccatcaatgacactcttgaacacagcagcccgagttcccagtatagaaccctgaacactaactctagagacagcagatcagaccttatttgcaaattattgccttgcattttccaatctgtataagcactatccaaaggtctgaaacaaggctgcttttttttttt

SEQ ID NO: 146534 - DNA, 318 bp, Homo sapiens
gccattccggataagcaagtgctctgaatcacagagtttgcttcaatcttttgatcaaaatcatctttgaatgtactattttccaccctttctaaattaccacaatcccatgcagaccaccttagaaatgccagttaaacagtgtgggattgacatactgctgaaggcaatgaaggccgctccatatcatgaaccatctgtgtgggctggtgcatcttcctcagcatcatggcacagagcaggcagtagaagttactgatggttattgttgctcccttttgtacatcctgatcccagagtcattctctcagctttttt

SEQ ID NO: 146535 - DNA, 155 bp, Homo sapiens
ccgagatcacgccactgcactccagcctgggcgacaaagcgagactccgtctcaagaaaaaaaaaaaaaagttaattaataggattattacactttgctggtgactttttcccactgggcagcccccgccagcccctgttgctgtggcttcatct

SEQ ID NO: 146536 - DNA, 167 bp, Homo sapiens
agcagccatgttttattatattacacagtgttaataatgaattgtcagaatgcaaattactgtatactagccaaaagaatatcacaactatcacattttaaacttgtgtttcttagcatgtatgaggtttagaattatttaacaatgtaactcagtgcatttaaatg

SEQ ID NO: 146537 - DNA, 516 bp, Homo sapiens
tgaaagagcccacccaagatcagcagaactctccagctgagcctagctcaagttgccagcacatagaatcatgagttattttaattttaagatattaaaatctgggagctttttgttattattttttatagctaaatctaacagacacggtcccttaataatacatcatatacatcaaatatttactatatttggggcgctgtcttaagtgctttgcctacattacttcacagaatttttaccatactctatgagggaattattaatatccctacttcatagaagaggaaactgagtttcaaagtggttaattaatgtatacacctggacaacggcaggtgtcaagccacaatctctctgatgtcacaaaacacactgttaaccactacccaatccagaaagacaaaatcaatgaatggggaactcaaaaccacatggactgaaggatgggggcaagaattaggttggcttaacccggggaaagtagacactcagaggccatgaaataaactctca

SEQ ID NO: 146538 - DNA, 266 bp, Homo sapiens
catgttcaaatttgggaggagttaatatgaagcatgtggtggcaattcaggctgtgatgacgctccttcagagtgaactctagttggctatattggttgcaactgatttcagccagttttgttatcttacaagcagaaggagtttcagtgtttcagaaagttgtttcttatctgctatcttgcaaactcaagactttctgttagttactggtttaagtttttggggcatggttttactaacaacttcagtccctgggcaacagcat

SEQ ID NO: 146539 - DNA, 575 bp, Homo sapiens
gatcccaggaggtgtctggcactacacaaagtgatatgagcatgagagtgcagaacataatgtttgggaacatagtgttcctctggggactaaaaaattaatgcagatccaaaactgttaaaaaaaaaaaaacacaagggttggttgtaataaattacaggaagacaaagtgaaaagcgtaggggcaaaaaccccaagcatcatggtaaactagggagcacaaaagcagaatatgataagccaattaaccttaggagagtacagactctcagtaagggcagaatacaagagacttagcctttgaaggcaattttgcagactcagttacttgtacacatagacaatcaatagatgtttctgatggcccactggcaaatatatacatatatttgtttgctgtagatgaagcccaagccatcctgcatataataaagtatttaggaagaaaataagtgggttggcaaacttttaatgtacataactggagacctagttctggaaagcagctctaatggaaataggagcaattgggtttatagttgctgatttttatcagcaaccagaaagtgtgctaa

SEQ ID NO: 146540 - DNA, 153 bp, Homo sapiens
ctcattctttaactcactgaatctggcatctgccagcacaactttactgaagctgcttattattcactggctgttttattgttttttattcagatatcatagctggcattgctgaagactacatagatcatggaaatgacatttttgtatgtt

SEQ ID NO: 146541 - DNA, 277 bp, Homo sapiens
caagcaggagagggatctctggaaggataaagggaacaaatttcttccagaaacagtcatatggtatgggcccaatgatacactgatctatcccttaggcttcaattacccttttacagtacttcataagctgactcattggaattcagacaaaatgttggcatggggaaagcaatggtattgaaaatcattgcctatgattgcagaaaatgtttagtcttgccatactgtctgtcccaaacataatcctggaaaaccccttcatgggtcacaggga

SEQ ID NO: 146542 - DNA, 379 bp, Homo sapiens
agatcaaaaagcttagagaagtgaacatgttaggatggatttattacatgagagaagaagaccgaccagttgactatgttcattggaggggcccagagtatagttcacttaccaaaacaataaggaatgtgatagtgaagggacaccagcattattgaaaagcttcagctgggcgtggtggctcacgcctgtaatcccagcactttggaaggccaaggagggcagattatttgaagtcaggagttcgagaccagcctggccaacatggtgaaaccctgtctctacaacaaatacaaaaattagccgggcatggtggcacatgcctatagtcccagctacttgtgaggctgaggcacgagaatcacttgaatctgggagg

SEQ ID NO: 146543 - DNA, 494 bp, Homo sapiens
ctgttcttgctgcaatatgccagccgcatttccttttacacgggcgtctccttttgtctcctgtctgtgggtactgcagtagcaaaaggggcaatctgtggtcttttctccataacccctcctgcagagaacaactttcaggctgggggtttcctgaaacatagattgcactggacagaaggacttaacatgtctttgttgcaccctaaaacatgacctttagtttctctctgcttagaatctatatgctgtgccacgatttttctaccatgattttatcttgtagaattcactttacctctctgggttccaagtcctcatttattaaatgaagatcccattctaagattgtgccaattttcctatttccaaattcatcagcaccgagagtgcctgtccttactgtggaggtctggcgatagagagcaggttctccctgcaatattgacacaggcccgcctctgctgtgggggcctgaacactggcatccctag

SEQ ID NO: 146544 - DNA, 335 bp, Homo sapiens
agcaggggttatcactggtcctgtttcagagctaaggaaacatgctgggacttgccccagatttaacaggaaagcccaactgttcaaaagttaaacaacaaaaagtgaagaacattgcttttttaaaaattccaaatttaaaaaaatgtagtagaagacacaaagcataaaatttgccattttacagtggccagttcatggcattaactacatttacagtgtgtgcagccatcaccagcgtgcatctccagaactttctcatcctcccaaactgaaactctgtccccattacacacgaactccccatccccttccccagcccccgacacccacca

SEQ ID NO: 146545 - DNA, 955 bp, Homo sapiens
atgatgcagactttctaacggatgcaggtgttcggaagagttgtggatcgaaacgccttcatgatggcttggaggtgtaggtagcaaactgacgtcacaggaaggaacacaatcttgggtacctactggcaacgttggagggagaaagtgagcatcaggtgccatcattttatagttgatctatgtgatgaggttggtatcggagcataattggtacaaaggaaaaatgacttaggcagatgcagactcacgggccaggctattttattagggcagaatgatttggtcctttgtggaagaattggtggagtgaagcgtgaatctttcccagcacaacccaacaacagtcctggccctaagaagtggagcatgggagttgggtgtggttcgtgcctgtagtcccagctacttgggatgctgaggctggaggatcgtttgagggtgcagtgagctataatataatataatcacaccactgcactccagcctgggtgacagagtgaaaccctgtctgaaaaaaaaaaaaaagaaaaaaaaaaaaaaaaaagggggggggggttaaaaaaatatccccgggggggcccaaatttacggggtcaccccgttttttgaaaaaagggggcccctatgggggaggccgtataaaaaagactagacgaggagcgcgatataacaacgccgtggagggggaaaaacgggcacggggagactgggggagaggacccctcaatcctggggggggacaactgggcacaccccccgaggagatattacgcccagggacatcatacgtcgcggcataggggtaaccacggcaagccggggcgagaattggcacggactgattcgacaatttcggggcgcgaacaacccaagcacaccggagaaagagagaacacgacgacaccaagcacagacaatcaatcagcagaccacgagacacatcagcgaataa

SEQ ID NO: 146546 - DNA, 675 bp, Homo sapiens
gcttgaagacaagctatgcacagaggagacaaaaggaaacaataagaaagaatgaagcacacctgcaagatatagatttgccctcaaaaggacaaatttaagaattattggctcttgactacctcaagacatttaaaaatgaaactcccaatgatcagagataaagtaagaaacataaaagcagcaagagaaaagaaacaaatattaataacacagcacagctccagtatgtctccagcagactttttagtggaaacctaacagctcaggagagagtggcatgacatatttaaagtgctgaaggaaaaaaaacttttagcctagaatagtatatccagtgaaaatatccttcaaatgcgaagggaagaaaagacattcctggccggcgtggtggctcatgcctgtaatcacaggattttgggaggccgaagcaggcagattacctgaggtcaggagttcaagaccagcctggccaagatggcaaaaccccgtctccactaaaaatacaaaaattagctgggcatggtggtgcatgcctgtagtcccagctactcaggaggctgaggcaggagaattgcttgaaccctggaggtggaggctgcagtgagccgagatcatgccatctgaaggtacaaaactcactggtaatagtactacacagaaaaacaaaggata

SEQ ID NO: 146547 - DNA, 286 bp, Homo sapiens
caccatgccactacaggttgaaggagccacaggctgcaaacagcaatgttttcccaaactgcttatccagccatgaaccacccacagcatttttgcaatatctccctacctcctatgaaattacttacttaatttttttaatcaatgcactttttgctgcctaaataaatttagggactattagtctaaacactagcaactcagaaatcacaggttttataacaccatcatgtttattttgtgtaatatatttttaaatggccaggcacaatagctcacgcctgta

SEQ ID NO: 146548 - DNA, 499 bp, Homo sapiens
ggaaacttacaatcatggtggaagacaaagagtaactggacatatcacatggtaagagacggcaagcgtgaggtgaaggagtcagtttctttaaatgaaccagttctcatttgaattaatggagtgaaaactttctcatgaccaggatagcacaaaggcattcatgaagaatttgtccccatgacccaaacacctcccaccaggtttcacatctaacattgaggattacactgcagcatgaggtttgcaggacatagacatccaaaccataccacagaccaactaggcttaacagataggtacaaaacttttcagttaaaagcaagaaacaacacaatgttcttatttgcacctgatgtattctgttaggacacataacaagtcttattaaatactggctggatgtgtggttggtacctacaatcccaataatttggaagatgaaggtgggaggatcacttgggatcagaagattgacaccagcctgagtaacacagtg

SEQ ID NO: 146549 - DNA, 6147 bp, Homo sapiens
gcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccatggggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaacatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttttgtatattgatgaatgagatcttacctattaaatatattattggaaaaaaaaaaaaaaaaaaaattaaagtttgagtgtgtgtgtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtatttt

SEQ ID NO: 146550 - DNA, 1224 bp, Homo sapiens
gcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggactttacaaaatatgctacctcaaagtgctaccgataaacctttctaattgtaagtgcccttactaagggcacatgtcttaatcaaagttagttttttgttttctggtttgttttttttttttttgtatattgatgaatgagatcttacctattaaatatattattggaaaaaaaaaaaaaaaaaaaattaaagtttgagtgtgtgtgtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtatttt

SEQ ID NO: 146551 - DNA, 346 bp, Homo sapiens
agaatcacttgaacccgggaggggaggtggaagctgcagtgagtcgagatcacgacactgaactccagcctgggcgacagagtgagactccatccccaaaaaaaaaaaagcttgcagtatctcccacaagcttctactcacttatcccacaaatatctaccacctactaggtgcacacactgttttggaaactggcaatgcagcagggaacaaaacaatgtcctgccttcacggaccttctagtcggggataaagccaaatgccttagcagggcccatcatgaaatgcatgcctgcctccctagccttgtgtccttcttctccttgtccgtgccccctagtcatat

SEQ ID NO: 146552 - DNA, 580 bp, Homo sapiens
tccaccaataacccctcatggatgagtgattgttactgtgtaggaagaacttggggctcagtgaggttgagccacttttccaagaggccacttagagctggagctcattataagtaggggtctctaggaactgtttctaaacaacccccgaacccagctggtggctcccagaagggtctctggaagcaaggcgactgtctcattgtttcattagtttgagccctacggggccttaggacacagccagcttggagaagtcactctaataacccatcttgccggtgatgcccaggcctcggcagactggctgtccgagggtgtctgggcctgggcagccgaggtcttgttaaccccaaatcccacaggactcgcatagagtgcagaatcccggttttctgaattggtgctaaaggctcagtggcctggccctgctgtgaagccacagggcttgtgctctgggagccttggccgacacaggtgccccgccgcctcctctgctgctgcagcctcaagggctacaaagaaagctccttctgcccgtgcagcgtgggctcctgggtcccctgcaggccaccatggc

SEQ ID NO: 146553 - DNA, 286 bp, Homo sapiens
cctgaaagatcatgctatgtgctgacgtctgaaatcaggtacctgagggatcccatttttgctttgctactagagaagtaaaattcaaatgtcctaaagaagcaattcatgtgttggttgataatattgaattgtagtcaacttaataattagagtgagaaaacactcatcagatcctttgtggcttgaattattgagaaaagggcattaagagtgtactgaatcaaaaaacaggtgatgaggtgtgagaataatatgagagcatgataaccagctaagtttaact

SEQ ID NO: 146554 - DNA, 410 bp, Homo sapiens
agacaagacacttcacagagaagctgtcactgcagccggctggccagctcagtggggaacagagtttgccagacggacaatcaagggtccctcacccaccaccttggtaggcttccaactgccacaaccaacagaggcccaggcatcaaagggcagtaacaaacggccccctgcaccccaccctgcgaggccacagaatcgatccacgcaagagtgcggctgtcactgatgccaccagctgtggagtacgttgttccacaacaaatgaacctgcgagcggctgaaatctcatcctacaggcaaagagcaccaccgtatcacctgcagccatggccacatgaccagattccaacagcagctggatggagaacctggggatgaacagtgaagtgctcaacaacgaagaccgc

SEQ ID NO: 146555 - DNA, 211 bp, Homo sapiens
ttgcaaagacagaaaggggacagaaaggagactgcaagagaagccctctatggagcaccttcaatggactctggccacatccctactctgtttctataagagacctttttatgcttaaaataatttcatcttttacaaggtagtgcatgataagttttttatttataacctaaagagtgttaattaattcagtcccactatcgtctgtgaa

SEQ ID NO: 146556 - DNA, 142 bp, Homo sapiens
cacactcaaataccgacccaagaaagaaaagcttccttgccactttccttttctcattagctgatacttttcctcttacccaccataatttatcctttaaagtttccagctttatgcaggatcaatagagtcttacttccaa

SEQ ID NO: 146557 - DNA, 136 bp, Homo sapiens
agaattaccgaaacgtctgtatgcccctggtgagaaacactgctcatgttcaaccaggtatttgagtcattattcctccctctagacctctccctcctccctaacttccttccttcgccgcttcctctcatcttcc

SEQ ID NO: 146558 - DNA, 242 bp, Homo sapiens
ctcagaaggaacccaagtagcaatttcaccatagtctcatccctccaaatttctcctaaaaaatattccctcaatccaggatttttactacttccctctgtggagagaaaccccatgtctaacatctgtctcacccaagagcatgctggaaaattctttggcttcaaagtccaaagattgattctggatattgaatgtccagctaagggaaaccaagaaaagacttttctgttttctccttc

SEQ ID NO: 146559 - DNA, 123 bp, Homo sapiens
tcatgcatatgcacataaatttctccctatcaatggaatttctgagtcctgtaggttatacataagtttcactgtggttgatactgccagttagttttccaaagctaattgtaccagttgaca

SEQ ID NO: 146560 - DNA, 588 bp, Homo sapiens
aggcaccatgggtggatcagcgcgccctcttttgctggaatcagagcttccgtcacgggaagcgaccagcttgctgtcctccagcatgagacagtggaccagggaactaacgaggcagacacacctgtgcaccctcccacactggaatcagagcttttgcccagggaagccactgtcacactggtccctgagcccacgcagcaaccctgaccaccagcaccggacaccagaccagggaactcggcaggcaccacaggtggagcagtgtgccctctcccgctggaatcggagcttgcatctgggaaagctgccagcctcctgtcctccagcaccagacagtggaccagcaaactaaccaggtggagccgacgcaccagcgtgccctcccccactgggatcagagctttggcccagggaagccactgccacaccagtccctgagcccgtgcagcaaccctgaccaccagcaccagacaccagaccactgaaggaggtaggcagggcgaacggaccagtgcgccctccccagctggaataggaacttctgttatgggtgaaaaatcgagctagagggaatacttccaaaca

SEQ ID NO: 146561 - DNA, 762 bp, Homo sapiens
catgggctctgaattaggaggatctggtggacctttccttgtgcctttaccccagaaagttaaagggagggatgagatcaccagttccaccttggtttttcccattcttgggtcttgagttaatctccctgctcctctgagcactctttctgcctgagggcttggaggtaagagacagccccagtaaacactggttgagccagcatccaccacgtgccaggcactgtgctctgtgcccaggagggtaggacatgggagggaagagatctctgcaagaagctcagccttcaggtgtcagatggacctggaatggaattcttggctcagcttctcccaagtccttagactgggcaagttaggtgaaccctgagcctcagtttctcaatctttaacattctctactccatacagtggttgtgaagattgggtgagctaatacctagagagtgttgggttctgtatctagtacaggaatgctcaaaatagaaaagctgtaattacaaaatggttcttgccttctagttcaggaaataagatcgtccaatttctggtgacgaagatgaccctgatggtcatctagtccaagcatccagagtccactgatagtgttgatgtctacctacactcggacacagcataggaagaaatgccaagggccagtgagctttgcagaatcctgtgagtcacaggcactcagaccagggagtcaactcggggagtcaaattaggaaaggcttcgaaggatgggcaggacgtaagaat

SEQ ID NO: 146562 - DNA, 554 bp, Homo sapiens
catgggctctgaattaggaggatctggtggacctttccttgtgcctttaccccagaaagttaaagggagggatgagatcaccagttccaccttggtttttcccattcttgggtcttgagttaatctccctgctcctctgagcactctttctgcctgagggcttggaggtaagagacagccccagtaaacactggttgagccagcatccaccacgtgccaggcactgtgctctgtgcccaggagggtaggacatgggagggaagagatctctgcaagaagctcagccttcaggtgtcagatggacctggaatggaattcttggctcagcttctcccaagtccttagactgggcaagttaggtgaaccctgagcctcagtttctcaatctttaacattctctactccatacagtggttgtgaagattgggtgagctaatacctagagagtgttggtagacatcaacactatcagtggactctggatgcttggactagatgaccatcagggtcctcttcgtcaccagaaattggacgatcttatttcctgtgcagag

SEQ ID NO: 146563 - DNA, 367 bp, Homo sapiens
gtcttatatctgtgtatttttggattagaacatatatcaaatggcatcccaaatttctctgggaaacttattgaaaattaaagtgtttgagattaaacctcaacctttcccccaatttttcatctctgatattgctaatattatctgctgccaagattaccatctactgatctatgctcttctctttacttaaaacaaacagaacaatgttggggtgcttttatatcatttaaaatttgtatgctattatctctatatcctttggcatgtttagtcataattataatgctgctgatgataaataagaatacttgccattttaaagtacttcatagattacaaaatgtttttatacattatttttggt

SEQ ID NO: 146564 - DNA, 285 bp, Homo sapiens
attgtccatcctggctcctagagccatctcttgagttgctgatcctcatctacccttggatttataataggccttaaactttaaatgtgcaaacaggactcctagttcctatctcctatcctcaaatctacttctcttttaacctttaaaattcctccttctatcctcctgttctctcctactctcactattttgtagacacattggcctttctattccttgtctatgccttcctagtctcctcttctcccttacctggttctttttgacactcagatctcagtt

SEQ ID NO: 146565 - DNA, 401 bp, Homo sapiens
cagcacacgtagaaaatgacagaattgtaactaaggcagatttatgagttcagctaaaaggggtggattcctgagtttttcagaaagaaatgggatatggcaaagggaatttgtgacccagggtacaggtgtaagaacctatggatagaacattactgaacttgtggaaatccaaaacacaattttagcttctctcttcattgagtccattcttttattgtttaccaaggaaccaaatgaattgccatcttccttgtttcattctctcaaggaaaggaataaagcagggaaattagcagcttcttcgcttccttgttttttgtttgaatttgtgggcagacatggaggaggtgagaggaaataagaaaggagggaggaatctggtgatttcccaacgtgga

SEQ ID NO: 146566 - DNA, 399 bp, Homo sapiens
gttgcttccttcccatgatgcctggtaccattcatgccaggggcgtagagaacaaacacttcccatttcagaagaccccaatgtccacctgaggtcccctctgcccaagcctttgctgacctcaggtcctgattgctgttgttggcctgagagtcaatggaggatggggtcataataacatgatttcttcagcactgaactatgggcttttttttttttttttccttttttgagacagagtcttgctctgtcacccaggctggagtatagtagcacgatctcagctcactgcaacctccacctcccaggttcaagtgattctcctgccttagcctccctagtggctgggattacagacacctgccaccccgcctgcctaatttttgtatttttagtaga

SEQ ID NO: 146567 - DNA, 511 bp, Homo sapiens
agactaattatacaccagccacactatgcataattcagctcctcaaatagacctaagttgattcccaccctaaagtctttgaacttgctgttccctatgctagagtgctcttcccctaattatggaatagctcagctctcaatttacatgttctcacctcaaaaaggcacttccttaacacccaatatcactacaagaagcaggtgccttgtctttttaccatcctataaccaacatctagaactactgtgcctgggctccattacaggcactcaatgaacaaataaatccccacagtagcctataatcgtaatttgccaagtgacacaacagcaacattagaaataaatctttctcaaggacacacagctggtaaatggtgagtctatttccttgattcaaaaggatcttccatgatttaagggacacactagtgatcacaaattacagctgtattatacatgtatgaagtagtaaacagtttggtaggaaatgaaacataagacacatt

SEQ ID NO: 146568 - DNA, 398 bp, Homo sapiens
cgagctcggtaccgaataagagaagaagaaggcagtgtttcctctataaacctcacactcctgagatactgagctaccaaaagcctccaaggtgctgcaccagttcacacttctgtgctcgacattaatatggctttacctgtagtttcagacactccatcatctctgcacacttgataagcttgtacttatccttcaagacttagctcaagtgtcctccagtctttgaagctcactgatcacatctcttttcctctttctatgatagcttactactcttattcttgtctccctattttgaatttatatgatgatatgccttacctccctgcacctcaaaatgagctccttgaagtcaggaaccacattttattcatttatatatcctcagtgcctag

SEQ ID NO: 146569 - DNA, 487 bp, Homo sapiens
ggctggagcccagaactggatatggtcatatctgagaaatcagacactcaagagtaggagtcacctctctgggtctgagtcagcaggcacctcccgcctctgacaggcctaaccacttatcatgagccaggcatgcactcagggtagcctaaatgctaagtactgccagcaatgctcagactcttagccagccgtggaggtcttctctggggccacccaactatcctttcagacctcattctgatatctctgcctgaaaaagcacgcggggcagcaatagtccccaatcactgtcccttttaaggtgtaaggaggacagggcaggggagtgggctgtcctagtccctttcaggggctatactccaagccacaagtctggtttctattacaattttccaaattgatatgtgatcctggtgacaacagtcactctctgcactggagtgtgttagcaccatctgtaaaatgggccacttgcctttctttt

SEQ ID NO: 146570 - DNA, 121 bp, Homo sapiens
tcaccccattgcaataactaatttttctttagtttacaaactagagattgcagagggtaataccaatactaatgtaaacagaataactctttttttaatgtggcgtgtttctgggtatgaa

SEQ ID NO: 146571 - DNA, 248 bp, Homo sapiens
aactgcacaccccacttatgcataatcatcagatataaagagggtacattcctgtaatttattgttgctctagtgatcttaaagaattaagtccacattcataaagtccaaacttgtctccaaggatttgctttgactttgggagtatctggatcattaagtaatttccggaggtcagagtaaaagctttttatctctaaatattacttccctggaaaattagatgtagcagaagtcagtaacggagt

SEQ ID NO: 146572 - DNA, 226 bp, Homo sapiens
ttagctattcaaatagctcatgtctgtttctctaggaatattcaatttaggctattgttttaggtggcttcaactgtctagataattcatgtttttatgcaggcagcttataggtattcatttccacaaaagtttttactggtctcttcatattttacagttgctttagtcttagtcaataactgtggtctatatagcagcttattatgggttattgtagtaactc

SEQ ID NO: 146573 - DNA, 481 bp, Homo sapiens
gtgtggagacgcctgcacaatttcagcccaagcttctagagagtggtgatgacttgcatatgagggcagcaatgcaagtcggtgtgctccccattctgtgggacatgacctggttgcttcacagctccgagatgacacagacttgcttaaaggaagtgactattgtgacttgggcatcacttgactgatggtaatcagttgtctaaagaagtgcacagattacatgtccgtgtgctcattgggtctatctggccgcgttgaacaccaccaggctttgtattcagaaacaggagggaggtcctgcactttcccaggaggggtggccctttcagatgcaatcgagattgttaggctctgggagagtagttgcctggttgtggcagttggtaaatttctattcaaacagttgccatgcaccagttgttcacaacaagggtacgtaatctgtctggcattacttctacttttgtacaaaggatca

SEQ ID NO: 146574 - DNA, 456 bp, Homo sapiens
gctgtcccctgcacaggagcagaagggcatggcctgagggtcagggtgcctcagctggcttcctgcactgccgcacaccttgtcctgtgccccccgccccccgcgtgctaggacctcaccgtcctaacatgcccagaactctggctactgctggagctgggcctccttcctggagagcctatcccctgggtcacctgatgaatgtttcaccctgttccagaagctttccaaatctctcgccagaatgcctctccagcccttggctcctgttgcacaatctgcatccttctgtgcccacgcctggtgcaggcctcttctcaggctctgggaggctggcctctgtgaacgctgggctgagccagcttctgacccaggaggggcccagggctgcaacattctcaccctgctccaggtttgagaaggtatttccatgggaagcttgtgtcaaatgcgtac

SEQ ID NO: 146575 - DNA, 308 bp, Homo sapiens
ggtcagttgtggggaatgggcagtggagaggatcttcttgggctctgagttactctagtcccctgctccatcccagggatcagcatctttcagaacttcagagtggagagactctggtctctgaatgtccactactacgttctcacaaagtggttgaccaacatatgcttgaatgcctcccacctctcattgaggcccattctacctttggtagaataattagctttaattattagaaagtccttcctcataaaggatctacatccactctctggtctttggtctttgctctcaagatatgcagaatc

SEQ ID NO: 146576 - DNA, 431 bp, Homo sapiens
cagtacggaaggttgagcttgacagcgtgccatgcacacggtgcttactcctgaagcgtgcctgcctggccccattgctctttcctgcatccaatccctgaccgctgagaacacagaggagccactgagctccttcggtaggtgctagggaatggttcagaactggaccattttactcttaaatgcctcttaggaagcatttttataactgcagatagacttggatatataaagcattattaaaagggaacttgaccttcagtgagattgcagcggtgctgaagctaatacaaaccagagcacagcgatacccttgggccgaggtcaggaacgttccttcttttgacagttactgatttgcccaactgtaatttactcacttcaagtcttttccatcttgagtatatcattaaaccatttccgaagctcag

SEQ ID NO: 146577 - DNA, 333 bp, Homo sapiens
ctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaacca

SEQ ID NO: 146578 - DNA, 232 bp, Homo sapiens
agttcacctacaggctgtctaattcctttaacctgggctggactgaagggctgagaagaacattctcattagggtatgaaatggatcatttccagtggccagatggttccccataaatacattaatgactttataggcatgtctgcttggaaaaggaacaatttaactaccacaacgtaggaagtgctccttttggattctgggtaaactaaatcaaagaccaagaaattac

SEQ ID NO: 146579 - DNA, 390 bp, Homo sapiens
gtgtatacaatcaatccctcctttgagctcccacgtgtgacttgtactcattttgtacaagctttatacaacagtggctttgtaaatgaatcttaagattgtagggcaaggccaggcacgatggcttactcctgtaatcctagcaccttggtaggctgaagcaggaggattgcttgaagccaggagttcgagaccagcctcagtaacatgatgaaactccatttctactaaaaaatacaaaaattagccaggtgtggttgcatacacctgtggtcccagctactctggaggctgaggtgagaggatcactttagcctgagagacggaggttgcagtgaactgagatcacagcactgcactgcagcctgggtgacagtgagaccctgtatc

SEQ ID NO: 146580 - DNA, 234 bp, Homo sapiens
cgagatcaggaaagcgtctgttgggacagcggtggccgcgtggtgcctgcgtggtgctctaggcagctgcctagcctctgaccctctaagtttgctgaggcctggtcccaggccccaaggatatgggcactcagaaccctcttcacaagtctggcctgtcctgtctcaggacaactttgcccagctggggactcttggctctgtaaccaccaccttgaccctttgcactctgaa

SEQ ID NO: 146581 - DNA, 99 bp, Homo sapiens
catggttgtgcaagtctgtgagtcagtgtgtgacatttatttccattcaggttatgaggatgaaagaggagaatatgtagatgggcttaggccaggcga

SEQ ID NO: 146582 - DNA, 196 bp, Homo sapiens
gatcctcccgcctcagcctcccaaagtgctgggattatagatgtgagacactgtgctcagggtaatatgtttagcctttatgaagtcttggaaactagattatggtggatatttggctttgccattagaagtagtttaggtatatcataaattttgtaatagctttatattaggaaaggatgtatggtggattaaa

SEQ ID NO: 146583 - DNA, 755 bp, Homo sapiens
ccagagatactaagaaaaatgttatatagcttgaattaataatagcttgaagtctacttaattttgtattcatttcctggtcataatatgagatctctgagtaaatgtccgagtttggaaagaatgaatagaaaagtcctcattagttaataaataatactaggcggctcacacacaaggtttgccatggggactagtgaaatatgtgaaagcatgtagtcctcagagactaattccacaataacaacatcccgcttccagactctgagttgagtgcccagatttagacaagctcgacagtgctctaatagaaatgaaatcatttgattggcgtcattgaaaagaatagtggtttctcctctcttccattaagtttaaagagaacaggaaaaattccctattttcatattcagcttcttccttcattcatttagttctataaatttgcatcagcatatttttctataatactatcaacccatgttaaagtaattgaagaattggggcaatgttttggctgaaacaggtaaatatgaagaagtgatttggttcataatcttacttccaattaagttctctccaaaagagggcagaataatcactgtggccaaaagcaacttagttaagaatgcattatattatttaaaaaaccgttaagtcctttccttgtatacagaaagacttatttagtaataatatgctgggaggagtctacattgacagtgtctaagtctcattttcattcagtcataaat

SEQ ID NO: 146584 - DNA, 576 bp, Homo sapiens
ctccacacttcgatcgcggagaaagccctgcaataattaacaacattttcgtttccaaaaccttatttaagtgactgtcataaaaccgtatgaaccactataaatgtgttcctgggctttctcccgttcccttaacagatttaacagatttcatttgtgctctttcaattgtatcatgctgcttagattaatgactcattttagcaatttatattaaaattttgttttaggcattaattgtggcaactatatttccatgattcataggtcagcatggtcgttgcagctcatgggtctacctgtggttacctaggggctgcccttgaatgtgtgagggcccacgcctcacttcatcctttatgaaacaattcacttgttcaccttagccagtttgtaagaatttggccaaatatggtgccaagataatagtaaaaaaaatcagaaagtttcaaaattccattgttaaagatggtcacactggtgactacactccttgatttgccttggttccaagaagggctaaaagggagggattatttttcgaggaatactatttccaaccattcggttctccat

SEQ ID NO: 146585 - DNA, 421 bp, Homo sapiens
aaccaacttgtacttggggagatgtctgagggacagcccaggcaggcagctcagagtggtagaaaaccactacagggggtattaaaaatgtacagaaacacttcagtgcatctctgaagcagcttcagaattcagcaaaaatcatgtgaaggaaactgcccagatctcaggtctccagctttgtcgctctagaccaccccaggtgactgctcctgtctttgctggtttgtcttttctcctgcagacttctgtatgaatcaagccccagccctcttgtagtttctccattaactgaattatttgtctttttaaaatattgatttatacacaatagcaaagaagtaaaaacaacctaagtgtttattcatggataaatgaataaatgtgatacagtggattattactcagacatctccagtaa

SEQ ID NO: 146586 - DNA, 245 bp, Homo sapiens
cctgattccgtaaggaaaatgtctgcagagaataataaatatgagtaaggctatgtagctaattataggttacattctctctgactcgtctcagcaaacttacaaagaccaataagaacttgaggagtattattccttgtctgtctttgtccttccccttacaattctactttgactctgttactttcatatacagttgacccttgaacaacatgggcttgaactgcgtgggtccacttataggt

SEQ ID NO: 146587 - DNA, 496 bp, Homo sapiens
ccttacccctttctgtaactcacttggcaagctctctgctgtctggcctgtgcttgctgtgctggggccacagataagaatctgacacggcctgagaagcaaggacacaaggcattacaaaaaagtgggaagatgccgtgggaatacaaaagtgggagcattatgggggcagggggcagtgctggccatgacattggagttcggctctgaaggatcaacaggggtcctcaggcagataaagaaggacatttcaggcagaaggagcaggctgtgtgagggctggagcaggaaggaatatagcaagtggagaagctccgaggtgcccaacatgagaacatggggcgaaggcttgggagcacctggagttggggccaggtcatggagggctttgactgtcaggccaaagggcttggcctttgtctggcaaacagaggagggtcattcagaagactgaaggggtctgagcagggcaaggaacagatgagtgaggaaggat

SEQ ID NO: 146588 - DNA, 338 bp, Homo sapiens
tttttgcggttttacaaaatatctgccaacaatgttggcctcccagactttcaatcattaaaaaaaatgatgtgggcttggcaaggttactgcccttttaatgaaaccattgcagtgatggccaaacatagcctgggtttttcagtccttgaatacggaggtttgtgtgtgaactcctaagagaactctttctctggtcaccatcttcagcagtacttcactccatctctcttttgggaaccagaaggaaccaaaggcctgtaggcttcaccaacctctcagagagtttccaggatctccttgaactttctagacctgtgctgtctaacatggtagcc

SEQ ID NO: 146589 - DNA, 330 bp, Homo sapiens
aaactcaaacatattgcaagataattccactcctgtcttaattacctggagtcaacaaaagcattctgttatagacattcactataaaaaactgacagacataaactcccagattcatttaaagtaatttcatagtataagaagctttataggaatcataacccactaaaacacactgtatctcacctagcatggggacattcaaaagcccgaggacctcaatcaaaagccttttaaagatttcaaagctctagccaccaacatgtcattctcaggaacactaggagaaacccagtagttaaagtggatttttcaaacaatggacatagt

SEQ ID NO: 146590 - DNA, 354 bp, Homo sapiens
agagaggatgacagctctcaggaagaagagaccacagaacacctacaatggggcggtgcaaaggatgagaatctggaggaggaggatgagaagaaacaggatgacctgcaattgctcttctgcttgtatttactagcttggttagcgggtacccgtatcttctcagtcacttacatgatgaatctgggcgttaccctagattcattcatctgcctttcccgtgtcatccagctggtctcctggcattatctatcctgtccttattcatttctgaacacctcccttccttgcctcattgcctgtcttactccagtccccatcatcttcctgatcaaccacagagcaacagactcc

SEQ ID NO: 146591 - DNA, 317 bp, Homo sapiens
tgtaagttggcaaagaccaaaatagtgccaacatatgaagcactgaaaaagaaaaagttaaaatatcttagcctcaacactcgaaatatagcaagcccacatatttgaagaccaaacacatcaagactcatctttcccttaaaagaattttcagctgggcacagtggctcgtgcctgtaatcccagcactttgggaggctgaggcgggtggattactttagaccaggagtttgggaccagcctggccaaaatgtgaaacccccgtctctactaaaaatgtcgacgcggccgcgaatttagtagtagtaggcggccgc

SEQ ID NO: 146592 - DNA, 253 bp, Homo sapiens
tttaaaatattaggactagtatccttcatgtaaaggcatttttgagctttttaaaaatattttttattctcgatgggcaaccccaacaccagacattttgactaaacatcatataagtgtttcaggaacagacaaaatacattagctgatacacatcgcgtgtgttagaaatggcatactccgaagtgcattgagcactggaaagttcatgctgcttagaggcgtgtcgttgtgtcagtaccggggaattttt

SEQ ID NO: 146593 - DNA, 257 bp, Homo sapiens
aaagaaataaaatcaactgttaagcttcttttttctaactaccaaagtgggagatccagaccttgaaaagaataattttttcctgtggcaagattttacaaaaccagagtggaatctcataagaacaaagtgacaggttaaaataaaaagagattacttttttaaaaaaattagctcaatcagcatttttaaaataaaggtactgtgtgatatttgacttctaattaattttagctatctttatgtgtgaaagaaga

SEQ ID NO: 146594 - DNA, 382 bp, Homo sapiens
attagggtgggccctaacccaaggactgctgtccttataagaggaaactcggacacacacagagacatgagagttgtgagtgcacagaggaaagaccatgtgaggaggcggagaaggcggccaactgcaagccagcgagacagggcttaggaggacccgaacctgcggacaccctgaacttggccctccagtctgcagaactctgggaaaagaaacgtctgttgctgaaggtgcccggtctgtggtgttttgttatagcagccctggcaaatgaatacatcatgtttctgatgaaagtcaatcaatttcatggaaacagtgaattgagacaggcagctggcgtcaccctggctggtccccagggcaggctgggctgagccca

SEQ ID NO: 146595 - DNA, 488 bp, Homo sapiens
aggacggagggtgtcctggggctgctgacagtacagagaagaggaggtatgcattctggcctttctgacctccacccggtgcctgccccaaccacgctgctgcaggcttgggagccagggctttgcggggcctcagggaaggaagaagccagttcccgggccaggaacaggaaggcagggggagcgcagcagaggccaggatgacagtgcttcctgctgcgggaagggaaggacagcagagacagacaacagccaggcaggaaggatgcgccttcttcagggctgcaggtgggggctgggcagtcacagagcctctggacgtggcaggctgcaggcctgaatctgcccagggagcccatcctataaaacaggaagcatcttttccagtggaacaacagggtctgacaagagtctctgaggtttcagaggtctgttgagccatccatccatctactttccatccatccaaccatctaaccatccaccca

SEQ ID NO: 146596 - DNA, 450 bp, Homo sapiens
cttccaaagtgctgggattataggcacaagccactgggccaggcctcaaatgttctttctgcatcatttgatatgaccatatgatttttcttctttagtctgttaagtatgatggattacactgactaattttcaaatattgaaccagctttctatccctgaaataaatctcacttggtcatggcatataattcttttcatatatattactgagttctatgtgctgatattttcttgagtaattttgtgtctatattcatgaaagatattggcctgtagttttcttttttgttgttgtctttggttttagtatcaaggtaatacaagctcttcataaaatgaattgggaagtgcttctcctattctgttttctggaaaagattgtgtataattggtattaattattctgtaaacatttgatagaattcctgagtgaaactatctggttct

SEQ ID NO: 146597 - DNA, 195 bp, Homo sapiens
gcttgtcagagagtaggcatccaaaaatgttagttatctcccctttgctttattcacatcacctttaagaagtccaagtccatgggcctactctttaagttagtcctagatattggtgtaagtttcaggggtattgcccctaagcccatcactgatgctctgacatgttctccaatcttctgggaattcctggtg

SEQ ID NO: 146598 - DNA, 268 bp, Homo sapiens
tgctcctgaagcgtggtaaccctgaacatatgttcatatgacccacattgaacctaagacccacaattaagcttagcagctggaagaaaaggtctttaatatgcaacagagacatctgcctgcattctaaataattacatttccacccatccccccatcaacattctaatagcttagatgcttagatttcttaagaaaacaagttctagaaagtcattttaatatagaagactaactgaagaggtttggggagcagcagggaaagaca

SEQ ID NO: 146599 - DNA, 290 bp, Homo sapiens
aaaatcaaattggctgcgacctctacagaacccaggaatttggaattcactgaatccagggttgctgcgctggaggcaaagctgggctgctattgggttggctggccctaagggaaaactcttctgacttttgaactcagcaggtacatttctattcttcctttcttcttcttaagcaacacttttcccgagaaaaacaaacaaaactttgctaaccaaaagctttgtgttgaaactgccaggaggagatgataagccaagcattgccttggctcctcaggacttttgca

SEQ ID NO: 146600 - DNA, 438 bp, Homo sapiens
tcccacccagcagggacaaaatcagaccaccgccatcccatccagcagggacaagatcagaccaccaccatctcacccaagagggaccactgccatcccacccagcagggatgagatcggaccattgccatctcacccaactttctgcagggagcgaagggtcagatccagaaacccgggaaggggaagtggagaggtcctagagcacgccctatttcatcttatctcattgtctgaggcacactagagcaactgatgcatatcctccccaaggccgggctctccaaaacgaaaagaaaaaaaacactgatttctagagggccaaaaaagagacctattttatttgataatataggaaagattcttgcagccagcctactcccattaagtcagagaaactcaccagggctgaaagctaaatgctgagccaacaaaact

SEQ ID NO: 146601 - DNA, 352 bp, Homo sapiens
ctctgggatcagtttcactgatccttcaaccagcttatgtgccctgttagcccagatacccctccagagtgcttcgcactgggctgcaggtcactgtggccccacagtcttcgcctgatatcaggcgaagactgtggggttgctatgctctgtgtccatgacctgaggattattgtgaccctcaggccggggttcagaggaggccgaagagttgttggggttctcctggcccccaattatcaccattacaggagggtcagtagaacatgcgttctggtgggcgaggaattcagttgggtcagtgaattgtgcgcagcactttgccacagtcttcgcctgatgggtaccgagc

SEQ ID NO: 146602 - DNA, 434 bp, Homo sapiens
aagactttttcagccacagtcttctctaccagctgatctgtgtggtgttagacatttcagtacttactgagagggagttttctgtgccccaccttcagctgggttaatccccaaagaaccagtgtttcctagaaagagcagttcattccataccttgctcttgtagtcctaatggccatgtcgacatacccagctgtgacaagatgaaggaccacgatttgggactcttcagggacagacttggccacctggtgatgtgccaccttcagcagctctgtcttcacacgtccagcctgcgcctgcttcatgtagtacacaagactgctctggtacaccacgaccatgaccttcacatgaggccagtctccccgcccctcacctgggccatagaaaaaggtaagagcctgagaagcagctcctggcctctcctccca

SEQ ID NO: 146603 - DNA, 606 bp, Homo sapiens
cttgctgcccatcttcccatttatttcttcactttaagcatttcagtttgttcaatgattaaacattcctggattcatctgtatgtaatggcttctgccatgtcctcttcacctatcttttttttttttcaaagatggagtcttactctctcacttaggctagagtgcagttccgcaatcataaagcccactgcagcttcaaactcctgcgttcaagtgaatctcccacctagtatgtgtgattataggcatgagccactgtgcctggcatttctgtaaggcctaaataatgtctcatcaatcctttcctactccccagctccggtgatggtcctcttctctcaattcctgtagcacataccatcattgacacttagcatacgctacttttcacacattactgtactccttttgtaaaaaattaggccctcttcctcagttcagtcgaaaaagctgattctaaacaatgacaatataacatatgaagagattagtaaaagtctttagcagctataaagggctcaaataactcagcctagttatttctttttatgcatacatcttgtctcacatctagactgtagacacttcatcttataccaactt

SEQ ID NO: 146604 - DNA, 230 bp, Homo sapiens
ctctcttcttcatcctgggtaatatcctccaatctgcttttcttctaattcactagttctctcttcagctgtactagtttattgtttaatccatctattgattgttttatttctaatatttttatttcattctttttcaaattttcctattcttgtcttccatttgattctattatgtctagttcttggagaacaacatcttaccattagtgtttttgctgattctctct

SEQ ID NO: 146605 - DNA, 501 bp, Homo sapiens
ccacccactgtgactatagatttgtctaattctcttttccattctatcagattttaatttatgtgttttgaagctcttttattaggtatgtaagagttaaaattcttatttcctcatgatgagttaatgagattgccaacatgaaatgtcctccattattcctggtaatatttgttgatcttgaattatatttcatggaactaatatagccccctccagcattctttggattaatgttggcatataattaggtattccttttttatccaatctgataatatctaccttttgtgatgtttagaccattttcagaaatataaataaggttggattaaaatcttacctgcttcatagttgatctcatgaactttgttctttccttttcttactatttttggagtcattaagttctgtctttttaaaattattcctggccgggcgtggtggctcacgcctgtaatcccagcactttgagaggccgaggggggcagatcacgaggt

SEQ ID NO: 146606 - DNA, 768 bp, Homo sapiens
gtctcgctctgttgcccaggctggagtgcagtggcgcgatctcggctcactgcaagctctgcctcccaggttcacaccattctcctgcctcagcctgccgagtagctgggactacaggcacctgccaccacactcggcaaattttttgtatttttagtagaaacggggtttcaccatgttagccaggatggtcttatctcctgacctcgtgatccgcctgcctcggcctcccaaagtgctgggattacaggcgtgagccaccacgcctggccagttcccccattttcttcagctacatgattttctttgtagaagaaagagccagtggttgagcaaggaaggatgccgtgggcagctcagggggagagatgacctgttagttcctccctttctctgcattgcccaagagcaacagccaaatagcggttcggcccttattttgtactgggcaccgtgtgaaacagcctgcctgcggatttcactcagtcttcaccatacctcgcagggtagagactgagactcagagatgtggcagcttgcccagggccatgcagcctgttcggtatctctgattctaaaacctgagcttttaagttttagctcactacttctccaaatgtcatgagacctttgaccttgaacctggggaggtggaaagccagcctgatggaggctgactcactggctaagacctgtgagttgtgcagggctggctgttcaagtctttgcgcttcaggttctggagatgacaaaacagaagggctcatt

SEQ ID NO: 146607 - DNA, 436 bp, Homo sapiens
attcattcatattcagacacaaatttttattccataatatcatcttgacagaaagtatcagatttcatttgtaataagcggttgattaaaaaataataaattgtaatacacaagtgcaaaccagttaagaataaagaataaaaaagtaacttctggccgggcgcggtggctcacgcctgtaatcccagcactttgggaggccgaggcgggcggatcacgaggtcaggagatccagaccatcctggagaacacggtgaaacccggtctctactgaaaatacaaaaaaattaggcgggcgtggtggcaggcgcgtgtagtcccagctactcgggaggctgaggcaggagaatggcgtgaacccgggaggcggagcttgcagtgagccgagatcgcaccactgcactccagcctgggtgacagagcgagactctgtctc

SEQ ID NO: 146608 - DNA, 331 bp, Homo sapiens
cattcaccagcccacccttacttcttgctctgtctcccttgctgctgttgccagggaagaggctgtactggtcagccatggagcctgatatctgaggatgaggcttgggcatctgactgagcctctgcctgggtgaggggtctgttttaaacactgaatatacctcatgagacccactcacagggccctgctcagccctggcactcataaaaatatgaaagagtcaagaatgctttaagaacttttttcttccctgagatggggtctcactctcacccaggctggagtgccacctggtacgatcttggctgactgcaacctccgcctccca

SEQ ID NO: 146609 - DNA, 422 bp, Homo sapiens
taccaatttaccctactcagtatgattaaatttttttaaatggtgatgacatcaactctgaaaggcatatggagcaattaaaacacttaaactgctagtaggctgtaaattggtaaaaaatgtttttaaaagcaatttagaaatacctgttgtggttgaagacaaaagtaaccaataccccaatatttccacctgttgcagcattatatgtaatagggaaaaattgaaagtaatatacccatttggaatacatatagtcactatactgaagtgagaataaattaaccagagctgtacaaataaaatagtaaacctatgttcttgtactttgttgcctttcttttgatgtttaacaataggcaaatcaatgctgtatgttgtttaaataattgtgaatatgaaataaaaactataccaaaaat

SEQ ID NO: 146610 - DNA, 352 bp, Homo sapiens
aacaaagatacaaatgagtactttacagaagaagaaacatgattgtctaataaatgtactaaaaatgctcagtaaatatacttaatatgctcattagtaatcaagaaaatgaaaatgagaaccacaatgagacaataccatttcaaactcgatgaaatgaaaaatacaaataattctaacaatacccttatcatcctttcatgcaggaatttgggtcttgacataaaataaagcacaaagtccagatttgctgcttatcggcagtgtaatcttcgacaagtcatttaaactctagcttcagtttgctcacctaccaaatgcaaaacataatttctctgcagagttatgagaa

SEQ ID NO: 146611 - DNA, 294 bp, Homo sapiens
gttgttatgaggcatcacatgatgagatactgctggggagggaagaagtgaggagattcctaggaatcttatgagaatttccagagacaacaagttttgagcttttttttaatttagaaaatttaccttatttttaaaagaatatgtaacatatcccatgctataaaattctagacatagtagatttaaaacagcataatggaaaatataaatatctattttcttttcctatttatgtattctgtgccagtaggaatgtagccaaaaagagagaaaaggggtctctgcagacat

SEQ ID NO: 146612 - DNA, 258 bp, Homo sapiens
cattcagcttcagtgtgctaccttttctggcatctttctgggacaaattcgtatttgttctatgctggtgagcaagggctctttatacagagctgctgagtgtagcgacctaaatttttttgctcaaacaaggctgttttaataagaaataaattatataaagtcacgtgatccatttagtaaaatattgggctgtgaaccaggagactggtatttagtcacactgattaggtcttacccaataacctttgatcagtt

SEQ ID NO: 146613 - DNA, 199 bp, Homo sapiens
gacgagaggacacggcacatgggacacagcgcatggagggggcagcagagggctggacgagaggacacggcacgctggacgcagcacgtggagggggcagcagagggctggacaagaggacacagcacagaggacgcagcgcgtggagggggcagcagagggctggacgaggggacgtggcatgccggacgcagcacgt

SEQ ID NO: 146614 - DNA, 208 bp, Homo sapiens
catgactggagccaccaagagctggaagaggcgggaaagatcctcccctagagcttccagggggagctcagcccagccctcaccttgatctcagattccttgtttccagtactggaaaagaataaacacctgttactttaagccaccccaattatggttatttgctacagcatccataggaatttaaaacctaagaggtatgaattct

SEQ ID NO: 146615 - DNA, 778 bp, Homo sapiens
gtgcatgtttttgtttgtttgtttgttttgagacagagtctcgccctgttgcctaggctggagtgcagtggcatgatctcggctcactgcaacctctgcctcccaggttcaagcaattcccgtgcctcagcctcccaagcagctgtgattacaggcacatgccaccatgcctggctaatttttgtatttttttagtagagaccaggtttcgctatgttgaccaggctggtcttgaactcctgacctcaagtgatcgacctgccttggtctctcaaagtgctgggattacaggcgtgagccaccgtgcccggccacatgttttatgtatataaaacatatgtacaaaaatacaaatatgtattttcccctaaccattagaccaccagggagcatgttagatattttgaatacctggtaaaatatatttatttggatcacacctaatcaagtttgaaaaatgctggtacaggggaaagagctctgggtccagacaaaggatagacacatggattctgtccagggctgtgcctctgtgaatgctcacctgctgtgggacagtgcccaactccccagggccctagtttcttcttctaaaaaatgggaatgctcatttctgccctgcctacttcttagctgtatcataaggagagaatgtctctatctcgtgttagatactggggaggcagcagagtatgacgggatggatgtgggtttgggaacctgaaaggcctggattcaattctagattttgtccctactagctgtgtgagtttgggca

SEQ ID NO: 146616 - DNA, 660 bp, Homo sapiens
aactcctgacctcaggtgatccacccgccacagcctcccaaagtgctgggattactttagtgactagtcttaccttagtctgaatgctggatagagtgttagaactagacttagagtaattggcttttttttaattgagtaacaagagactggatacaagatcatccattagggagaaaatgttagaacttccatctctattcagtatttcctatcttcccttcacatttctattaatattttcatttttgcaattaaatgtttaacagctgaaacagctaaaaatcttcatgtagtgtattattttagtagtatgtgtatatgccttataaagaaatacccatttttggggggggtgcatattcaaactcttttgttgataagggtatgcaattgaaagggtttgatactcaaagtgtggtccagcagcattggcattcaccttgggaactcattaaagattcagtatctcagaccccacctattgaatcaaaacctgcatttctacaatattcccaggggaattcaatgcagccaaaagcttaaggaggactggcctggaggacagaacagtagctgtcttgtaccatggttctaccatctactgctctgtgacctaagagaggctcttttgagtcttagagtcatctgtaaaatctg

SEQ ID NO: 146617 - DNA, 372 bp, Homo sapiens
ccccattcaaaccacgccaggcctgcctgtttacacgatgagcgcaccacgtccttccctttacagcacacacagagtggcaacctgacacgcactagtttgattgtttccttcctttctgccctccctactgctctgcatctgaattttctgctgctcaccattatatcctagagaccaagacctggtgtgtaggaggtacccaacagcgctctgtgacccaatgaatgcacaaggatctccgtgtaagttcatgctattattggctgctgacaatgctggcacaaacttagcttgcaataagagaaccctagcgacagagttaatacagttgatcattgtaaacttaattcaggtgttttaaaaccaggt

SEQ ID NO: 146618 - DNA, 202 bp, Homo sapiens
agccggtccactagatcacggttggctcctcatcgctcaggtctcagcttaaatgtcacctcctccaggaggcccttcctgactgcctcccccacttattctataacaacgatgttaccccacataacacgactaagtgttcaactaatgtgccaggacctcttccgagcccaatacatacgttatctaacctagtcctgaa

SEQ ID NO: 146619 - DNA, 885 bp, Homo sapiens
  misc_feature (506)..(506): n is a, c, g, or t
  misc_feature (533)..(533): n is a, c, g, or t
gcagacattttgctgccctaatgttttctataagcgtaagctctaaaatacttccgacttgaattaagcagtttggtgtttgtttgctcctttgcttacttatgtctaagtatgatttggatagatcccagtttaactctgcccctttttaacacttaaaattgccgagtccttgatttataatatcttctccgaagttaaggcccagaagatccagatgttcagggtgtgcaaatcatccaaaacttgggtttgatgtataaagggaggcaatataataagtctttttccccccgattctaaaaatcccttcttttactcaagtattgtagtgaaatatttggcatattctccccctcttctcaggaaagataagagtcagtagggatgttttcctgaaaatcttttaatcaaggcctttgacctcttgcctcctctctcttcctgatttaccccatataatgactttttattagagacattatgttctaataccttaaagcagnaagggacctatttagacttttcctttntagaccgtaaataaactttataagcagggtgattttttttatagcctaagtgaaagaaaacttattgcctgggtttctgaaaagtgggtgtctttattacatgaaaccatgtgactagtttctgttgaaagggatacgtagcttgcttaggttgtcatcttgagaatctagtcaagtttagattttagaaaatgttttccagtgaagtttttaagggtctcaggtttatttttctttatgtattagttttaagatggggctttacatttttagtaacataatggttctcttcttaaaatatgtaggttaacttgtattacattgatcacaattcgcatagatacaaaaacac

SEQ ID NO: 146620 - DNA, 619 bp, Homo sapiens
tctgggaagggtttccaaaggagctgtctgacaagaatattgaaagatgccatcctttaaatccattttaacaaaagtaagctagataaagaagacagaacagttctatcttggagaggaagctcctgagagactggtgtcttagagagcaggggtagaaaagtgtttcaggaagacaaaaaaacaaatatgaagacacaaaggcaagaaaaagcagaggtgccctcttcaaagaactctaggaagttcaataagaccggaagatagtgtgaatgagaagagcagagtggcgtaagaatgcagagggaggttgggaccagggcatagaaggtctcacatttgctatgaggaagcagcacaattcagtggctggaagcacaggtgaggaaagaagactccccaggttcaaatcccaggtctattcttactacttagatggctataggcaagttagttaacgtcgagatgtcccagtctcctcatgtgtaaaaatgaggcttacataaattcgtatctcatttgagaatgaagtgaaataatacatataaaatgctggctgggcacagtggctcacacctgtaatcccagcactttgggaggctaaggcaggtagaccacc

SEQ ID NO: 146621 - DNA, 361 bp, Homo sapiens
agacagtggaggacagtgcttacagtttgataatgtttgcttactgagcatgaaatgaaatttaactgtggcatgtctgcatttgtaaatttattgtggttgtttagacttcttgcaaaatgaaatgtcaggcagtcattctgagactgcaaatatattaggcttcaaagggctcagataactgaggttattgagttttcaaagatttttttctactttttttctaccatatagaatatgttcattcaataagtgtagaatgagcataaaagagcaaaagcataaaaataatttctgaatggtaaaatgctaagtgtgccgttctgactattataaggatttcaaaaaatggtcattggat

SEQ ID NO: 146622 - DNA, 207 bp, Homo sapiens
aggacaactcctggggattttagatggattttgattcctctggattagagctgagctagagagagtgggttactattatggtgatctgaccatatctccaggctggtatgtttcataaattgcttttgatagaaattccagggcaagaatttaaaattttttttgagcaaaggaataactgtatagccttctgaggtgactatttgg

SEQ ID NO: 146623 - DNA, 411 bp, Homo sapiens
tctgaaagaatttggaggctaggagaagcaggagttggatggataacttaggcactaaagggaagctagtttaatattttaaagtcacccagaagataaaacaagtagttgcaagaaagacacttgagaaaaacaaaacaaaacaaaacaaaacaacactgactaggtaattattcaacagttctgacagaagtagttctgaggaaacatcagtagatggtgaaaaaacttagggcctcagagaaatgttagcactgatgtctaagagatggaattatgctcagcacataattggaatggtcactctgatggttttggcttcaaaatgagattcttcttttttttttgttttttttttggggggggatttcacctttgcgcttgtttaaaggggcccaatcggcgggaggg

SEQ ID NO: 146624 - DNA, 1562 bp, Homo sapiens
gtttatcttccaggctccctgtctttgggtcttgatcaccacagaggggaaggggagaatccagagataaaatgtgagactgaaactgttttaaagaagcatacaagaaagaagcacacactttattagggagatgttgatgagatgcttacaacccgcccgccaccccccagccccagctaggccatctggcaggtaccgcccgtgcgccaggcatcgttttcaaattgcaagaccgaaatccaatcaaccgaaataatttcttaggaagataagcttgcaacacgtgcaataatgaaaaaatttaactagcattaaaaatattcaggaatgtcgagcaattaccacctggccgcagtcacaggacagaagacggaataaatgggcacgcaccaaaggtttatattaaagtgtaagtttcagcccctcagtatatttaagggaggctgctctgcagaggaaacctctgccttctcggcgagggagtttccgagctaccttaactggggcgcaacgcagccttccgccaccagaggcagcgggcgtctgcggcctgtcaaaaactggcgcttttttcctcccctttccgtggagagactatcaactccatctgtcacaaaaattaaggctaaatctcctctccagaagcagagggagccggggctccgacgcgctcagcgtcgggctgtctgcctctccctagaggccaagtgaatttgaaatggcaaaagtcacagccggaggcccagcactaggagattcctccggctgcgggaaatcttcctgtacctgctgaagctgctgcgttcctcagaggcgcttggtctgccgtgggaagctgcacctctgcagtccccaaaaccaaaatcaaaccttaaaagagccagactgagaagccagtcaccacgtaagacatctggaccaccttcagactcgcatgctgtgaggaagcccatgcttactatgtgtagaggatacatggagaaggaaagagatgcctggccagctccctgctgtttcagccatgtgagtgaagaaggcaccagacttgtgagtggagacactaacttggatgtccagcccagctgaaccttcaggtgactccagctctagctgccatcctactgaagacacatgagagagaccccaagccagggtcaagatcagcgtgaagcaagtgaggcattttggtgcaaaatgtaaggaggcattgaccttcataattgggctccaagactccaagagtgagtgcctccttaaattttgtactttagacactacactcacctttctctagttctggtcttgcctcaagcaagaagagcagagcttagctcagtcaacccaaagaatcctgagaaataacaaaaaaatattcttttaagccactcagttttgagatggtttgttatgcaacaatagagcattagaacttttcttcctgtccaattgcttaggtgaaagatgctagtatctgcctgaattctttccttttcttcacattctacattcaattaatggctcatcataggtgtcaataaaatatttgataagttgaatga

SEQ ID NO: 146625 - DNA, 343 bp, Homo sapiens
gcttttttcctcccctttccgtggagagactatcaactccatctgtcacaaaaattaaggctaaatctcctctccagaagcagagggagccggggctccgacgcgctcagcgtcgggctgtctgcctctccctagaggccaagtgaatttgaaatggcaaaagtcacagccggaggcccagcactaggagattcctccggctgcgggaaatcttcctgtacctgctgaagctgctgcgttcctcagaggcgcttggtctgccgtgggaagctgcacctctgcagtccccaaaaccaaaatcaaaccttaaaagagccagactgaggtaaggcggaccgtcttg

SEQ ID NO: 146626 - DNA, 229 bp, Homo sapiens
tgaggcagatggaggagaaggaacaatcagttaaatagtgacacaggctccctgaactgaggatagattatcaggtcaaagcagctcgccgcatttgaggtaaaattaatgagtattagctcatagttgacactgttgaatttcaaattttaagaagaaaaaaagtctcatatccatcctgaggaaagtatgttatcaacacaagaagaaaaatcatgtaggcatctga

SEQ ID NO: 146627 - DNA, 197 bp, Homo sapiens
ttttttccaccatgaagatttagtccatatttagacaagcactagcaaaagtcccaaccattttggagataatgtcaagaatgattaaaattcatacaaggccttgcatagccttactatgaaatattaagtaggttgcagttgggactcaatggtccagaacctctcaagggctcaagttttgcgtatcaagaacc

SEQ ID NO: 146628 - DNA, 374 bp, Homo sapiens
ggttacttcacctagttggtcagctgggttaaaaaattaagtgtctaaattacaaagccatcacagttacagtgaatacagattgtagtaatctgaaaataatttcattatactttcaccccaaattctaaatacaacctccgtagaataaaaagtgtattctgacactttcccaatgacatacaatgatctttaaaagctttataatgactcatcacagtattctaatttctaggtattacctttttttcaattaaaagctaatttgaggcagtatttcacaccactatttccatatttaatagctaaaactcctgtcggctacaacctagtctggccatatcccttcatgtaagtaagcactttcatcagga

SEQ ID NO: 146629 - DNA, 121 bp, Homo sapiens
acccacatctcgcacaggaatattcctggcaaccttgttcacaacagcaacagatagaaatagccccagtgtactctactgagtgctggtcgaacacactctggtaaaacccaaccgtggg

SEQ ID NO: 146630 - DNA, 401 bp, Homo sapiens
gctctgctcctccccctccccctctccccaactgtctttgatctgtgaagcttgtctcatccttagccaagtctgctggaactttatccagagcaggaaaaggggaaatagttttcctttcttgggtggatttgtatttatataaacccttagcgagcggcagtgtgtggagacggtggtcaacatgggctactcgtacgagtgtgtcctcagagccatgaagaagaaaggagagaatattgagcaggtgagcggttggtcagccaggagggcaggctcagacctgtggagctggagtagtgtcctcccctgtcctagagcccctcagacttgtagcaccaacctcctttcctgtgggtttgtgaggacacggggcatgttttggggaaagggatggatcg

SEQ ID NO: 146631 - DNA, 354 bp, Homo sapiens
ctcgctacaacactaagtccagagatcggacagagtcaacgtttcttcctttcttactacaaaggacagacttggtcagcaaggagaaataggatcagtgttaatatctggacaccagcaagaggccagacgacttgtggcttcatacaaaatgttttcatttaaaactttacttgtaaaatgtccttactgctgaaactaaaaccattaacaggttctactgcttaagacttagaaatcttcaaagatttccctaaatcaaatcaacttaagtattaatattaacatttctcccctaatgccttgagttttactgggataacagaacaactgatgccctaagtcagaagtcag

SEQ ID NO: 146632 - DNA, 267 bp, Homo sapiens
cagcttactagatcttagagatcaacttcatcatttacagcaaaacatgccaaggttcaccaaaaatgtataggcttgtctatggtcataagacttagtgatagaaaagggatagatcccagatttctctttttttcattgatttatctatgtaactttttatgtatttcattgatttatctatttcattttttctttactttcaagaaggtaatatattctcatggcccaaaattcaaaatttatatccacaaaaactgctttacc

SEQ ID NO: 146633 - DNA, 253 bp, Homo sapiens
tccatttagccagcggttcgctcggcttttaggagggggctggcggtgaacccatccccgttacaatgcactcagggaccctgacaactaatttaatttaaaacagccttgcaataaaagctcagaacggaaaaccgccggtcttgggggttatttaacaaattgcctcacagataaatacattaaaatgattctcaaaccggagccgggcgaagttgaagtaaaattaagaaagttgaatcaaaatgtaaat

SEQ ID NO: 146634 - DNA, 267 bp, Homo sapiens
gctgctagaggatcccagcggccgcctttttgttatagtaagcagttcatttactatctgatcacactgagcttgtataggctgggttttacaatttgcttgagtgaatcagtagaaaacctcaggtatctaagacagtgtaacttgtctccaaactctgtctccaccatgggtgctgtcagggcttgctccaaggctttgttaggtcttagaataagagcaagccttcttctaggtcatgattcttactcctaaggcctattcttt

SEQ ID NO: 146635 - DNA, 494 bp, Homo sapiens
atgcccagctaattttttttgtattttttagtagagacagggtttcaccatgttggccaggctggtctcgaactcctgagctcaagcaatcctccctccactgcctctgaaagtgctgggattacaggcatgagccactgtgcctggcctagccttctttttgaaaagaactgggcagcaccacgtgagctgatttaagggaaataaaaatggtttccgtttttataattgctaacatgagattttgaggataattggtgatttgtgtgcttgaaaactgtaatggcaacattcacaaaatcgttataagtttttaaagatatgtgtatgggcatatgctttctggaaaagagggcactgataaaagtagtttgagaatcatgaagagttaagttacctcattggagcaaaatacgaggtatagttagttttctcctctcctcccaaattccactgtgccctccaaaaaaggtggagcagattacaaaggacag

SEQ ID NO: 146636 - DNA, 197 bp, Homo sapiens
tgccatcctcggcctccttattgccagcagatgagcgctcccagccctaacatgctgcggccagttcccagggcctttcttcctccctactcagggatgatctttgctgcggcctttcctcactcttgatgcctctctccatctcagaaacatatccaggaactgcagcctgacccatctggttccccaccaggccc

SEQ ID NO: 146637 - DNA, 278 bp, Homo sapiens
acgcacacacacacacacacacacacagaaatgcaaccaaatatgaaaggtcatcaactatactcagtgctactggatctctccatgaaacctgactgcccaacagttactgaagggctatggaaacttgaagcttgaagaatttttctctttcaaatgtcagagtcatattaggatttaaattttaaactggtttattttaggttaatgtagcccagtcttttagagacgggaatcatccagaaacttccatttagcagaatgtgattaagccaccc

SEQ ID NO: 146638 - DNA, 364 bp, Homo sapiens
ggcagggcatgaggggccagatgacgtggggccggcctttaggccctcctctaacttcggctttgattccaagtgcagtaggcatagggcagcaacaggaggtgtggcagcagcctttgcttctgccttctaaagggtctttggggaaggttagagacgggacaataaaccagcgactaaggataacagagccacatggaaatacgacgagcagctgtaaaacacacacgtgttgagcactttctacacctaggcccttgctgtgtgttttacaagcatcaccacattcaatcctcataaccatcctaggaggtagattatgcagaagggaaatggaaacacacagagatgaagtcactttccc

SEQ ID NO: 146639 - DNA, 457 bp, Homo sapiens
gtctcaggatacagaggtcaattgaatatagcaaattttgtcagtgttgtaaaaaatctggagaggaatgtaaacggctcatcttgtgtctggcctctaattgaatcagtcagctatggtggggttaggggacagatccgtgtatttacttgcataggacaaaaattagtcatttgtgagtgttcacatacttccacctctcccaacccaccaaagagaattgtaatttgacagtacaataatcccttcccctactcttaaaaaagttgatcttacaaggtcagtcctatgtttttatgaaaaagaattagagaatgagtagaaaggaactagtcaagaaaagcagaagatttgggttgatagacataaagtgctgggaatgagaggaagagagagagatcgtgaaattcctgggctgggaataaagactgtgtgtaggtaggacagcctttggtga

SEQ ID NO: 146640 - DNA, 309 bp, Homo sapiens
ataggtgagggggtgtcatcactggaaaccagcagcctgggctggaaaccctctgtttaaactgttaattgcacaatgccagatttgcagacgtgctcccctgctgcattttgggattggtcatgaatgacagtgtacaaggagatcacccagagattacagtgccccagagaacagcagaccaggatgtttctcccagagaactttccagaagcctcggtgatagaaacacaactactctgtcgggtgatgacatctgtgtaaactcgtggttgctgttaacactattgcatgactcctgaccatagg

SEQ ID NO: 146641 - DNA, 411 bp, Homo sapiens
ccacagtgggctgtgctacaacataccacagggtgctcagccccaagaccacacctgcgcacttcacaccacacggaaagcagagatcatgattccaaaaatgcatattcttcaccaagcagacactcagccaaaggcgaccccaagcagataccatctatgaagtcacaggtcagactgctctgagccacgggacacacactggggttatacaggcaatctgtgatgtccacattgagaaatgacatctcactgtctacacatggtgaggtcacgatcacggcttaaacaaggacaaagtacaggactttggaattgtatctatatcatggtcccttgttaaggaggaaaagaggagagaacagaaggtagaaacaagagaatgagagagctctttgtaagcagccacac

SEQ ID NO: 146642 - DNA, 393 bp, Homo sapiens
caagttggatcgcggagaaagagggagagaaaagagagaccaaagttagaagtgaggaatcactgggcattcagtggtcagaactgactcccagaatgaaaaaatcggtaagggtgtggaaagggcccaaaacacatgatttctaacttcacagcaaccactattctgagtcttctacgaacattgttgcaaaaaaggggaagaacaagatacggagaagtaacctaacagaagggttcttgtcttcctaagaaagtaacagcagaaagaaaaaatagcacattgatagcaattattaccaatctcaaaaaagggcaggaactctccctacaattgatctgacagaaaagaaaatgccctcctaacaggcctccggcaggcacacttctccaa

SEQ ID NO: 146643 - DNA, 254 bp, Homo sapiens
tgcggtcgatctagagttccccactactggcctacagtgggcactcagctgtcaaatggacaatggaggcagggatggagcgaaagagcttggaggaaacggaggctatagcctcaggaacatgacacctgaccctgggaaggggagggagtcttgccttctaaaacccacagccctctcccttcctggctctcagcctctccatctagcagagacaacccagaggttcaccagcccaaggtgaaggagtgggt

SEQ ID NO: 146644 - DNA, 487 bp, Homo sapiens
agtagagatgaggtttcaccatgttgaccaggctggtcttgaactcttgatctcaggcgatccgcccacgttggcctcccaaagtgctgggattacaggcgtgttccactgtgtccgctcagaggaatttgtttctcctactcaattttgctgtgaacctaaaagtgctctttaaaaaaaaagtctactaaaattaaaaacaaacaaacaaaactatcttgtcagtgacttctgccagaaagatcgatctaagattgtgagtactagggtagggttcttctctaaataaaaataaaaaaaaaagaaagaaaagaagaaagagagagaaagaaagaaagagaaaagaaaacaaagaaagaaagaaagaaagaaagaaagaaagaaagaaagaaagaaagagaaaagaaagaaaaccaaaataagactgccaaagaaaacctaaggataaattcatatatttgattaaatcacagtcccttacctgtgg

SEQ ID NO: 146645 - DNA, 458 bp, Homo sapiens
agataataatgtatctgttttaagcagattggggcatttgtgggatttattatagagggcaggaaagactggtgggaggagataaaactttcttttgtcgtctttcacatttttctcattgcatacctttttttacctatacttatcccacttgcagcttttcaacacctttacttaagatttttttgttttgttttttgtagagcctgtgttgcccaggctggtctcaaactccaggcctcaatctatccttattccttggcctcccaaaacactgggattacaagtgtgagcctctgcacctggccttctacttttctgcgagcctcctgaagtttccacacataaaagaggtcttggaatactctgtagcacaatacaattctcatttttttttagatagaacctgtctctactaaaaatacaaaaattagtgccaggcgcggtggctcacgcct

SEQ ID NO: 146646 - DNA, 248 bp, Homo sapiens
gctttttgattaattttccagaggaggaaaaggagtataggtataattttaaactattaatatgatgactggcaaacttgaattatgtgactgtgggtctggcttggtataatatgatttacttttgtcattatctacttttgtatatacaagcaggcttttaattaattttagtttatttcaaatctgtgagcttttatgaattgagccagttcctagaggctacttttatggtacactggaaagtg

SEQ ID NO: 146647 - DNA, 847 bp, Homo sapiens
ggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatgaaaaagcac

SEQ ID NO: 146648 - DNA, 925 bp, Homo sapiens
gaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacgtgatcaagtcccggatgcagatggatggactgagacgcagagtgtaccaggggatgctggactgcatggtgagcagcatccggcaggaaggactgggagtcttcttccggggggtcaccatcaacagtgcccgcgccttt

SEQ ID NO: 146649 - DNA, 1404 bp, Homo sapiens
gaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctggtgagtcactcctgggagtggctcctccccaccctgccacgcagcggcaactgcgggctgggcctaccccctggtggccacgctccctccgcacccggcctctctctgtggcatgggggcggccatgccccttggtggagatgaatgggagtggagctgggctggctgggcaggcaggggcttgcctcttgctgactaaggcagccctggaggggcccgaccatggggcaggaacccagttgccatcctcagagcgaggatcattggccgggctcggggatcagggcctctgtggtcccggcacgcctggcccgtgagactgtactctgcacgactcctccaggtggccagggtcaccggaactggctcgctctcctctgccagttgccggaggtctgggcaccaggccaattctcaccttcccgccagggttaaacattagtgggaggttatcagcgtgggccaggggagggagaggggggaattcaactctgtctcctctgctggagccaccagttcccgcaagcccagacaatgccggtggaggaatttgtggctggctggatctctggcgctctgggcttggtcctgggacacccgtttgacactgtaaagctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccaaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatgaaaaagcac

SEQ ID NO: 146650 - DNA, 505 bp, Homo sapiens
tgggcaccaggccaattctcaccttcccgccagggttaaacattagtgggaggttatcagcgtgggccaggggagggagaggggggaattcaactctgtctcctctgctggagccaccagttcccgcaagcccagacaatgccggtggaggaatttgtggctggctggatctctggtgagacatttttcttccttctgtcacatcacacccaatggtaggtcacttcctcgggaagatgggtgacatgggaggagcagagaccaaagtctgagttccggcctggcgggaggatcacttgagcccaggagtttgagaccagtctgggcaacatagggaggcccctgtctctacaaaaaaatcaaaataattagctgggcatggtggctcacacctgtagtcccagctacttaggaggattgcttgagctcaggagttcaaggctgcagtgagctatgactgcaccactgcactccagcctgggtgacagaatgagaccctgccaca

SEQ ID NO: 146651 - DNA, 1496 bp, Homo sapiens
gaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctggtgagtcactcctgggagtggctcctccccaccctgccacgcagcggcaactgcgggctgggcctaccccctggtggccacgctccctccgcacccggcctctctctgtggcatgggggcggccatgccccttggtggagatgaatgggagtggagctgggctggctgggcaggcaggggcttgcctcttgctgactaaggcagccctggaggggcccgaccatggggcaggaacccagttgccatcctcagagcgaggatcattggccgggctcggggatcagggcctctgtggtcccggcacgcctggcccgtgagactgtactctgcacgactcctccaggtggccagggtcaccggaactggctcgctctcctctgccagttgccggaggtctgggcaccaggccaattctcaccttcccgccagggttaaacattagtgggaggttatcagcgtgggccaggggagggagaggggggaattcaactctgtctcctctgctggagccaccagttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacgtgatcaagtcccggatgcagatggatggactgagacgcagagtgtaccaggggatgctggactgcatggtgagcagcatccggcaggaaggactgggagtcttcttccggggggtcaccatcaacagtgcccgcgccttt

SEQ ID NO: 146652 - DNA, 535 bp, Homo sapiens
gttctcaccaactttgaaaagatccaaagctaataaaattgaaacaatcaataaacatccatatctatcttcaacaaatactagttttgtcaagtttttatgtacacacatacatgctttctatgcactatttagaaacatgcatgctcataacttcaagcctaaatgcatcttctagaacatgctcctagataaccaccgtataagaaatttaaaattaactgaatatcacttaacacacactacatattctaatttccagttggccccaaaatgtcctctttagccattttttgttcccatgatctaatcaagatccatgctgcactttagtttacttccttggtctccttcaatctagtggtttccccacttgtctgtcgtaacattaacattttagagtttggactacctgtcgtatgcatcaatgtctgggttttcctttgtcattagatacaagctaaacagtttctcaagaatactgcataggaatatgttgtatgccagtgcacatcaatcagcagccctatttatg

SEQ ID NO: 146653 - DNA, 336 bp, Homo sapiens
ttcatggtgttgaagtcccccagcctgtggtattttgttatggcagcccaagcagactaaggaggggaaacggcaaaggacagaatttggagaatgacttctcttggggtaggaagatgataaggaactagtggaagacatagaggtcagaaaagttgaagggaatgtattcattttctctggctgttgtaacaaatgactgcaaacttggtggcttctaataacaagatctatttattctttcacatttctggagaccagaagtccaaaatcaggatcgctgggctgaagtgaagggtcagcagggctgtgctcctgcagaggtgtagggaagaa

SEQ ID NO: 146654 - DNA, 705 bp, Homo sapiens
cgttagggagagagttcaccgagacatcatctaatataagcattacctcacacattatctacactaaattttaattatttatacggcatgccagttcttggtattctttggcaatgaatgaaaatgtgtatgtggttagtattggcatataggtctaaggtaaatatttagccctgttggtaataaacaaagtgggtccatctcttgaagctatttattccagagaagtaccttcagtttaagagttctgttcaaaacctgccctctgtgctaaatttgggagaaaaaaatctgaaaagcatggaatgaaagagatccaggaatcctttttcagaatacaataagatttctgttctggttggtgaagactggtctaggcaaggaaggtccccgtttgcattggcacacagcagcgctgcgctgcccgggcaggctcagcctcaggtgcctgcagctttatctttgcaaacttgaccatcaaagtcccaggggctttggggccatggacaacaccacacccatgcgacagccactttacctacctgctggcctggcttctgggttagaatttctgaatttctgccccgccctttctcctggaggtacgctgccaagtgaatcacgcctggcagctttcagacggcgtgtacctatgccttcccacatcagcagggatcgaggatgcctttgctgtgaactcacact

SEQ ID NO: 146655 - DNA, 405 bp, Homo sapiens
atacatatatagtttcgtagttacatatatgtataaatagatatatagttacatatgtatgaaactatatatgtagttccaatgacatatatatacacgtatatatatacgtatacatgtacacgtatacatatatatgtatatatacgtatacaagtatacgtatatgtgtacgtatgtatacgtatatgtgtacgtatatatacatatatacatatatatatctcatatatatatatttcatatatgagattgaggttgctttctttgccaagtgactagaagggtgtggtgggaaacctctaagacagcgccgattatctctacattcttctgtaaacacccccaccccttgtgtgggccaaagctaataacgtttctgttgaattaaacatggctaaagtg

SEQ ID NO: 146656 - DNA, 685 bp, Homo sapiens
ttttatgtgctaaagctggcaacattactacaaggttaacttctcactttcatcctggaacttgttttgtcattatctttgagggtcatggtgctatggggccaaagggacttcatgcccttttggatagccatgggtctgacattcatcctgccctcccctgctgctctctgcctcctgcctctggtccctcaggcctcaaagcccctatgccagcagacacagggcagcatgttgagggagaagattctgcacactcatttgaggcccgcctgaccctgtctccctcacatgttcaatagcactcggccccaccctcaccttctggaatgttgtgcctccaagtctctaagcaccacaatgtgtgtgtaaatctagcaaaatagacagattttgagactaaatggggactctgggtatggatttacacatgggcaaaatttttcttgctgagcagtttgtgttaaatgggatttagtttgctccttgatgatcagtctgggagggtagttggaaatctacccctgtacaggcttcttctgaagttgctctttcagattttacagcatcatggatccttttttagtggccaagttttggagctagcaaagcagataaagctacacggaatattcacattttcattgtggaaggagaaaacaaaatctgtgtctccaagatttct

SEQ ID NO: 146657 - DNA, 394 bp, Homo sapiens
cagggccaggccagtgatgtggataatggtgcaggctgatggggagagagcacgatgttcaatggcaaaggatgccaggcttacatgtcgaggagacaaaagggagaggggagagcaggggatgggataaacaggagagtccacgcctagctgctcctcaattccagctgtgtgcctgacatatgggattggagccacagagtctgatatttcaagaggagccaactgaaattatcttcagcacacctgatggctgggtacctctcgtggcatgccagtttgaagggaggctgaacagtgagaaaaaaagagcatgatctttttaatcggatgatgtagattccatcttaattccactacttccctaactgtgcaatcatgggccattttctta

SEQ ID NO: 146658 - DNA, 408 bp, Homo sapiens
acaagttctcatagacaacaacggcactctcggatatagacagcagacacacactcacaaccactctcagacatcgatgcccttcagcaacaaccttcagggcctcagactcacagacaacaaccacacttttggatgcatccctcacggacagcattcacagatgcacactatcctacaccattctcagacatgcgttcttccagacagccttcagaaacacactcacagacattacttgcctgctcagatatagagcccctcatagacagcgttccagaacataccattgcacacttgcttacacacacacacacacacacatccccctctgctgttggtgctcccagtcctgggactgtcaggatggctgatcagtgaagactgtcctagtggctggccacctcc

SEQ ID NO: 146659 - DNA, 240 bp, Homo sapiens
tcaaagccacccctccccaagatgctgcctctgaagctcaaacagtccatctccctgacagttgtgtcctctccttctctcgtatgtggtagtatcactgtcctccccctaaagcagtgggcaccttgagggcagaaccttgccacgggcatctctggcccctggggtccgagcactgagtgggaatcctgatgataagtgttgcatgagctgggcacagtggctcacgcctgtaatccc

SEQ ID NO: 146660 - DNA, 393 bp, Homo sapiens
gagtggctcaagctggagaagtcttggaaacctgatcccaactaccaggtgtttaaagggtacctgtggggaagtgggtttagattcttctctgattgcagagagcagatccggaaataataggtggaaatgttaggagggcagattgggtttaaattttaaaaaatctttttttaatgaaatttttgatttgtaatttttgtgggtacatagtaggtatatataagaaccttattttctgttgtttcccttgctattataaatttattactgccagtcatggtggctcatgcctgtaatcctaacactttgggaagctgaggagagtggattgcttgaggccagaagtttgagaccagcctggataacatagtgagaccccatctctacaca

SEQ ID NO: 146661 - DNA, 733 bp, Homo sapiens
ctgaattatataaggcgaaaagtgaacgtctcctgtaatctagaaaaatggcattataatgagtaaattttaaattttaatgtaattttccagaattttttttttttgagacgggacggagtctcactctgttgcccaggctggagtgcagtgacgcgatcctggctcaccgcaacctctgcctcccacgttcaagcgattctcctgcctcagcctcccaagtagctgggactacagccgcccaccactgcgcccgactaatttttgtatttttaatagagacggggtttcgccatatcggccaggctggtctggaactcctgaccttgtgatctgcccgccttggcctcctaaagtgctgggattataagcgtgagccaccgtgcccggccttttttttttttcgacaaggtctctccctgtcacccaggatggggtgcagtggcgcaatcacagctcactgcagcctcaacctcttgggctcaagtgatcttcccacgtcagtgtcccaggtagctgggactacagacgcgtaccaccacacagggctaattttttgtattttttatagagactgagttttgccacgttgcccgagctggtctcaaattcctgggcttaagcggtctgcccaccttggcctcccaaagtgctgggattacaggcatgagccacttcacctggccatccagaaacttaaatgcttataatcacatgcacacatagttttttt

SEQ ID NO: 146662 - DNA, 523 bp, Homo sapiens
tacgcaatatatgaaaataaatggaagtgagagcagaaaatagggagtcaagtgacagttttagaaaaatggaaagaaacaagagaattaaaagtttgagttcgaagaggagactgcggtttctaccatgggtaagaggaaggatgcagcctgcactctgctcccttgggatcattactgaggaatggctgaacaagcaaataaaggggcaacaaactgtacaaggtgcagaatgaggcccagcttactgctcttcagtccccaggccattcgtcagaaatcaaagaattgttttatttatttatacctttcctcatctgggaaacatttgaaaaggtcagcaaataaccactgttgtgttacttgctgttggccaagcacaatagaagtatttacactccctggaaatttagctgctgtgataaagacatggctctccttacaaattatatgatagatgcaattctgaaagatttgtaaatgaaattataactctggtcatatgctgaatgtactaggtaag

SEQ ID NO: 146663 - DNA, 349 bp, Homo sapiens
actgctgcctgtaatgaaccttccttcactattccacaaaccaccttgccaagtcaaaagactcctccttggtgaagctccccaggatctttcccattcccgtggcaccctttacttaccatgccagatgccaccgctgccccacggtgtcccccgctgcattgggacctctttgagagcaaggatgtgcctgatccttctgctctctctgcaggcttggagcagagggagagcaagaatttaccgaacaaggctgggtgcagtggctcacgcctgtaatcccagcactgtgggaggcccagatgggtggatcacttgaggccaggagttcgagaccagcctggccaac

SEQ ID NO: 146664 - DNA, 375 bp, Homo sapiens
aggctccatggggagtgggggttgcatgactccatgaagaaatactccctacagacctgggtgcaagtcctggtgctgtcattttatatttgtagggtcctgcccagatttctgaacttctctgagcgtccttttccttgactgtgcaggatgatgccgcctgccgtcctggagcagtgtggagattctggtgacaggaaatgttgtggacagcacccgacctgttacagacacttgtccgttccctgtgtccaaggtggagagggagtggaggagggagtgtccgtcctgggtctccactgagcttggcctagacccccagtggtctcagttagagtctggtctccacttgctgctggctgactgcagggaaat

SEQ ID NO: 146665 - DNA, 775 bp, Homo sapiens
tgctctgcaccgtgttttatagggaatgaaaaagaaccccaccaaacttaggatgcatctttccagccgggcccttcctcaagcccctcactgtcacctctggccccagggcaggcctggggctcaccccttggacaacactgaggcccagcccagagaagggacttgtaccctacgccatacccacagctcacagccactcagcccagcatgggttgccccagccagatctccttccaaaacagttagaagagtattgatgaagagtccttcagaattttgattcttcttcctctcctggtttatcttctggtggaaagaaaaacacgtttggaatgtttaagactgagaggtgatgggatttctttttgaggtagaaaatgtggtatgagaatgggagggagaaatagaaaagtattgaagcttttaaaactgtaaggtggccgggcgtggtggctcaggcctgtcatctcagcactgtaaggtggccgggcgtggtggctcagacccgtaatctcagcactgtaaggtggccgggcgtggtggctcaggcccgtaatctcagcactgtaaggtggccgggcgtggtggctcagacccctaatctcagcactgtaaggtggccgggcgtggtggctcaggccgtaatctcagcactgtaaggtggccgggcgtggtggctcagacctgtaatctcagcactgtaaggtggctgggcgtggtggctcaggcctgtagtctcaacactttgggaagctgatgcgggaggatcagt

SEQ ID NO: 146666 - DNA, 298 bp, Homo sapiens
gcggccgcctactactactactactactattgctcgaattcaagcttctaacgatgtacggggacatgtgaaagctttattcaaaactgctaagcattaaaattcaaaaggatgattttatctaagaagaatatttaaaatagtcaaattagtgttttttattattagaactgcctctatattgaggttagagcaagtactttggcatttagttttcttggtttatgtgtaattttaattaacaagatattaattatgagtctgaggatttcagaatttattattaaacccaaaagaa

SEQ ID NO: 146667 - DNA, 632 bp, Homo sapiens
atcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgtt

SEQ ID NO: 146668 - DNA, 451 bp, Homo sapiens
tgggaagcaacagctctctctagaaggatggctggagggcaactgttcctccctggtcccagcaaaaaatgacaagagattttgtctctagagaggataagcagtctctgaccttgaggacagcaaggatgaggatgagatagtagtaaatgtttacacactgaatgctccaacacctctcctccgtcccccactcctacccagccctcttcccacactcagctccctgccacgcctacatttcccaggtaaaatatgtgacgattcttttttgggaactgagacctgacaggaaaaataaagactaaagacattgggaggccgggcgcggtggctcacgcctgtaatcccagcactttgggaggccaaggcgggtggatcacctgaggtcaggagtttgagaccagcctgaccaatatggcaaaaccccacctctactaaaaacacaaaa

SEQ ID NO: 146669 - DNA, 137 bp, Homo sapiens
tcccacactcccagccactcagggacagtgtgaagataaaaccgggaggtgggtaacagtgaacttgagagagagccagagaactgactgagggacagtggcttcgaccccagaattcacccctgtattgtctctac

SEQ ID NO: 146670 - DNA, 273 bp, Homo sapiens
tttctgtgaatcactcactcatccagcttcagaattctttattctaagttcatcagtgtttattagtggaacctaaatgccctttcatgttagtatgattttaatggagtactttttatctcaataaagtcgtgtacatataatgaagcaaattctataagcattaaaatatagattctttaaggtttaagagaaaaaaataatagtgtatccaaaaaagggaattccccaccttcacattcagagtcttaccaagtaaaaacatgatcagta

SEQ ID NO: 146671 - DNA, 236 bp, Homo sapiens
tcaagagtagctttttgatcaatactacagaaatatcacatatcggaaaaacatatatgatttgttcatatacaagtcagaaaattacactaatgatttaatttacattcaaccccagccgtctattttacaggcagaaaatttgtgcttcctgtaattgcacaagcaattaggcatttacactctaaaaattaagagaaaatgtctgattgtgtatgcaatatctgtgcccacaa

SEQ ID NO: 146672 - DNA, 297 bp, Homo sapiens
ctctgtttacaacaaaagtaaccacccacacccctgccagaaaaccagcctcgactcccaaccagcgcatttccactcattcagttcctctctcctgaccattgctcagcaaccaggaataaccaagtcccagatcaggctctgcctcctcctggagcccagcctctgttctaggtcatgctgaagagctgcctgtgtgctcaaccaagctgctaccctgtcacagatcccccttttgctcctccttgggtgtccacaggctcggtggggccaaggtggtcaatggccatggggaca

SEQ ID NO: 146673 - DNA, 390 bp, Homo sapiens
  misc_feature (14)..(14): n is a, c, g, or t
  misc_feature (20)..(20): n is a, c, g, or t
gtgacacagatggnagctancgcctgctccagaggctggcatcctcactgaccagatcccagcttttggctgtgaactgcttgcttcccaggggggaaatcatcaggtgggatgtctttgaggcacaggaaggaggtgtgttcctcccaggggcacttccagagtctaagcttgagatttctggcccttccaccccaggtgatgggaatgaatttgggctagagtcacatgaaggctggccagtggctggagctccttaagggctgttttccttcttcccctgctctgctcagcaccaaaacaactttccttgaagtcttgtgggtggcaggatgggatttcctctggcttttagcttgagtgtgtagccttttggggtctcagcatcat

SEQ ID NO: 146674 - DNA, 336 bp, Homo sapiens
aagaaaacagaggggctccgttacaggcttcaaacagagagaaagccagagccacctacagccgagtcaatgtggggattcctgcaatgcctcggccaactgaagggtagagcatgaaacacacagtcatttgatggtaattatcttgaaaagatcagaccagtgatatttctgcaaggagaccaattctaccacaattccttccatctattagtcaccatctcacaattattttgccttttctaatcagcagctaggcatttgaagccctttcttgaacacatttatcatctccaattttgtggacagaatcaattttatttacccatgctaagc

SEQ ID NO: 146675 - DNA, 401 bp, Homo sapiens
gacactgaatcctataggtaaaatcatttttctgaagtgttccagtaattaattgtaaaatcatcatctccatcatcatcttggagaggcaacaatttccaaagacaatcaatacaaatgcctctcaccttctttctccctatgcacaaaattttatcaagtccccactggtatcttctatacctcaagctgaattgggaaaaaattccacttgggcattcctaatagagcccagggacaggactcattcccttccctgctgctcacacctctagggaatctcaaaacaaaactaaaaactgttctaaatattccatgcaaacatgggtaatatcataactaacttgctcagcctctttatctaacatttagaactagcttgtccaacctgtggcctgtgg

SEQ ID NO: 146676 - DNA, 213 bp, Homo sapiens
acctactttttaaaggatttaattaaggtagcttaaatatttaaaacgtaacaattaagaataaaagtaggtattagttgtagagggaatacatataagtagggccctaagataagttaattactaagttcgaataccaaatttgaattttgcagctaaggctaaaaaaggaaaaagatctttttttaaaagaaaaaaaaatcttaacatcca

SEQ ID NO: 146677 - DNA, 393 bp, Homo sapiens
acagtcaggtcgtacccccgctggcaatggacccgctggccccaatggcaaatccgtctctactaaaaatacaaaaattagctagatgttgtggcgtgtgcctgtggtcccatgctgctcgggaagctgaggcaggagaattgcttgaacccgggaggtggaggttgcagtgagccaagaccgtaccattgcactccagcctggacaacggattgagactccatctcaaaaaaaaacaaaaacaaaatgtttgggccagcggggactccaggttcataagcccaccaacagctcacaccctcagtacagaaaagctacaggcactcgacaccaacccagcccatgagagcagccatgggggctacaccctgcaaagccacaggtgcactgtcc

SEQ ID NO: 146678 - DNA, 209 bp, Homo sapiens
atctttgtcaccaagcagcgttgagccagagctgtctaatgctgagcccagctcaggaaggagagaggagtccttcagtgtgtcttggagatgcgaagtgcgtcctcgtaaaggtcagctgtcagttttgctggccgctccggcgctggctctcctgtccgggaccacaacgagaaacagcgacagattcgacgcagagctccggaagt

SEQ ID NO: 146679 - DNA, 851 bp, Homo sapiens
atgtgagtgttgtacatatgctgtgtatgtgtgtgcatgcatgtgagtgtgcatgggtgtgtgtctgtatgtctcagcagctgtcactgggcttcccagtccctgtcagcaggcgaaggaggccccttcatttccttgggtcctgcttatgcagcacaggccacagcaaaggctccctgggttgggtcagccctcactctaactcaacatgccctggaagtcaccacagggtcatggaaagagtcctggtgatgagatggagtgtctgctctgccacaagggctgtgggaccagggtcggggcatacctctctgggtctcagtttcctcactggtaagatgtggcaacagaatctcatctgtgagccccctctagccttgaacaactctggatccaggtagaccagcataatgaaagcctatgaagcttctgagatgtgcgaggcatacattgtcccaggtactcaagtaactcaagtctggaagctgcgagccacagagatcaagccttctccaaaaattggactgcaaggcatgccgtacaaacagagtgctaggagaccttggggaggtggggaagaggaagaggaatcatggacagcttcatggggaggtggctttggagctgggatgggtgaggacagctggaatgtgggcagcacgtgaccaagtgctttgcagacatggcatggcccccagccaggccctgaggaaaggagagtctcaggacagcagctatgtcactgtaagcaggacccttgaaagcaggtgccacctgcaaaagggggagccctgaggcccaggcaggcctgtcacagtgtggggcacctgtctagacagccccatggccag

SEQ ID NO: 146680 - DNA, 438 bp, Homo sapiens
ctatcggctcggtcctatctgtgtcggggtgggacggcccggcactcagaaccccgtctccaccaaaaccagtcaggcgtggtggcgcgtgcctgcaatcgcaggcactcggcaggctgaggcaggcggctgggaggtgtaggttgtagtgagccgagatcacgccactgcactccagcctgggcaccatcgagcactgagtgaacgagactccgtctgcaatcccagcacctcgggaggccgaggctggcggatcactcgcggttaggggctggagaccggcccggccaacacagcgaaaccccgtctccaccaaaaccagtcaggctgtggctgtggacttcagcactaccaacagtgctgaaaacactatgatttacatccattccaagttgcaagtccatcttttcttcctgcaacaaaagaccattagcttaa

SEQ ID NO: 146681 - DNA, 437 bp, Homo sapiens
tttgttttacctttttttgagacagggtcttgctctgtcactcaggttggaatgcagtggcgtgaacacggctctctgcagcctccacctcccgggctcaagcgattctcctgcctcagccccgagtgggactacaggcacacaccaccgcatctggctaatttttgtatttttttgtagagatggggttttgccatgttgctaggctggtctcaaactcctggactcaagcagtctgcccaccttggtctccctaaatgctcggattaaaggccagagtcaccacgcctggccataactgtaatattttggacaaattagttaacctctgttagtctcactgtacgcatgtgtcgctaacaaaccttgcagggttgatgtgaaaataagatatatgtaaaaggcctagcatatactatatgctcaataaggaacag

SEQ ID NO: 146682 - DNA, 178 bp, Homo sapiens
cgacagagccagaccctaactcaaaaaataaaaataaaaaataaaacaaatcaggtgtgtatgcacatacacacacacaaaatgacttcaaagtattttcaaagatcttattgacgctccttgggccaaaaacagaaaggcttccttggcctgaaccctgttgtctcccttcccctga

SEQ ID NO: 146683 - DNA, 293 bp, Homo sapiens
caattacttttctcctgccagagtgggaggtgcacacactctggagcctgtttgaaatccgagtctccgtgcctgcctgggtcctgcgaccgtcagcaagttgagccccaggtgctctgtccctccagtagcacaagtggagtgtcccttccctgctaatcacctgggcgggaaagctggctgtgtgagagctgcagggccctgggtatttgctgctgaggctggatgctctgatatgtcgggtggcagacctgcgggagctctttgccagtttgggggtgaaacagaatgca

SEQ ID NO: 146684 - DNA, 163 bp, Homo sapiens
aagcagggtggttttcgctcctctcctagactgtctgccatctgggggcaatggcagcttggaaaatttctttgcacagataactacactacgtaaaagtttgctgcctttgcaaactttgaaacgcctacaggaagaaatgggataaaaacgactttggccg

SEQ ID NO: 146685 - DNA, 319 bp, Homo sapiens
atttgaacaacatgatcaactgtgtgaaaggcaagtacagaagtgtatctagaatatattactcttcatggcgttgttttacagttaacttttttttaataagtagaaggagtacactctagaataatgataaaaagtatagtatagtaaatacataaactagtaacatagtcacttattattatgtactgtacataattgtatgtgctatacttttacatagctgacagtgcagtaggtttgtctgcatcgcatcactataatcctgtgagcaatacgctgtgttaccaggttatgaaagctaccatgtcactacatg

SEQ ID NO: 146686 - DNA, 181 bp, Homo sapiens
catatgcatgcatgtgtctttatggcagaatgatttatattcctttgggtatataccaatatatccaaataataatgggattgctgggtcaggtggtcattctgttttacgattttctgtgagaaattgtcaaaccgcttttcacatagctgaactaatttatattcccaccagcagtgta

SEQ ID NO: 146687 - DNA, 532 bp, Homo sapiens
ttcttactctataatttaaagtcacgggtataacaagcgagcctttaaaaactgttttccgaattaaaaaatggagcaaattcattctttgttgttgaattcaatatacttagaagtaatttatcactttggtaaagaataatgtcctactatgccttaatatctgacacgatggagatattcttgctatctacactgtgatcaccagataccagacacttcaaaaatgttgccaaaagctgttaggcatactgattgtatgaaaggtgtttgggtaatgtggactcctttcagacatttgtgatttttctgccttaattgaaagttttgacaggtttgtaaaagcataaatgtcaggttattagtagaaactctaaaataacctgggaaataaatacatatactggtttcaaccactttggctaaagctgaatgtctctaaaaattgaatcagctgatgctctaatatgttaaatatatcaagagacaggatgtttcctgatcacatccagataatttttttaattaatag

SEQ ID NO: 146688 - DNA, 641 bp, Homo sapiens
caggctggtctcgaactcctgacctcaagtgatctgcctgcctaggcctcccaaagtgctgggattacaggcatgagccaccgcacctggccaacagtggtttttctaaaaggcgaccctgatgtcactcatttgcttaaaatttctcagtagctcttcgtctatttcagtgtaaagttcagtttcctccttaatgtagtatacaagccacttcacaatcttggttctacttagcttaccagcctcagcatttgttgctctacaattgcacttgaaaaccatagtaaccttaacttacactctctcccaactattctcatgcttggaatacctcctcttaccaatattttccttgttaatacgtccctactttccaggacagagctaatatatttatgggaatctattaatgatctcatcctatttgaggtttacagcaaccttgaggtaggtaacattacagtaggtaacacaatgagaaaccctataactgatattttaacccaactttcattccttcaaagcctggcacgctgcctggaccaacaatatcatattctactccctgccagggaatttctgaaccatctgagtctcagtttcctcttctgtaaaatgaatttcataagacctgcgtcaca

SEQ ID NO: 146689 - DNA, 126 bp, Homo sapiens
ctgcctcggcctcccaaagtgctgggattatgggggtgagccactgcattcggcccatactattctcttatccttttctgtaaggtaattagtaatgtctttattaaattggcttttaagtagagc

SEQ ID NO: 146690 - DNA, 803 bp, Homo sapiens
gcttttagatacaaatcagacttcctctccagcttatgtacattacagcttgtgtaaattttaaacattgattttataacatctgtatacatttctaaaaattgtattatgctttttagttagctttgactaatacaagttatttaatactaaaattatcctcagtttactaagattttaatctatttttaatagaatattcactgtaaaagttttgaacattatagaaaattaatcaggtatttttaagtttccctgttaccacttcccagaggtgactattgttaacatttcgtatgactactttcaaatgcttttcagtgcttactaaagtgtttgtgtacatagctatgcacacacaacccctcagaattaggttttttttctcccatggaatcatactgttatatcattatgcaagttgacatttatttatttatttattgagagggagtctcactctatcacccaggctggaatgcagtcacgcgatctcagctcactgcaacctccacctcctgggttcaagtgatcctaacacctcagcctcccgagtagctgggactacatgcatgtgccttatgtttttagtagagacaagttttcactgtgttggccaggctggtctcgaactcctgacctctgatgatccacccgcctcggcctcccaaagtgtagggattacaggcgtgagctactacacccagccatcatttttattcaacccatagtaggcatcttaccatatttcaggtggaaatacttcactaattttaacagctacataatactttatggcatgg

SEQ ID NO: 146691 - DNA, 404 bp, Homo sapiens
ctttttcgtattgatgtatcatggaggctataagcaataaaacttatcaacaaagatgaaaatccctatggaacataaacactttcctattaaactcttaagttttatggcaataccatcacactgtaatttttgtaatagtcccaagtttgatcagaaaaactaaacaatatataatgcatatggcacatgtattttaggattttggcacaagatcattaaaaggcctcaaaagtgtgtggcaaattggtactcttttccacacacccattaaatttgctgcatgactaatcagatgaagcatgtcataatcatcactagtgtaaaaggtgacatataggctgaagtcacactgccataaacatcttatgattcaaacaaaaaataattgtgcaaaagagcaa

SEQ ID NO: 146692 - DNA, 492 bp, Homo sapiens
tgcgtccggcctaatttttgtatttttagtagagacagggtttttgccatgtcacccaggctggtcttgaactcctgacctcaggtgattggcccgcctcggcctcccgaagtgctgtgattgcagccgcgagccaccacgcccagccaggttgagcgtctttaatctgaaaatcccaaatttgaaacgctccaaaatctgaaactttttgaacaccgaagtaacaccataagtggataattacactcgaccttatgtgatgggttggagtcaaaatgcaggtgcacaacatacagtttattcagtgtccccaaagggaaaaaacatcctcccggtgcttttcagctgagatacatcttttctatatatgcccagattgccccaagcaagtgtgccctcaaagcgtaataagatggcatgtgtgcagaccagatgtgtcagtggcaggatccccatgatgccccatgatgggaccaagacctctgtgtgtca

SEQ ID NO: 146693 - DNA, 388 bp, Homo sapiens
gtagagaggagctgagtcagaaagcattgatatgtcgagggccattcataactctgagttctaataaaagttgatatccatccctcttgcttctgagtaccagccagagatgactggttgattcacaggaataagcagagtcagtctcaatagcagaaaaaacctcaaaaacaactgatgagacaggtgtaccatagttctctctccagtcctcatttttactaaagataaatcatggtaagactgctttgctttattatacttggcctagttatttgtataaagtgcagcaagaataattatttttcacacaggctttcttaattggctttaatgggattttctttcatagaaggaatctcaggttagacttttttaaaaagttgag

SEQ ID NO: 146694 - DNA, 169 bp, Homo sapiens
ctgccttggtctactaatgtgctgcgattacaggcatgagccaccgtgcctagctctagtggacttgaaatgttgccttgcccagggcccttatgttgaatggcccaggtccacttgtatggttctgtaccaaggttaaccccatcccataatgcctgggacagttgat

SEQ ID NO: 146695 - DNA, 180 bp, Homo sapiens
ctctctctctctctctctctctctctctttccttccctctttctctctttctgactagtcctatctccagaactcaacaagaaccactagagctacctctcattcttgctggaagccactaaagttgtccacaccaggcccaccagctacaccagaactataaggttatgagattgtgga

SEQ ID NO: 146696 - DNA, 225 bp, Homo sapiens
ccagcctgggcaacaggataatataaacctattgtgggtggctgtactgagaatatcattaaatgaggtaatgtgtgtgaggccccaagaagagtatgaggcaaattgtgaggactccagagtggtcaacttatttatggtttcttttaatttttttttgagacggaatttctctcttgttacccaggctggaatgcagtggcatcgatcccggctcactgcaac

SEQ ID NO: 146697 - DNA, 249 bp, Homo sapiens
taggagatgaagtgaccagggtatgacctgctgactggaatgttcctggagaaagtttgacctgtcttaaaataggaatggaggactggaggactgtgctcagtctacaaagtggggattggggaacattagattgggagcatgtcagtgtatgtatccagccctgctcagaatctctgcactgggcgtcggttctttagaaagccatctctatggagaagggctgtgagtgtatctaatgaggcttct

SEQ ID NO: 146698 - DNA, 441 bp, Homo sapiens
ctttcactacagaaagccctaatgggcagtgctgaacgaaaacctttgaaacccagacaatccagaacaaacagttccatgctttaaattcatactagcttcaaatgctaaagagcaccttccttcctggcttttccatcaaagtacatatacgtaaatctcatagatctttctgttgaacattgataaaacacacagaactaagtgagattgcctacacaagactattctggaaaattttatctttatgacacagacttatttctaacccaattctaacataaaagccattttattaaaaatgagcagtgcaactcaattaggctatctatatgttttaatccacggtttgatgaatcaaaaggattcatgttcttgagaggttccttgtaagctgaagttgcaagtaaaccatgagaaagtgtaaaaaacacttgtgac

SEQ ID NO: 146699 - DNA, 588 bp, Homo sapiens
cactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgaggaattaactaacattatgttatctatctaatttgtctgtgtccctaaatgcccatgcctaacttgcttctctagtttattccttctgtggagggattaaaacgtgggtgttgcaagttgccctaagctaaacatagttttcttacatctttttgggaaaaaaaatggaatgggaagtatgcaagattaagcaagagtgatttttttttttttttgacaaatcaggtggccttcctaaacatactaagaattatgttctttcatgtgtggagacacatttgtttgcagcactttaaaaaatatatatggaataaaagtttacatgttgg

SEQ ID NO: 146700 - DNA, 395 bp, Homo sapiens
gagttacagtcttttacccttattacgtttacacttcgtgctacttttacaaccctgagacgggaataaacatatacactctatactctcctgattacgataaaacggatcaatccttcataaatttttgccaggactgagaatgcagaaaacaacaatgagcaacagcattgactacagtacatcctcaagagagtataaatcccacctttccaattgataatatacctcatggactgttgtttccactaagtgtcaaaaagaaagcatctcacctccattatgggatccttgaggataagacttggtctcactcatggaacaacaatatgattccataaagaaatggtgctaatctcttggaaagatttgtagctggccaggaacaccacccg

SEQ ID NO: 146701 - DNA, 285 bp, Homo sapiens
ccagatgtaaacacagatgcagtatcatgtggaattatattgttagctactcttaactacctgtattgaattgcagcagaggaggagaaaaatcatgcagatgttggaagaagatatgcattagtgtgcaagagtacagcgagaggttagaaaacttgaagctgtagaaataggattgaaaaaggtttctttgcagtacagtcactaatttatgtggaaatgcatgctctttatttctaattgagatataagctaaaataaaagtccattgttgaaagaaaactc

SEQ ID NO: 146702 - DNA, 308 bp, Homo sapiens
tggcttcagaccctggctctcccagaagctgctcctaatttggccatggtgaggttgctgaggagaagatggctgggtggctttggtgggaaagttcccattgctccaggagtgagtcctcgaatgggacaggggtacgaaacacccactgatgagtgaagcgttgtgctgacaccaggagtcctggcagctgcagagaccatccgaggcctgtcctgcctccagccccttacatggatgtgccaggcagcccaggctggggcgtgctgccgacctccatcctgtctgtaggcaaggcctgcctaggt

SEQ ID NO: 146703 - DNA, 378 bp, Homo sapiens
ttctttcccactcttcctttgcttaaccagctctttttctttcttttggtttccaattcaatgtctctacttcactggctactaatgtatactctgttattctctcacagcacctcattcccctccttcatggagcttattataagttttttattattttattgttcatttgcttttaaacaatcagtttcttccattaaaatgtaggttgtttgaggacagagacttttacttgtcttattctcttttgtattcagtgccccagtgccctgattgcaattagggtcacagtaactggatggataggtgggtgaagagatggccaagtgactgcctcaagtaacacagtaactggatggataggtgggtgaagagatg

SEQ ID NO: 146704 - DNA, 203 bp, Homo sapiens
gcacactaatgacatgaaacctgttgaggcagaatgctcagtggttatttaccatagttatgacctgcaaaggctcaaccaaaacatacacactctccttttacaccctacaggatgactaatcagtcacacctcttcaaaggctcttattaagtctttagcggtctcagactgttgctgctataagcctcctagaagtattt

SEQ ID NO: 146705 - DNA, 300 bp, Homo sapiens
ggctatagagattttaaaaaacaatgatgaaataaagcaaaagttggcagttataaagaatctcagtgataaaatactgaaatactcctccctgctggggcagtgggtcctatacacaccccttcccttgttgatatgtcactgagaatgcgacgtgatcaatgaccaatgagatttagaaaagtcgggtgatattattccttccttattgagtgtgtaatagtgatcactaatttatgcaacttgtttctcttgggtgtgcattaactactctactagtgatttgtaaaagtgaatagg

SEQ ID NO: 146706 - DNA, 428 bp, Homo sapiens
ttactatgcaggtatcaaaataagtaacttattaatgactgaaattgagagatcccaagaacatctttaaagctgcagaacaacatgcatgagttggggtggggtagatcacaaaatgatcaccccatcagtatgtacagtatgatattatttttgcaaactaaaacactatatattcctatgggtacaaatacttgtaaataaacgcagaaaaagtatacattccattcaggaggagggcacctgtgtactcaagtacgtggtcatagggaactgtagttttgtatgtattgtttgaagttctaaaaataggacatgtatcactgttgacttgtacaattttaaaaacagcataaaacagagtagaaaaaaatagataatccacacttcaagtcccatcctctcccctgagcgccagattcttagtt

SEQ ID NO: 146707 - DNA, 462 bp, Homo sapiens
gcaggattggaagttgctctgggtgagtcagtgagtgggtggtgagcgaatgtgaaggcctaggacattactgtacactactgcagactttataaacactgtatacacttaggctgcaccaaatttatttttgaaatttctttcttcaataataaattaaacttagcttactgtaacttttttactttataaacacattatttaaaacttttcgactcttgtaataatacttagcttaaaacatcatccactttaaagttgtacgaaaatattttcttcttttatatctttattcaataaacatttttctattttcatttttaaaaaattttaaacttttttttttaaaacaatactaaggcaggagcagtggtgcacacctgtaatcccagcactttgggaggccgaggcgggtggattgcttgaggccaggagtttgagaccagcctgaccaacagagta

SEQ ID NO: 146708 - DNA, 754 bp, Homo sapiens
ctgctccgcccctctctgggactgccaggcagagagaaaagaaggctctcttccgcactcagatgatgccggggattacgaacagctcttctcatcaactcagggagagatctcagagccgtcccaaataacaagtgagcccgaggaacaaagtggcgctgtcagggaaagggggctggaggtttctcatcgcctggctccctggcaggcatctccaccgcacccgtgccgcttcctattggggcctccccagggcgggagtccccgcgggtctcatcacacaagtgggtcgtccctgtcaacaccccggtcccgtggcggaacttcccaggtgggctccccaaccttgctgtctccagctgtgccatcaaagcagagaaaggcgagcagggtagcgatcctcacgctgtctaaagagccagggcaccagaaaggcaaagagcgtcggtccgtgctggagtgcagaaataagggggtcctgatgttcccagaaaaatctccgtctattgacctaacccagtcaaatcctgaccattcgagctccagatctcagaaatcttcatccaaactgaacgaagaagatgaggtcatcctcttactggactcggatgaggagctggagctagaacaaaccaaaatgaagtccatttctagtgatcctctggaagaaaagaaagctctagaaattagccctaggtcctgtgagctgttttccatcattgatgttgatgcagatcaggaaccttcccagagc

SEQ ID NO: 146709 - DNA, 296 bp, Homo sapiens
gcctacctctcccaccaatctcacaaatgcacctttcccagccatgtgtaattccttgtagtacctttaacatactagcctccatgcttttgcacttgctagtccctgggtctgacacgctccttcctttcttctctcatatagctaaatcctagctcaaataacaagtttccaggaaactattcctaacactgtgatttataaggctaacctatttttgtgtagtaccttctgtagaatatcaccatctaatactgtaattgtgagtttacccatttcactagttcacaagatcc

SEQ ID NO: 146710 - DNA, 387 bp, Homo sapiens
aaccttctgtatttggattctttcacttaccattatgcatgtgagattgaaacatgttgggtttggctgtgattcattcacggtcattgctgtattctgttgcctgaatgtaccacaacttattaattaattctaccactgatggacactgggttgtttccagggttggactgttatgaacaattgtgctatgaacattcttacacatctcctcgtgtgcaagggcaggcatttaggttagatgcttacctaggagtgggagagagtatgcatatacatctgttcgactttagcagataagccaaactggtttccaaagtatctgtacaatttggattctttttttttttaaggttttcatgaccacatcataccttctttactgct

SEQ ID NO: 146711 - DNA, 309 bp, Homo sapiens
atcacagcttactgcagcctcaacctcccaggctcaagcgatcctcccacctcagcctgctgagtagctggaattactggcgtggtggcgggtgcctgtaatcccagctacttgggaggctgaggcaggagaatcgcttgaacccggaaggtggttttattgttttgaggcatggccctgggggcttgtggcaagggctgaggtgtttggggagcagcagtgcaggaaaggccttactcagctgggcttgcaggtatgctcactcctgtctgagcgctgcttccttgtttctagcctccgtttagaata

SEQ ID NO: 146712 - DNA, 152 bp, Homo sapiens
aattaggtagccacgctgggatgtgcctttatcccagctattcagaaggctgacgtgggacaatcgctttagccccagaggtggaggctgcagtcagccatgattgggacactgcacgattcagcctggccaacagagtaaatccctgtttc

SEQ ID NO: 146713 - DNA, 341 bp, Homo sapiens
acttcatctcaagaacaatgggatgctgctggagagtttaaggagggagactttgttttaaaaagaccaccactgaatgaagggaacaagattggagccagggagtctggagccagggagtctggagccagggagtctgatttggctgcttcaacagctcaggccagagctagtgacagcatgaattaggacagggactgggatagtgacagtagggtttgagagaagtgagtaggttcaaggagtatataaggagattgggtgcggtggaatgccttcatttttggcttgggcaagtgggtgtcattcagcaaagtaggcaatgctggaagaggattgga

SEQ ID NO: 146714 - DNA, 562 bp, Homo sapiens
atgccttaaggtctaaatttaactgtggaatatgacaaaaatcacattaactgttcaaccatgaatattttaatttttcttaaatatttaaaatggaatcttctgttactctgtgtcctcttatcctgcttttcttaaaagcacttgtaataccttacatgtatacatatttcatatctgtttactaattgtgtttccttcacttcagatgccgtgagagcaggggcttgttttaccgcttgctgtttcctaagtctctagtacagtgcgtgacatccattctggagctgggaagtccaagataaagatgccagcagattagtgtctggtgagggccagctatctctgctttcaagatggcaccttgttgatgtgtcctcaatggcagaaggtggaagggcaaaaaaagggaccattaggaccctttcttcagcctcttttataagagcactaatccattcatgaaggcggagccctcatgtcttcatcacttccccaaaggccccacctcttcatactgtgacaatggagatcaagtttcaacatgaattttggagagaca

SEQ ID NO: 146715 - DNA, 465 bp, Homo sapiens
  misc_feature (52)..(52): n is a, c, g, or t
gcgtccgctcccgcgctcatcgggcatttgcagtcgccgcctgcgaggacgngcagggatgaagatgactgtggatttcgaggagtgtctgaaggactcgccccgcttcagatgccgtgagagcaggggcttgttttaccgcttgctgtttcctaagtctctagtacagtgcgtgacatccattctggagctgggaagtccaagataaagatgccagcagattagtgtctggtgagggccagctatctctgctttcaagatggcaccttgttgatgtgtcctcaatggcagaaggtggaagggcaaaaaaagggaccattaggaccctttcttcagcctcttttataagagcactaatccattcatgaaggcggagccctcatgtcttcatcacttccccaaaggccccacctcttcatactgtgacaatggagatcaagtttcaacatgaattttggagagaca

SEQ ID NO: 146716 - DNA, 635 bp, Homo sapiens
atggctcactgcagcctcaacctcctgggctcaagcgatcctcccacctcagccccccaggtagctgggactataggcacgcaccaccacacccgactaatttattttttatagagacagtgtctccctatgttacccaggagttctcatgaacagtggaagttgattttaaacaatgaagagtcatggtcagattagcactttaagatcacctgctatatgttgggaaatggtttgagaaagaggactaagagtagatgcagagggaccagttatgaagttcttggagaggaaagataacactagcttgacctagagtagtagctctggaaatggcgtgatatttggaggtgactgacttttatggcgggcgggggtgtcaagtgtgaatcctaggtttctggcacagtgaagtgggttgtcatgctatttgttaagctcagaaactgtggcagagaatcaggttaggtcattttgagtttatcagaaaagagttgttcaatatgctgtcaccaaatactggatgtattggtcttaaactcagtgtgggaaggtctggactagagatacatatttgagcttcatcagcatacaataattatatttgaagccatagataagatttctgagggata

SEQ ID NO: 146717 - DNA, 312 bp, Homo sapiens
aggcatgagccaccacgcccggcgggaccagacacttctgacaactgctaaccacctgcacccccaaacccccatacacccagccgggcaccctatggtggtgctctccatgcccgcatcccatcaggcaacttctgaagagatagattgaaccctaaaggatcccaacactggctgaacggccttggccagccctgaagcgctagatccccactctcaaactggcttctctgggaacaccactaccctcacccaggagccaaggagccccaaactctgtttttctttcctgggtgttgagtgcctttctgt

SEQ ID NO: 146718 - DNA, 225 bp, Homo sapiens
ctgtctgccagcaccccccaccccaatccctggtggggagagaggactgtaactttggtctggatgaaggttaaataagacttcagatatcctctcctagtaaacaagctgcaacaacttgaaggcagaaaaggggaaagagattcggtttggcaaatccttaatgaacaccaccttctttcttagtgaggaagacggtgggcaggggacactgtggcagggtgg

SEQ ID NO: 146719 - DNA, 337 bp, Homo sapiens
atgcttttctgtgtgtctattgttcaatttttctgaatgttccaagggaactaaagcccatctcaagtactatttctacatggtcaaatggctcatttccttttcttttatgtactttctccttgaagtctcactctaggattccagctgtcccagcctgctctgggcattaatctgagacctgcattctttcagctctcttctgtgaaggccactgttccttggattccccatctttctatttgtcatttattccgctgtttgaaggaagacataatcacacagctttccaagaaagggtgcacaaaaggtaaattttcggaaatgctacatcagt

SEQ ID NO: 146720 - DNA, 980 bp, Homo sapiens
ccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaaacaggctgcactggaggtgttgcagagaataatactctgagtaaattgcagctaggaccagctagcctctatggagagctctgtctttgatgacatgattaacctcttagaacgtttaaagcatgatatggtttgacccgtcaagtagaccacgtttttagagaaagtttaaagatgcttgcaaaatctgtttcacaagagacaagaatggttgtccttggccatctcagtcaagagcaggccagggatgtctctgtccagttcgggctgccccgtgctggtgaaggtacgagaccattacttcaggtgggcccagcagtttgttctccttatttaaatttctggaatgctggtgacag

SEQ ID NO: 146721 - DNA, 344 bp, Homo sapiens
caatgacaccctgtgctgtgaaagtggcctcagagatgagtctcctgccctgttccctcccaggcctcccctgcctccctaccccagccggctaccagaggggaggtctttggtggcatctgattggtagaaatgcatccttggttgggagccaagttaagctacagtgagagagaaaaagaagcccgaggcaatgctgatgtggagaggtgtgactggagaaactccaggacccttcaccagaggaagccagcttgaactttcattcctggtttgatcaagatagtgtaaaaatggaccccaaaggtcttcagatggaaaactaggttttaggtttcacttat

SEQ ID NO: 146722 - DNA, 229 bp, Homo sapiens
gataatgaggcccctcctatacatgagaacacggaggatgggagatgttaaataacttggttaagatctacagctcataaatagaagttgaccctagggctattagatgccaaagtccacactgataaaccgggcagaaagaaagaggcttttagacaaagaaaaaataaaataacatgtaatagttgattagtgctctaagttgtattacacaaaatgtgctgatagt

SEQ ID NO: 146723 - DNA, 240 bp, Homo sapiens
atacgacaatgataacgccaacacgttctattcactacggtccatctttctgaatctaaagagctccccttcattgctccctcatcaacccatcatctaaactcgaacagccatcgtccgagcatagaactggtcttcttcctactatctcgttactcacatgctcctgacaatgcccttccgggcagacacagatctccccttgcccccacccaagcccgcctgccaagggggctacag

SEQ ID NO: 146724 - DNA, 476 bp, Homo sapiens
tggtagtcatttcatttttcaagctaacaaagagagagaagtaacttacctcaagaaaagattcgttttactaaaaaataacagagagacacatttcatatgattaaaaaaaatgctgagacataatcacaggaacattgcctcatatgcagaactagaaagactgttttagctataaaatgtgatgtttcattaaccagatttctaaagcaaatgtttatacattttataacccttgtgttctgtctcttcatagagctgtttgtctgctcagttgtacagtcctgtgggctctcactcagaagtccctcccagcctagcctgccttcctcttcccactgctgtctctctctccatgggaccctcctctctcacgggactaatgaagcagctgctttgttctctgcctgccacctgtcgctttttataacaagctgtgtatcttctactctgccaccgtcatttccttcctcaaa

SEQ ID NO: 146725 - DNA, 383 bp, Homo sapiens
agtaggatcccagtcagcgagcattagtattctgtccacacagtactgagtacaggcacggcgtggagggagtccctggagggttaaagagtattttgtgagtaaagtcaggggaaatggagagtgtgcctttccctttttgagttcttctgggcttaggaaggagatgaaccagataagcctactgtttgttgagtgcttccttttcatggctagtagagtcctcacaacagccttccagggtaagtactgtattattattagccgcatgttccagaggaagaagcaaaaactgagcacctaagtaaacctgcctgggaccacccagctaagaactggtggcgtcagtcggtctccagtgtagagcgagataacagatgagt

SEQ ID NO: 146726 - DNA, 375 bp, Homo sapiens
agattctgttcttaccccattttgctgaaaaaacattgaaagaggttaagcgatttacaccaaatcacaaaaccagttaattttagatcaggacaatcggactcaacaatctataaaatatcaacattcagtttaaattgtatatcttacacagctttaatctcctaaaaaaaatgaaatgtccctttgtctgaaactgaaatgtcatcaatccatatacactaaggagagggacaatggcaggatgggggtgcacctgctcggaagaggtatccacaactcaccactcactttaaaactctgtggataacttcattcagaaacaaagttaaggagagaaattgttaatgtggggtgagagctcaaaaatttgcc

SEQ ID NO: 146727 - DNA, 355 bp, Homo sapiens
cccagtgccctgcacctggagtcctgtgcttagatctccagcttccctggataggaggccccattcattcattcattcattcattcaacagttcttcactgatgaccttattagcaagccgtgctctaggcactgagggcaaagcagtgtacaaaagagaaagtcctccctcatggagctgatttgagtgagggagacagatgattgcccccctcccctgccctaccaaaaaaataaataaatagcaacaaagttctaatgataccaagtcctgcggtggaaattagaaagggtaaaatatggttgatacagtggctcacacctgtaatcccagtgctttgagacgccgaggcag

SEQ ID NO: 146728 - DNA, 384 bp, Homo sapiens
ccccaggtaatcttgtttgagatgcagaaagccatagtcattcagtcattagatgacttaaggagctggcgggtgcatttgggcatttgtctctccttttggaagatgtggaattggagttttcttttggagaaagctctctctcaggagagagctacagtgagagagctgcaggtgagatgcaaagatctttccaagacagcaggcgagggtagagttagggctgccatgggagcagtggtgcaggggctggttcgaggttcctgacctttgcttggctctagttcctggcactggcaggcccttagatggtaagttcctggcaggcctggctccagggcaacagtttgagtaatcctgtgattactcagctccttctcccca

SEQ ID NO: 146729 - DNA, 456 bp, Homo sapiens
tttcttccaggatggctcccttgaatccatttcgtatactgctatagagcatgctttctaaaatgtaaatctgctcctgtctctttggtttaatatctctgcagggcttcccttaactttcaggataaagtaaatcaattctttctttttttttctttctttctttctttcctttctttctctttctctctctttctttctttttcttgactaagtctcacttggtcacgcaggcctgagtacagtggctgactgcaacctccacttcctgttctcaggcaatcctcctgcctcagcctccttagtagctgggactacaggagtgtgcaaccatgcccagctaatttttgtatttttaatagagacagggtttcaccatgttgatcaggttggtctccaactcctgacctcaggtgatccacctgtcccagcctcccaaagtgctgggattacagg

SEQ ID NO: 146730 - DNA, 504 bp, Homo sapiens
accagacctttttttttgttgagcattatattataaaagacgtgaatcataacttcaaatgtgtttctgagagttgtagtgtatccactctcaaagtgtcgtttggttttgctttctgtttatgctatttggtttgtgctgatgttatttggtttagcttatgtttattatgtaaaacagctcagcccaacttcttccaaggaggaaggatgctttctgtctacacggagatccatttccctcatgttttaattttgtccgagaagtaagttccatctttgggtctttgatgtttgaggtgtctgaaatatgcacagcctgcagcacacgttagtctcaggttctctgaaacctgcacactttggttgtgcatgacattgtatataccaactatgttttgagaggctttctaagaggaggaataggaataaacataaagaacttccatctcagtgtggagtcattactgctgagtggctggttatgcttgaaaacatcagtgct

SEQ ID NO: 146731 - DNA, 235 bp, Homo sapiens
cctgcctcagcctcccaaagtgctgggattacaggcgtgagacactgtgcccagcctgaagtgccagttttataggggctcgttaataatcgggtgccactggttaccactggacaacctctcaacatgatgtggaatagacccttcgtatgcgtgcctccagccccctttcccagagaacctctcaggactgcctgcttactcctatttaaaggcatcaaagattatcccactc

SEQ ID NO: 146732 - DNA, 758 bp, Homo sapiens
ttgtatttttagtagagatggggtttcactgtgttagccaggatggtctcgatctcctgacctcgtgatccgcctgcctcggcctcccaaagtgcggggattacaggcgtgagccaccgcacccggcctgttcaaatctaatttaatattcagttcatgcttagatttttcctccatgtgggcttctagtcactagccattatacgaactgacctaagaaatctaaaatacagtataattgtggaaatagctattaatatatagtaggtttataactgactctttctttgatcaggagttttttgcattcttcattagctgtctcagtattaggtctatcaatattttggtgggcatttgaaaaaatggattatgtatagctactcacaaccacataaaattgcttcagagaatttaagcaaacctttttagaagattttatggtacaataacttctgtgtagccaggttatcctttgtataaaatcttatctctaaaattctagttgctattctccatacttccatagttttttaatttttagctgtagatacttggacttaatttcagagagtacaaaggaatgctgtacacaaaaggggcaaatctttgtaattttggattttaagaaatttataagagcatgtattttcttacctttttgagacagggtctcactctgttgcccaggctggaatgcagtaatgtaatcatggcctactgcagccttgacctgcacaggctcaggtgatcctccc

SEQ ID NO: 146733 - DNA, 263 bp, Homo sapiens
caactcctcctcccaggttcaatgcaattctcctgcctcagtctcccaagtagctagacactacagttgtgtgccaccaaacctgggtaatttttaggtagttcatagtagagactgggtttcaccgtgttagccagaatggtctctatcttctgactttatgatccacccgactccacctcagcttcgaaaagtattgggattacagtagttagccatcgtgcctgaccttttaaattttggaactttaggtttacctgaaa

SEQ ID NO: 146734 - DNA, 302 bp, Homo sapiens
ggcccgaattaagagaaagaaggaaggcttcagaacgtttacataatgtcttccttggaattctaacaagggccacagaatctaaaggctctctcttcattccttccttccttcctttttttcttttttctttctttcttttctcttcccctctctccttcctcccttcttcctccctccttcttccttccttccttccttcctttctttctttctctttctttctttcttttttctttctttctctctctctccttctttcccttccttccttccttctttctctttctttctctttcttt

SEQ ID NO: 146735 - DNA, 457 bp, Homo sapiens
ggcccgaattaagagaaagaaggaaggcttcagaacgtttacataatgtcttccttggaattctaacaagggccacagaatctaaaggctctctcttcattccttccttccttcctttttttcttttttctttctttcttttctcttcccctctctccttcctcccttcttcctccctccttcttccttccttccttccttcctttctttcaaagaaagagaaagaaggaaggaacaggaagaaggaacagcaagtacttattgcactcttctttgactgtaatataattgaacagatagatgaatagattttaaaggtgttttggagctttaaacctatatgtatgttgtttatgtatattttttatgatgcttcatgaattaaggccatttaatgaaaggagcaccatgtttctgatatctgactattgctactcttttctttactctgggtgat

SEQ ID NO: 146736 - DNA, 219 bp, Homo sapiens
ggcccgaattaagagaaagaaggaaggcttcagaacgtttacataatgtcttccttggaattctaacaagggccacagaatctaaaggctctctcttcattccttccttccttcctttttctttcgctcaataaatgttcactatataaatgaattttgaaacttctctttggcagtaagtagccttttgtttgtgcctccttctttctctaatcgggc

SEQ ID NO: 146737 - DNA, 153 bp, Homo sapiens
cgcatatgccactctgccctgcagcacaaaagcagccatggacaatgtgtcaatgagtgagggtggctatgttccaaatttgggtttcatgtgattttcacatgtcaagaaatattacttatgctctttttttttttggagacggagtcttgc

SEQ ID NO: 146738 - DNA, 377 bp, Homo sapiens
agtgtattcctgagaagctgggagtactttaagtattggcaaatttgataagatttttattgtatattatggagctttatgtttatagggtaaatattcctaaaaaaatcattatttggcttgctaagcaagtcatgtcagaatctgagctggtggcaaaaacgccatgaaaaatgcccttccccacttcatgtgaagaattgtgttatcatggaagaagccctgaatcacatgttagaagacatagattgcattgctgaaatctaaacatgctctatatcaggggttagcagactaaatctggcccactgcctgtttttgtgcagcttatgatctaagagtggcttttacattttgaaatgattgaaaaaataaaa

SEQ ID NO: 146739 - DNA, 328 bp, Homo sapiens
gtggagatctaaatggcctccaggggtcattaggaaccctcactttttttctgcccaaatttcaagaccatccgtgggggatccttaccctacctctccaataggagtcgcaccctaacccagcaagtccccttcgttctggctgtacatttgggctttccctatttgtgaatggattctcctcttcctccaagacccagctgagatctcatctctgcaaagacttctcagttccctcctgttcaccttctttccctcaacactcaaaacccacccctcattgtccagtgcttgataatgaggctacccccttggtttcatgaattgc

SEQ ID NO: 146740 - DNA, 201 bp, Homo sapiens
agtagatactttataaaatctctaacatggtgtgcatagtaggtgcttcatatcaccatcaattatcactaagtttctgggacacaacttaagctacaaaccaaagctatagcaggtctttgaaaccaaaaaaggagactccataggaaaacacactccaccctgaatttcagtgatgccttttgtaggaaaagcttcagt

SEQ ID NO: 146741 - DNA, 507 bp, Homo sapiens
gaggatcacgatgtccgtagttcagcaggctggtccaggctggtcttgaactactgacctcaggtgatctgccctcctcagcctcctaaaatgctgggattacaggcttgagccatcgtgcctggccgagaattctaaaattaaatagtgcatttttttctcaattaaaaaatcttagggggattggaaatacattttaggtccctctcttttgaatttttctgccctcccctcctttctaggccatatcattagcctctggggagttatcccaaacctaagcacttggcattaacaaacctcaagtgtgggagaggtgatgaataaagctgttaagagtaccggggaagaaattaagagaaactagcctgtgatgtcagtaaatcagagcattatcttgctactagcagaggcatctcaggacctttgatccctgtcctctcgaacatagtagatgcactctgatcttgttttattgttattggaatggactcaactcacttgaca

SEQ ID NO: 146742 - DNA, 247 bp, Homo sapiens
tgcaccggcctccatcccgtttccaccttcccaccctccattcccatcccctaggaacaaagtgtggaggttgatcaggtaagtatgtatcgagcactagcatgaagcttcactccactcattggcatgaaggcactcgacatgattatgtcgagtgccttcatgcctagtcccgggagttccctcttcctcagaaagcagccacgtgttacacactttcccgtggatactggctaccaagagaaaa

SEQ ID NO: 146743 - DNA, 576 bp, Homo sapiens
aggggaattggagatatcaacaaaactaattaagtggattgactgtgtcagtagtgagtacagagatgtcagaaaagctagttgtagcaagtatttaaacacagcctcaagttcattttcagtggtgttgccatcatccacaaacttcaaagaaagtttagccagattaatccaggaaaattcattctcctgggaacatcacattctaaattacttattcattgttaatatcttcatttaaaattttgacttgaacttttttattctttacttgtcctttaagatcacacagacccaagatttgataaggttatcatcttttcagatctcagaaaagtgggaaaatgaattcccttttgaccagaataaagggaagaagaatttaaaattataaaccaggtttactttactcatagatggtcatatattcaacattgcctttttttttattttaaaaaactgcccaagtcataaataaatgcattcttgctttaagaaattcagctaaagcaatagactttcttgaccctctatccccaatcctgctcatctccccagaaggagagcccatttctc

SEQ ID NO: 146744 - DNA, 407 bp, Homo sapiens
gagtagctaattcttctctggatctgagggcattagacttaacctgcgctccacggctcatcccttctggccatactaaacagagaagccatgctacaaccccgggagagagtcgtctcctttggagaagaaggaaaattacagttaatctctacattcccacagcctggcatcgtacttggcacgatatggtgggcagtacatgttgccatgactagagcaaactagccccaactctgtagctaagtccttttatgatcctggatgagttgctgaagctgccttttcttcactttatagcgcaagtcacgctgagttaaacgagtgctgcctgtgtgagtttgggccctctgagaaactgctgctgagacaagattaagcacacaaggattttcacagtggaaact

SEQ ID NO: 146745 - DNA, 178 bp, Homo sapiens
ctctttctccttcattagctgtttggttcataaccccgataggctgttccaagccattatcttgccttttaaaattctctttccctttcctcacaactatttcagcaggtgaggttgaagtcttggagtttaccagctatatgcacttctcttgccttacaccttccttttcatacta

SEQ ID NO: 146746 - DNA, 341 bp, Homo sapiens
acactctagctttgggaacagggcctggtgtgcctgagacgctctagctatgggaacgaggcctggtgtccctgaaacgctctagctataggaacatggcctggtatgcctgagacgctctggctatgggaacagggcctggtgtccctgagacgctctggctatgggaacgtggcctggtgtccctgagacactctggctatgggaacatggcctggtgtgcctgagacactctagctttgggaacagggcctggtgtccctgagacgctctagctatgggaatgggacctggtgtgcctgagacactctacctttgggaacagggcctggtgtccctga

SEQ ID NO: 146747 - DNA, 186 bp, Homo sapiens
caataccaagtctgagtgcttattacaggttaggtagtgtgcttaagatgttgacactcattagctcattcacaaccctataaaataggtattgctataatctctctctgctttccctcttcaccttcctctgcttcctcctccgccgccgccggccgctcctgctgctcctcagacatctccagt

SEQ ID NO: 146748 - DNA, 614 bp, Homo sapiens
aggacttcaaaattcatatgaagtcctaacctccagtaccttagaatatgactttacttaggaataggattatttcaaatgtaattagctaaatgtagtaggatgggcccctaatccaatatgactggtattcttatacaaaaaaggaaatttgggccaggtgcggtggctcacacctgtaatcccagcactttggaaggccgaggtgggaggatcacttgaggccaggagtttgaggctagcctgggcaatgataagaaacctcatctctacaaaaatttttaaaaaattaactaggcatggtggtggtcacctgtggtcccagctactcggggcagctgaggtgagaggattgcatgagcccagaaggttgaggctgcagtaagctgtaatcacaccaccacactccggccagggtgtcatagccagaccctgtctcaaaaaaaaaaaaaaaaaaaagaaaagaaaaaaaggccagggtgaaggggagactgggtgggggtgggaatttgaacccaggcatgggcccaagggaattttgacccacatgaacatgaacatgaaaatagagattagggtgatgcttctacaagccaaggaatgccaaagattgc

SEQ ID NO: 146749 - DNA, 179 bp, Homo sapiens
aatggtcacatgtcgccagaagctgccctattggataggacagctctaaagcaccgacttcgggcaggcctgggccctgctgttccctgccccacaagatgcccagccagggcaggagacggtcacaacacacagggtggaagtcactgccagtgggcactgagagccttgaaagccag

SEQ ID NO: 146750 - DNA, 429 bp, Homo sapiens
gtagaactacaattatattaataaatgcttactgtgccccaggcactgggctaagcacttacaatcattagcacatttaattctcaggacagtcttgggggtaggaattcctggaaatgagctccttgtccaaagctatagagttaccaagcggtgggtggagttgggcttcatgccccaagcctgcgttctaaaccacctcactgtgtgtggagttagcagtgtagggactgtccctccaatacaatctgatggagggaccatccagtgatgttgtcttcttcagggtacaggctaggccgctgtcataaagtaacccagataagatgccttcctcaggacgaagctcatctcttacatgcaagtccacgaggacatccaggctgggatggctgctccgtgatcatccaggccccttctccctcattg

SEQ ID NO: 146751 - DNA, 550 bp, Homo sapiens
ccactgctctgtctttgcagttggagagtctgatgccattctgattcttaaatcttttatacaaaacatgtttttgcttttggcaggaagctttaccttttctttctttcaagtgtcctgaaacttcactgagatgtatcatggtataggtccactttgatccactgtcctggacacttgctaggccttttcagtctcgaagctcatgactttcaggtaagagaaatttacgtctaagacctctttttttttttttaaagcatcccttctctcttaactgagttttttcccggcttctcggagatactatcctcgaattctcgggtaatatgtgactctgctcaaacttcaagactagggaactaaagacggacaggtgtttggaattctggggtaggactggttgaccttcattgtagggtgatcaaactgagatccttttggggggaatcccagattccctcagataggagtcttttactaaaaattacagagagtgctggtgcctctatttccttagtgagtctccgtcgaactggggatcctctag

SEQ ID NO: 146752 - DNA, 615 bp, Homo sapiens
tcggtacactacaggcacataataaatgttagaatgaggataagtgaatagatggatggatgaaagaatcactaagcctctggtctgttctcacatttacttcccagaggccttgctctcagaatcgctatgtcatttacaccaaactttaaaaccaaatgaatcctatgattataataatatcaataaagatcaaaatgagacttagatattgttgatggtgatggtaacgataaaaatcaataatcttctcatgagaatgctgtattcttgcctctcagtaacattgttctctatcagttcccaaacattttggtaagaaagctgttttcttgtttttcatgtgtttttccctataaattcagtaagtttctagatgcccaagctccttctcccaaaggtgtcctagagaccaaacctgaactttgaagccaggggccaaaaactttctctataaaaggccagagaataaatattttaggcactgcaggacgcacagtctctgtcgcacccactcatctctgctgaaagcagccatagacagaaaaacaagttcacaatggctgtattccaataaagctatagttgtggacactgaaatctgaatttcatata

SEQ ID NO: 146753 - DNA, 147 bp, Homo sapiens
ggatgcaccactgttctccagcctgggtgacagctgagactccgtctcaaaaaattaaaaaaaaaaaagattattgcaattcattactccatgtggaaggaggagaggtgtctgagaacagatcaaatgaggaacagatgattaaac

SEQ ID NO: 146754 - DNA, 316 bp, Homo sapiens
ttaagaacagcttgtagggggtgaacaaaaatgaaagaaaaaagaaacaccacatgtagtgtaccgactaattgtaagacacatcctgatttcagaataattaaaatttgaacaattgtgtgccttggaattgaggaaatacactatttctacaggtcggggttggcttcctttttcattgctgctgaggaagctgagatgcaggctccaagcaagaagtcaggagactggggtgctgggcaggtgtttgatctcaaaaagaagtcattgaagtagcatgtggtcaagccaagattattctgggaggtaccgatat

SEQ ID NO: 146755 - DNA, 395 bp, Homo sapiens
ttaagaacagcttgtagggggtgaacaaaaatgaaagaaaaaagaaacaccacatgtagtgtaccgactaattgtaagacacatcctgatttcagaataattaaaatttgaacaattgtgtgccttggaattgaggaaatacactatttctacaggtcggggttggcttcctttttcattgctgctgaggaagctgagatgcaggctccaagcaagaagtcaggagactggggtgctgggcaggtgtttgatctcaaaaagaagtcattgaagtagcatgtggtcaagcctgtgccaggttaggaggtgctggggtgaagcttgccctgcctttaccctctagtgtgtggctgtttatcctgtcaagaggtaacgtgtctcctacagcttcccag

SEQ ID NO: 146756 - DNA, 437 bp, Homo sapiens
gagagtggtaatcctaatttgcaagcccatcttgcacagtaggggtgatgtatataaggcagctggtgcagtgtctaagttaaagttgatgctcaagaaaggctagtggctgaatgccattatgagtggaaactgagcaagtgtggcaaggactgggcaaagaacaggacagagcctgggaagccctaagccactgcttctgggtttaaccaatcactttaagggtgccctgtgggttcagcacctcccagtccacatcttacagcttagtgcctactcagccccttctatctgagttccctggtcatgattaaaccacctgcaaatacgtcctgacaaccttctagatgtcaggccaggactgggcactttaggagaggctgatgtaaaagtgccaactctgcatccagggctggccatgggacttgtcatcacca

SEQ ID NO: 146757 - DNA, 436 bp, Homo sapiens
agagaatctgaaccctttgcctgtgtctatcaatacctttctgttaatcacagtccttcttgtgaaaatgatgtcatggactagcctagaaatgtaaccacctataatattttcattttttggaaaatagttcaaaataattgactttcaaatctgaagactgtacacacttacatgacataaaataaaattacactaaattgttcccagttccaactacccagtacaaccagaaagttttatacttattttacatgaaatttgtttcaaaaaattgtgtctgtttaggcaaatatggtatttccaacaaggtagaaacaaaaagcatctattgtaccatgcaacattatatttgtgttttttacttcaaaaatcaaaactactataagaaatcatcccatatttattcttattttttatattaaaaggaaagatc

SEQ ID NO: 146758 - DNA, 411 bp, Homo sapiens
ccccaagacagcctctgcagggggtgatgcacacccacccatctgtctccccatgcctctgctcccaggactgacctcggcctcctctactggacctcggccagcctctcccatggtggtggcttctcactatttgaccacaacttcctacttttccagccctctcaaactcccacaaaatcagaactattctttgaccgcattgctacttcccgtccccggcctcctccattctcttctcactcctccggcctgccggcctcccttcactccctctgccattggacccacagcttggcctcttcaaccaccctctcattgagaccttaaccacctcgactcctgtccttccatggcacctgccctaatcctcaaccctgagtctgagaaaagcctccattccctgtatcc

SEQ ID NO: 146759 - DNA, 345 bp, Homo sapiens
tattctgaattaagaaatcaatttggagagatgtcatcttgcttcctcaccagccttcctgggtgctctccaggaccgtagtatgaacatacatgcaggtcatcttctatgtccatcagcaaagtttaatatttattttttatttttatttttttgagacaagagtttcattcttgtcgcccaggctggagtgcagtggtgcgatctcggctcactgcaacctctgcctcctgggttcaagcaattctcctgcctcagcctccctagtggctgggactacaggtgcctgccaccacgcccgggtaacttttttgtaattttagtagagatgggtttcaccatatt

SEQ ID NO: 146760 - DNA, 224 bp, Homo sapiens
cttattgaaagattctgtttagcacccctcctttgataccacactggtgggtccaggttccccattcagctgttgacacctgcagggcagagaggtgggatggggtgaagggggtacctcattattgctggcccaggttagaagttcaggcttcccagtagatctctgctgataccaccctggtgccatgtcattccttgagtccaaaagtccctcccaattct

SEQ ID NO: 146761 - DNA, 220 bp, Homo sapiens
ctttgtaaagagactgccatagaaggaggattattatggcaagcatctataccagctcatccctattttttagtttttgttgaagataggataagaaaaaaaagagaagcaaatgcagcaagcaggaattaggttagacatcagaaattttctgataggctgagttgagtgattagaataggttatgaagggaggctgtgcaaattcctatcacgttatt

SEQ ID NO: 146762 - DNA, 149 bp, Homo sapiens
gccaaacatctcctggaggtcaaagttgccctgactcagaaccactgcttcaagctgttcctacaagaagaatattacttatttgttaagattctggccacaatctatgtcagtggaacagaaaccaaaaaaactaacaaacatgaggt

SEQ ID NO: 146763 - DNA, 511 bp, Homo sapiens
tgtggcagccctaaccccttactgggaaggaagggaattccaggcccagaccagatctcactgccctggagtgaggattcctaggttggagctttcatttccccttaattgcaacatgatcctgagccaggtactgtgcttttctgggcctcagtttcttcatctgagatgtggcaggggttggagagatgatcttcaaagagccctcaccatggatgactttgcccctagaaggaaggggggtcagtggttcccttccttgagtcggggcctggggcagcaaggagattccgcttatctcagatccctgggatcagagagagctggaccagcctcttatctggaagcccggggctcccacaagcaagtcacccaagcagttgatcacaagtctccccacaagaaaggggacgagacatggggggaatggaggagggagccttgtccagctgtggaacctaccaaagaccccagactccaagaagttaaacctccaggtctacaggcaggg

SEQ ID NO: 146764 - DNA, 502 bp, Homo sapiens
ccccgccagccggtaggaagtttcccctgagttctcagttttttcttctgaaaaatgaggggttgtatgcaaggttctcctcctggcctgtggtccccagagaagggcaggaaggaaccttagataattctcatatgcatttaacagacgaggaaactgagacccagagccgtcacatcaatacctcatttgatcttcataagagcacctggaggaggggggtggggtgtttgtgtttgtttaaatttttttttgtgaaaaaaatgaagataggcattttgtagacaatctggaagttctggaccggaatccatgatgtagtcagggaagaaatgacccgtgtccagtaaccccaggcctcgagtgtgtggtgtatttttctacataattgtaatcattctatacatacaaattcatgtcttgaccatcatattaatatttggtaagtttctctctctttagagactccacaataaagttttcaacatggtaaggttttcca

SEQ ID NO: 146765 - DNA, 651 bp, Homo sapiens
gaaggtagaaggccacagactttcagatgtagatgtggagatcatttagtcccgacccatcactaacatgaggagactgagactgatgtggtaattaagggaagaggctaaagtaatatttcattcacagccatgaccaagatgctgttcagattaacctgaataatctgatgtttgattctttaaaaatattactggtaccaggctggtcgtggtggttcacgcctgtaatccttgcactttgtgaggccgaggtgggcggatcatgaggtcaagagattgagaccatcctggcaacatggtgaaaccccatctctactaaaaaaaaaaagtacaaaaattagctgggtgtggtggcacgtgcctgtagtcccagctacttgggaggctgaggcaggagaatcgcttgaactcggaaggtggaggttgcagtgagccaagaacatgacactgtactctagcctggtgacagagcgagactccatctcaaaaacaaaaaaattactggtacctggctgggtacggtggcttatgcctgtaatcccagtacttggggaggctgaggcaggtggataacctgaggtcaggagttcgagaccagcctaaccaatatggtgaaaccctgtctctactaaaaaaaaaaaaaaaaaa

SEQ ID NO: 146766 - DNA, 365 bp, Homo sapiens
tgccccgcggctaaggccttcggagaccatagtctccgcggacccctggctggagcccaaagccggccggacctcctccctgcgtctccccttccgcggctcggagaggaaggcaggagagcccccaaatattcccctcccgccccctagggaaactgaagctgaaagagccagcgaaagaaaaaaaaagtctcggagtggggcggcccgagcgacctaagggacggggcagcgccagcgaccgagggaaattagtcggggtgggggaacagggagacaagcccccagaatttaggaaactcctaaattctactaaaaatacaaaaattacctgggcatggtggcgggtgcctgtaatcctagct

SEQ ID NO: 146767 - DNA, 573 bp, Homo sapiens
tgcagtttgaaaaacactgcaataaatattggtaggaggtagaagttttacccttagcccaggctgccagtcctggcttccttccctttgcctctcagctgtgccctgagcctgcttgtgactaagccagacccaggccagctcagctctagctggacagaggagccaccatgtagctgagagcccttttgtagcgcgccgagagctcagccttctctgtgtctctcaggctttccctgcaggagtcatcaggcagcaatgatgtggattctgtctctactgcaaccctcagcccagctatgagaaaggcattcttcccattgctcagatgagaagcctgaggccgatcagggtgaagtgactatggcataaggacaaacaggactggtccgcctgtgaaattcagaatgtgaattaggcaggaaaattggctctctagaaaatactgtggaagtgctgaataggattgataggtggctgtggaaaagaaagtgctagagacacagaaaaccgatacaaaaatgggcagggcggccaggcgcggtggctcacgcctgttatcccagcactttg

SEQ ID NO: 146768 - DNA, 325 bp, Homo sapiens
cagctcactcctctcccccagatttgccaagtcaccaaatgcataaagcatatttctccctcattcacacagggagaggggttgggacgctaggtggaagaccaccaatcaaacacgctaagagtgtgaccttctagcacctccctgacgactttacattggtagttgaaagcctccattggtgaaaactcacctaaaaggaggtttttccatcaagccgtcttgaagccctgcattgacggagctacaacccacaattttatacacaatctagtgggattttgacttcaaagtaaggatcagggtgtctttaaagttttctggg

SEQ ID NO: 146769 - DNA, 98 bp, Homo sapiens
aaggttttctgacttcaaatctaacattatatctattatatcagattacttctcatatggtttgtaattaactttaaaggaaaaaaaaaaggacacag

SEQ ID NO: 146770 - DNA, 107 bp, Homo sapiens
gttttacattgaagatctatgatctattttgaattacacgccaaggggcttttaaaaaaaatctagaaccatttgtttaaaagataacaaaaacaaagtcgacattt

SEQ ID NO: 146771 - DNA, 751 bp, Homo sapiens
ggcaatgatgacacccaaaagagcaagaagcaccaagacagaaatacagactccagcacagattcctttagtggtgttgaccatctgtggactatatgctggggacagttgagtttgattgttattccaaaggccatctgaagactctgtcatggtgtcattcccatctgttgtgaaagagtgcaatggtgagctggtgggttgtgtccttatttctccctgaagtgtcatagggtgggtttctgctggctgaggtgaagatggtgaagtggctactgattgatggttctgcgtgggcaatggcgttggaggaacaaaggtagagaccattgttgtcattggaacacttgttttcattgaaatgctcgttgttgttggaacagtctttgtcgttggaacagttgttgtcgttggaacgcttgttgtcattggaacagtgatgctcgttcaaacagtagtggcggttggaacagttgtgacaattggtgtagtcgtgaccctgggtggcacaatctccaatgatagagtgattttcatgtcattgaaccacccactgtgctcaacatggcaacaatataagccactgtcagacacagctgtattttctatagtcaaagggacatcccttcttgaaaggtcccccaataccttatagtgtgtgtccttccgataggtgacgtgggttccattggtccagacaatgctatttcagcatgtgaataaagaacgtgcgcctctattccagcacatg

SEQ ID NO: 146772 - DNA, 264 bp, Homo sapiens
cacggcacctttgctggccatttctttttaaacgcttgtctctctgaaagctttctcaagttatcctaccgttggagcattccctcctacactggtcatgggtccctccctccaatcccaatagaaggctcacagcagacacagaatgcaaggtgatctgtggatcttacaaaatagtgagaaaaatcatcggtaaataggcaagcgaataagtcagcgtgtaattgtaaattgtgaattgtatcccaagacaagaatcacttt

SEQ ID NO: 146773 - DNA, 691 bp, Homo sapiens
tgtcattgggaatatgccataataaacccttagttatttttgtaattgttgtattaatgtaaagtagctagaacatggcaaactgtagatcagacactagtctcatttcctgaaaaagcaagattaacaatgagcattatattatagcaaagagtattcatgctgttgacaggtattgggctgcattgttaccccaattaagttctctgaaaacactttaaataggatttgacctctggggaaaaaaggaatcaaacaacatgttttggcaaagataacagaatcagttgcctagtctcccaaaatttagtgctgtgctctgcgtggtctttactaagattaagatagtattggattacagaactccctaagagcaggcataaaacaaggatgtccattctcaccgcttctattcattattgtactagagcgcctagccagtacattcaggcaagaaaaataaaaggtttacagattggcaagaaataatactgtctttatttgcagagtatatgatcatctatgtaaaaagccccatagaatctaggaaaaggcaactagaatagtgagttcagcaggggagtaaagtacaagttctatatatgtaatcaatagtatttctaaatgccagcaaaaagctattagaaacatttttttaaaaatactatttactgttatatcaaaaaacaaa

SEQ ID NO: 146774 - DNA, 952 bp, Homo sapiens
ctagacacattcaccctgtcagcgcgtgcagagcagctgtgatggctgcatcgtgttgctggaagcaggccagtgttaccatgttcctgggcgtgcagctgctgagcaggcagcatggaggccgccctggctgcaggggacccttagcctgaggatcctgccccaagttgctgatgccaacagccagcccttgccagatgtcttatgtctgactcttgggtgtttaggcagcataacagtgaaattgataataactatggatatcaattttgagtgtgtaattttaaccagagcaaacctttattgatctcttactctgttctcaggccttctcatgcatcttacttaattctctcagttccccaggaggcagggactaacattatcttctgtgtagaccagtggggagcaactctgtgtgtgtgagtgtatgtgtgtgtgtgtgtgtgtgtgtgtgtgtaggtcattcaggacaagttaaaacacttatgggtgtgtgtgtaggccattcaggacaagttaaaacacttatgggatgtgtttttcactttcagggtgaatacatttttattgacttcttttagggggataaaagtggtattcttgcagatagctgctttctgagtagaatactaatgagacagcataccctgctttgtaggtgtttatacgcaactatctagacattttagagaaccagccaaatggaagcagcttctgatgtctttcacaatggaactagaccatggctatttttcagaggtaggagggcttctgattgtcgtgggatggcacagacattgacaacggggaatgtgaggcttaacctcagtgactgtcctctatacgcttttaacaattctagaataaatcagttcggaaaagatttgcatctctatcaaaatccgggggatgacattgcaccaactggatcagactgggggagaaaggt

SEQ ID NO: 146775 - DNA, 922 bp, Homo sapiens
  misc_feature (892)..(892): n is a, c, g, or t
ctagacacattcaccctgtcagcgcgtgcagagcagctgtgatggctgcatcgtgttgctggaagcaggccagtgttaccatgttcctgggcgtgcagctgctgagcaggcagcatggaggccgccctggctgcaggggacccttagcctgaggatcctgccccaagttgctgatgccaacagccagcccttgccagatgtcttatgtctgactcttgggtgtttaggcagcataacagtgaaattgataataactatggatatcaattttgagtgtgtaattttaaccagagcaaacctttattgatctcttactctgttctcaggccttctcatgcatcttacttaattctctcagttccccaggaggcagggactaacattatcttctgtgtagaccagtggggagcaactctgtgtgtgtgagtgtatgtgtgtgtgtgtgtgtgtgtgtgtgtgtaggtcattcaggacaagttaaaacacttatgggtgtgtgtgtaggccattcaggacaagttaaaacacttatgggatgtgtttttcactttcagggtgaatacatttttattgacttcttttagggggataaaagtggtattcttgcagatagctgctttctgagtagaatactaatgagacagcataccctgctttgtaggtgtttatacgcaactatctagacattttagagaaccagccaaatggaagcagcttctgatgtctttcacaatggaactagaccatggctatttttcagaggtaggagggcttctgattgtcgtgggatggcacagacattgacaacggggaatgtgaggcttaacctcagtgactgtcctctatacgcttttaacaattctagaataaatcagatgtcggccgaaattgntcttttcttttttcttttgaaacaacgtta

SEQ ID NO: 146776 - DNA, 872 bp, Homo sapiens
  misc_feature (842)..(842): n is a, c, g, or t
ctagacacattcaccctgtcagcgcgtgcagagcagctgtgatggctgcatcgtgttgctggaagcaggccagtgttaccatgttcctgggcgtgcagctgctgagcaggcagcatggaggccgccctggctgcaggggacccttagcctgaggatcctgccccaagttgctgatgccaacagccagcccttgccagatgtcttatgtctgactcttgggtgtttaggcagcataacagtgaaattgataataactatggatatcaattttgagtgtgtaattttaaccagagcaaacctttattgatctcttactctgttctcaggccttctcatgcatcttacttaattctctcagttccccaggaggcagggactaacattatcttctgtgtagaccagtggggagcaactctgtgtgtgtgagtgtatgtgtgtgtgtgtgtgtgtgtaggccattcaggacaagttaaaacacttatgggatgtgtttttcactttcagggtgaatacatttttattgacttcttttagggggataaaagtggtattcttgcagatagctgctttctgagtagaatactaatgagacagcataccctgctttgtaggtgtttatacgcaactatctagacattttagagaaccagccaaatggaagcagcttctgatgtctttcacaatggaactagaccatggctatttttcagaggtaggagggcttctgattgtcgtgggatggcacagacattgacaacggggaatgtgaggcttaacctcagtgactgtcctctatacgcttttaacaattctagaataaatcagatgtcggccgaaattgntcttttcttttttcttttgaaacaacgtta

SEQ ID NO: 146777 - DNA, 311 bp, Homo sapiens
gcgtttgttcctgaatctgcccttcaccttccacctaagctcctctctttcctctggtcttttcactgtctctaaattttctccagttcttccttcctgatttcccatcttctgcccctcatccatgcgttcattattgcaaggcatatttacctgtggcctgctgtgtgcccggcactgttctgagcactggggatatggcagagaaggaaacagacagaagtcccagccctcgtggaggttatgctcaagtgtgcagagacagaagataacagacatgtatgtagtgtgttaggcgtggtgagtgcttt

SEQ ID NO: 146778 - DNA, 483 bp, Homo sapiens
caatgatgtagtgttttgttgttggttatcacttttaacagctttcttagtggaccactgtgctcagtaatgtgggatgacttgtaagaagtgacttagtcttattgggggaagaggaaaacaaacgtgattgatttggcaaatgaggattaagcatcctgaggtcaaatactacacaggttgccaaccagcccctattaaacgttgaatgttccatataccataacagctctgaacttaacagaggtgggagaattcacttgtgatcataatgatagttttggataggagtagttttgagtagaactaagaacagtttagataggtagagaagagggggtaaaaacacaggtaagtagagaagtcaggaatagtgattgttttggagcataattattatgtaggagaatagtgaaaactcacagcctaccacttcagaaatgagacttttgtccatgtagtttaatgtctcataaattcttt

SEQ ID NO: 146779 - DNA, 439 bp, Homo sapiens
tatatttatactaagtaggaactttggggtgggttttcccccccaatcaaaagcactattttttcaaagtcctcgtatacatgtaatttttttttcccccttttagttacatgaagaaacctctaggtccaccacctccatcttacacgtgtttccgttgtggtaaacctggacattatattaagaattgcccaacaaatggggtaagttcaaagcagaaactatggtatatcttactttttttcctttggaattgttccttagctatcttatttttcttgggtaatactgccttctgtagacaatggcaaatgagcatggtctctggagccaaatttgccaggcttcaaatcttggttctggcacttggctgagtttgggcaagttacttgatctctataagcctgttttttcttctctaaaatggagataaaatagt

SEQ ID NO: 146780 - DNA, 519 bp, Homo sapiens
tctcccttatattcaaactagatttttattatctaattgaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaagaaaaagtcgatggagaacgtgagagatctcctcgatctgaacctccaattaaaaaagccaacgaggagactccgaagactgacaatactaaatcatcatcttcctctcagaaggatgaaaaaatcactggaacccccagaaaagctcattctagatcagcaaaagagcaccaggaaacaacaccagtctaggaaggaaaaggtgaagaaggcttttccaaagatgtcaaatca

SEQ ID NO: 146781 - DNA, 4735 bp, Homo sapiens
cccacgcgtccgcggacgcgtgggtccgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagagtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaaaaaaaaaaat

SEQ ID NO: 146782 - DNA, 3079 bp, Homo sapiens
  misc_feature (50)..(50): n is a, c, g, or t
  misc_feature (70)..(70): n is a, c, g, or t
catttgggaaagtctgctatgtagctaaggtcactgtgaccacagaacancagatgaaaaggaaaaagcnctgaacagcaagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaaaaaaaaaaat

SEQ ID NO: 146783 - DNA, 2690 bp, Homo sapiens
tgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaaaaaaaaaaat

SEQ ID NO: 146784 - DNA, 1092 bp, Homo sapiens
agctcggtacccggtgtttccctttgtctcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaaaaaaaaaaat

SEQ ID NO: 146785 - DNA, 364 bp, Homo sapiens
tgaatgctgatctagggaagtaggctggttttatgtagtcttttgttgtctttgaagaagggaattgccaaagacaaggttgtaaatagattttgggggtgagccacatttgtgttgatacaatcataatcttaaattgtgtgtcttccttagggcagaataagttttttgttttttttaatgttaaaaggacatttgtgtttaagttagcatttttatatttatcagtgttttataattaatagtaaattcttcattaattaaaaatattttgttattctttttagtacgagctcaactggaggcagtcctgtgcggaaatctgaagaaaaaacagatacaaagcgaactgtgattaaaacga

SEQ ID NO: 146786 - DNA, 410 bp, Homo sapiens
gatatggtgcttgtctaaactaatttggcattgcgctgaattatgtgttcccattatgttatagtagaacatgtagcatgagtactctgccttcttaacaatggtaaaacatgaaaactttcttttacagagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtaagaagtgctgaatcttggaagatgtatattttagaatatttgtatttacttggaatggctcttcccaacctcatatgttttaataataaaataaataatgttga

SEQ ID NO: 146787 - DNA, 5463 bp, Homo sapiens
acagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaaaaaaaaaaat

SEQ ID NO: 146788 - DNA, 4085 bp, Homo sapiens
aaaatacttgccatatccgcacaagtgcccacagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagagtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaaaaaaaaaaat

SEQ ID NO: 146789 - DNA, 5307 bp, Homo sapiens
acagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactgggaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagagtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaaaaaaaaaaat

SEQ ID NO: 146790 - DNA, 5042 bp, Homo sapiens
acagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaaaaaactcaagaaacataaaaagcataagaagcataagaaacatgcaggcactgaagtgcaggaatcaagta

SEQ ID NO: 146791 - DNA, 4847 bp, Homo sapiens
acagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccgtcgtagacagtgagccgtcgtagcagtgaggggatcctcagaacgaccac

SEQ ID NO: 146792 - DNA, 637 bp, Homo sapiens
acagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtaagaagtgctgaatcttggaagatgtatattttagaatatttgtatttacttggaatggctcttcccaacctcatatgttttaataataaaataaataatgttgatgacaagtgttgatcaatgagcattaa

SEQ ID NO: 146793 - DNA, 272 bp, Homo sapiens
atttctaattttgagtaggtctttgccgaatacaagcattttgaattagccagaaaaaaatattcagaatatgacgtaaaattgagctctgatatttcattcttccaaaagttcttttactgtttgatagttttctggacttaactgaaagtgtagtttgtgtcagagtctttagtgattgatgacaggtaaaagttggcagcatgacctggaattttaatggatcatggaggattgactccttgagagaaaaattgtcagatgatgctcag

SEQ ID NO: 146794 - DNA, 422 bp, Homo sapiens
caacgcccatgaagacctaagggaaaacctaaagggaaaaaaaggaaacccaacctaaaagaaaaaaaagataggggaggcaagaggaggcaaagagagacaaaggaagacaccacagagaacaggaaagcaaaagaaaaggagaaaatacaggagaattggtagaagaaattataggtaaaataaatgtgaggaactgaatgtgggaggctacagagtgccaaaagaaattagcttaaatagccaggcaaggtggtgtgtgcctgtagtcccagctactccaggggctgaagtaggagaatcacttgagcccaggagttggagacagggcaacataccaagactctgtctctctgtttttttttttttgagacggagtctcgccctgtcgcccaggctggggtgcaatgacatgatatcgg

SEQ ID NO: 146795 - DNA, 107 bp, Homo sapiens
tgtgtgtgtgtgtgtgtgtgttttaatttttgtattttttaagagcaatgaggcaacactgtcatcatttctcattaaaatgaaaatacaactggggatgttcccca

SEQ ID NO: 146796 - DNA, 205 bp, Homo sapiens
cctgattttcttcgatgtgatattttcttcaaattaatgtaatttgagtaaagacacagaataaaacctgtttttaagacattaaactttctgtgtagactatgcagaaagtaataccagaaatgaatgaggaaattcagagactgcctaaaagtattgttgctgattctgttggcagaatcttttctcttccctttcgaaaaat

SEQ ID NO: 146797 - DNA, 402 bp, Homo sapiens
tattttgttaataaaacatttgtgaagttgccaacattttaaaaataattttagagcatttgggagacaaaacaccacgattcatgtggaaaggcttgcaaagcccatgaagttccttaaatagctatgagacctcctactgtttatgttttatttgtgatcttgtaagacagatttgttgcttcacttcagccttgttgttatttgtgttcacaacaatgtacaggctatataaacttaaatctacctccccagcaaaatatgtattggaggtacgtacttataaaatttttcaatgtataattttcgtcaagggtttttattattgttattatcattgtttggggggactttgtaactagtaacagattacacataaaatcccaaagaaaccaagaattt

SEQ ID NO: 146798 - DNA, 380 bp, Homo sapiens
ttgtacaagtgatttaaactatttgaactgcattttcctccctctcaaaattaatttatgtttattgattacttaccatgtgccaggtgcttttatgcatcatcttatctaattctcatgtgaccccaatgtaactcacagcctccttggacctccctgttgcttttgtgaagccaatctcagtaagttgttgaatccctccccatctcacctccccccgcaaaaaagaacccagaattccatctttaaaatgttgaaaaaagtgtatatttttctgcatattttgggagaagacagaggggagaattacttaacaaaacttcttaaacatacccttttttttttaaccacctcttctctttcctcaaaattcttctttg

SEQ ID NO: 146799 - DNA, 184 bp, Homo sapiens
tggtagctgggctcctggggccagactgcctgggtttaaatctttgttcccttacacttttagctgtgtagccttgggcttcacttaactctctgggactggttccttgtcataggatcgatttgaggctaattaaatgaggtcaagcaggtaagaaggcctgtcatacctagcacatataggg

SEQ ID NO: 146800 - DNA, 342 bp, Homo sapiens
caagagtcagaagctcctgtctccctgtttctgccttttccatgacagcatgctgtttctcaaaggcatcttctcctagaaacaggaggctacaggctagtttttggcatgtttactgatttcattctttccgaatccgtttccatctccatcttccagatctgtaaataaagtctatcccttcaagctatcccttagttttaatttttcccctgtggtttgtagctcctcctggcttgacatcactaggtccactcttggctcccacgggcagctgcccaagactccttctggaatgagagtcctttctttctcctaggcctcattctaccttcattccta

SEQ ID NO: 146801 - DNA, 425 bp, Homo sapiens
tgttgcggggcattttgtacagaatggatgttcgagtccaataagtgcaggaagtctctaacttcccaaggagctgtctcccagagaaagccgttcccactcagaaaccggattataaatgacgtcgggcttccaggaaccgcccgaaagctgctgaactctgaatgcagctgaaaatctgtacatgtgaaatgaaaacagtaaaaatcaatactagttgcaataccagtaatttctgaacagaaaaaataaatggttttatgcatctgactgtggatgctggagagagaaggtagttttcatcagaggaggcctaggggaggagggaggccttctcattccacttcccctgcgtctctctccagcctcagcctctcagcctggaaggaacaccccagtccctcctgcgagccctcctgtctact

SEQ ID NO: 146802 - DNA, 422 bp, Homo sapiens
agatcatgcttggagccgagggatgagagcgcacgcactgtggcagcttttatgtagtggagtttatttttatgcaacttaaagtagcggcagcatctttagtagaatggactcgttaggtttggataatccacactggtgtaacactgatgtgtacattttattaccaaactggggtttcagacatttggggatgcttgaatttatggcagcagctaagattccctgatgagggactgtattgagtttatcaaaattaaataacagatttaggacttttttcttttcttttaaattttaatgtgaaggtgtgtttgggtgactggctatgtactttttcttttcccctttggtctaattgctttaattccttggacaccttcacttatttctcaattattttcttctctaattttgtgtaa

SEQ ID NO: 146803 - DNA, 542 bp, Homo sapiens
gttgggagatttttgaatattgactcaatctcctcactaactacaatatagttctattcaaattttctatttcttagtgatttagtcttaacaagttttgtgtttctagaaatttgtacacttcatctaggttatccaatttattgatgaacaattgttcgtagtatttttttttttaaagagtctcgctctgttgcctaggctggagtacaatggcacaatctgggctcactgtaacctccgcctcctcagttcaagcgattctcatgactcagcctcctgagtagctgggattacaggaacatgcaaccatgtccagctcagtttttgtattttcagtagagacagggtttcaccatgttgcccaggatggtctcaaactcctgagctcaggcaatgcacccaccttggcttcccaaagtgctaggattactggaatgagccactgcgcccgaccaagggaacacttcttaagtctttctgtgaggccagcattaccctgataccaaagcgagacaaagacagtacaagaaaactacaaa

SEQ ID NO: 146804 - DNA, 304 bp, Homo sapiens
taaatgattactgcatcagctagcagctccggaatggccatttggccctgtagaaagatcattcttgggcaggctgttgatgtggagagtgagaggagcagctgttctttcacctgaggccccatctgggtagcagatggtccccagctaggcacaagccctgtgtagggacatccgtgctgcccaggatcctgggacactgcccaaatcaactgtcaggctgggagcctgtgtccagaactgtggatggcattcactttgggttgtggaagttggtttgtacctactcttaagtcttgcccct

SEQ ID NO: 146805 - DNA, 285 bp, Homo sapiens
cctttcatgaacatggtacaggatgtatggatgcaagaaagataaatatttctatctttcagaaagcagtaaataagtttaactttttcttttattaagcctaactaaaattctttatatgtaccaatttatagtacaagaaaaacagaatttagtgagtttaacaagcattaaatggtcatttctatagcattaaaagcaaaaatccccaaggccagcaacatctgggtataggtttgcaaacatcttgttttgggtcacctttatgggatactgaggacattc

SEQ ID NO: 146806 - DNA, 220 bp, Homo sapiens
cttcaaggaccaggtcttgccggctgaagtttgaagctcccactgatgccctccaggcagaggcctgaggccatctgagaacaatcttgaagaggggaccccagctttgggtgggaggctgggttggaaggctgtaaggtccttcctgtgctaagattctctctgccaagtctccagtgacagggagcttgttcctttgtaaggagcttgttccatgttg

SEQ ID NO: 146807 - DNA, 326 bp, Homo sapiens
cactcttgttttatgtgggaacctctctctcttacagctttgttttttaaccattcatgggctctcatgagtacactggtggggatttgtgagggaaggaatccaaaaaggtccttcaatccagcctgctgcctcttggcagaaccacacttctcagggatctggggctgaggcgagtcagacggcgggtgcagagcagcacggtgcccccttcctcaagtgggaggcttgagaacctgctggctgccccagtcggccgcacggaggggagagggcatgggaactgcacatagctataggatcaggctcaggcatctggggtgcgg

SEQ ID NO: 146808 - DNA, 430 bp, Homo sapiens
gcaagaatagaaaaaaagaacagaagttttaaaagtatgtatatacatttaactaatgcttaagaaagagggtaaatatttctatctcaattagattgatatgatattaaatgacatatgaaaaaagatgtgaaagtatttactaaaactattaataatatacaactaaccagtgtttatataatggtttttattatatatagggcttagctgttacctttattcacataatgcagtaaaacttcatgaactagtataaagggacttattttgaatatccccattttttaaaaatgtgcatactagtgttgccttccacctagatttcaaaaagactgtatgaaagacactgtcaggaagaatatatacttaaaatgactattttttatcataatcataattttattaaaatctgcattgaaaaacatgt

SEQ ID NO: 146809 - DNA, 263 bp, Homo sapiens
  misc_feature (15)..(15): n is a, c, g, or t
cgatctagaggatcncgtcattaggtcatggacaagacccatgctgtgtcagtttgctaatgccccaatttccctttatgttcaaagaagctggcaaaccctgagaaattctatggcttgcaaatattaccctcagacaataaaacaccctttctaaagttgttgtagaataacagctaagagttagataattcttcgtaagtggtaggaatgtaaagtacctgtcctatgaaatttacatctattaatgcatttaaatgtca

SEQ ID NO: 146810 - DNA, 681 bp, Homo sapiens
ggtggtgcatgtttgtggtctcagctacttgggaggctgagttgggaggactgcttgaacccaggaggttgaggctgcagtgagttgtgatggcaccactgcactccatcctgggtgatagagcgagatctcatcttaagaaaaccaaagtagggccaggcgcggtggctcactcctgtaatcccagcacttcgggaggccgaagtgggcagatcacaggtcaggagttcgagactagcctgaccaacatggtgaaaccccgtctctgctaaaaatacaaaaattagctgggcatggtagcacgaacctgtaatcccagctactcaggaggccgaggcaggagaatcgcttgaacctgggaggtggaagttgcagtgagccgagatcatgccactgtaccccagcctgggtgacagagctagactctgtctcaagaaaaaaaaagaaaaaacaaaaccaaagtagatttatattggcttacagaaatgtaaacctatatcatcaacaagattaaaaataagtaaaaaaattgatgcaaagggaaaacgtaggaaaaataagtcgaagccaagcgagataagatttaggactaaaaggaatggcgtaagatctgtgcacctggtagagaagggccacagatttgactctgaacttgttggcagccattgtaaaaagaaaaaa

SEQ ID NO: 146811 - DNA, 185 bp, Homo sapiens
tttacatgtcttaaaatttttttggggttctctccacatacgttttaatcgtagtgtttataattaaaaggtattttatatttattttagtgaccttaatagcttatgctctgatttcacaaaggttttacttggaagctcaatattcttgtaaaaacaaatgcatcatcaaaaatgtgagtcct

SEQ ID NO: 146812 - DNA, 285 bp, Homo sapiens
atggtttaaactcaagcccctgttctttagactaagttcccctttttaatactatttctcatagaacatttcagacagacacgaaagtagagagaatacggaaatgagtttcctcgcgccagtccctcagacgcaagcaccagtcgagtttcttgacttcctttttaagcattaaacttcactggtggtgaaaaagagctttttaagcccacgccttcctcatgggttttgtttggttttgcttttctatagcccagcatgccctgaggtgctgcacggtggaag

SEQ ID NO: 146813 - DNA, 450 bp, Homo sapiens
tgtttttaagagtgacaaaatactatatggtatcctggtaataaaggttttcctaaactttcctaatacagtttcaggaaaaggggcagttcacatagtcatagaagtagaagtagaaattgacctaactttcctggatggaaatttagcaataactttctacaatgtaaatgtacatactctgagactttgcaagtccacttctatgagtctattctataaagaaacctcacatataaccaaggcacatcttcgcatataatagtgaaaaactggaaccaacctaaatttttcatcagtttcaataggagaatgatactataatacatctacactgaaataccagttgctgtcaggcagaatgaaaaacaatctatatgttttgtcgcagaaatgtttcctgaaaaaagcaagccacatgtgaatatgaataatatgactccagttttg

SEQ ID NO: 146814 - DNA, 472 bp, Homo sapiens
tctagaggatcttcggtatgagtggccactgtgacatcaaagccaaagaaatcaagaaacaaacctagaggaatcctgcaaagagccctaagtggattttaatttatgtttagagtttgactttcaagattattttcatcaggaaacatttgggttggtttaggttcagttgaaaaggcagtcacagagttgtttaaaaaaaatgggatttggaatctgacagatgtgagagtcattcctagctgtgttacatttaccaaatctctgccggtttgaatttgtttccctgtctataaggtggaaataataagacccgttttatcacctcacatagcggagtcttaaaggaaagaagggaaatgaaaactatttatgacatatcaaaagttgtgtttgctgtcctgattgacgatcctctcatttacacttacacagccaggatgaaaataagtttcatttcacaggccacgta

SEQ ID NO: 146815 - DNA, 165 bp, Homo sapiens
tatcctcaaatggaatagccatgttttctccagagttctatctagttgcatctgaccagctctttttcctttcatttctggcagacctggtgtctgagggctcctcattcttctacagctgtgtgtgtccatcagagccatagcctcagagccagagggtcacgg

SEQ ID NO: 146816 - DNA, 298 bp, Homo sapiens
tgcagctgtcctgtgttgctggggtcactctgcaaggtgatctcccagctcccattttcccatttgggaaggaggacccaagtccctgtggctttgggttcccaaaactctctgtagttttctattcccacccccaggtggttctaccctgggctgggtatgggggaggctgcatgaggtgaaggaaaaagttccacactggaaactttagtccctccgtgccagtctcccctcctccctcagctctcaaagggattaacccttgtcatggctgaaattgtggctcccctccaccaaa

SEQ ID NO: 146817 - DNA, 363 bp, Homo sapiens
tattcgtcccacgtcggtcccatcgcacttcctccttcaagtgccatactctgttttttgctccagcctttagacatgttgttcttcctccttagaacccagctcctctctctgcactgtctggctacctttccctcattcttgaaatctcagcttagagtctcttcctcacgaagcccttggactagggactatgttatttgctaccttttctgggttcccatagcaccccattcttccccttgtataatacttcacaacccctttcctggcccagcgataggagggactgccctctttccagtatgtggcatctagtgaatgggcaatacatacgggcattccccctgacgcatgcttatg

SEQ ID NO: 146818 - DNA, 290 bp, Homo sapiens
atgtgattttaaaaaaatgtgcagtagtctgtgaaagaaaagactcaggactggggggtcagaggaattaaattttctgacagctctgcaggtaaccaactggatcaatttgttcatgacactaatattaccagtaaagcacagagttgaatgaactacatgacttttttttttttttttgagacagggtttttgctctgtggcccaggcgtgaattgcggtgccttgattcttggctcacagcaaaggtgggcctcctgggctcaagcaatcttcccatctcagttctc

SEQ ID NO: 146819 - DNA, 780 bp, Homo sapiens
ctgggattacagatctcagccagtgcacctggctatttctccactgactgttttccagaagtatgtagaagatttttccctgctggtgacatctctcatgctctatgtggtgttatgtcttttttttctttccaattctcactttaacagagtcccagaggagaggacatatatgcttgtttagtttgccttctttcgctggaagctttaaaataagttttaagactgggtacagttggcttatgcctataatcccagcagtttgggaggccaaagtgggaggatagcttgagatcgggagctctagaccatcctgggcaatatagtgagaccctgactctataaaaaatttaaaaattagccccgtgtgatagtggacacctttagtcccagctactcaggtggctgagttgggatgatcccttgagctcaggagttcaaggctgccgtgagctataagtgtgccactgcactctagcctacatgacagggtgagaccctgtctcaaaaataaacaaataaacaaaataaaatataattatgttttaaaataaaataacataatgtcttaacagtagattttgacatatctccatgctagctggcatctcgtcatctttaagggctgcatagtattctgcagtatgactgtactataatacgtgtcgtcattccccagttaagtggttttaaatgtattgctgttatcaacagggctccagtgagcattcttgtacatatatctttgcacacacatacaagcatttcctcaggataaat

SEQ ID NO: 146820 - DNA, 327 bp, Homo sapiens
cagttaaagaaaatgctcattggagcatttcagattagggatgctgaactaactgataagtataatgcacatatgccaaaatttaaaaaaaaaaatccaaaatactagaaatggaaatgtgtatatgtgtcacaaaagtcatgcacaagaatgttcataataggccggctgcggtggcttcacgcctgtaattccagcactttgggaggccgaggcgggtggatcacctgaggttcaggagtttgagaccagcctggccaacatggtgaaaccttgtctctagtaaaaatacaaaaattagtcaggcgtggtgggcacctgtaaacc

SEQ ID NO: 146821 - DNA, 195 bp, Homo sapiens
agtaagagtacatttcaattcaatatatgatatcataaaaattggttataacatcataaatagaacaaaatgcaaatagcttagaacaccataaaattggactcttttagtatacagaagtattagtatctatccatgaacacagtccttctccaaacgttctttttttttttttttttttttttttcaacagaa

SEQ ID NO: 146822 - DNA, 135 bp, Homo sapiens
tctttagggccttcagaattttggctaaaggctatactagtggaggtactaagacctgacacctggagcctttattaaggatgttagaatccactcccatgacaacatcccagctttgccaatttgcctcatgtg

SEQ ID NO: 146823 - DNA, 322 bp, Homo sapiens
cctatgtaaggaacctggacattctgcacatgtatcccattttttagaagaaatcaaacaaacaaacaaaaaactcatttccttgtaaattgctcagtctcaggtagttctttatagtaatgtaagaaaagactaacatcaaaggtcactattcacagtgcagtactggagtgaaatgtgttaagaaaaagatttcctaaacttggaaatagccatattggagaaatgtgcaacagatccatcattgatgatttaattatttaaggctgttaactttgatttaacgctattgattgggatatttacaactctatgcatagat

SEQ ID NO: 146824 - DNA, 164 bp, Homo sapiens
gtacctggaaagaaagtcagtcatcagcccattacattgccctgagataggaacacatttctaagaaactgtaaaagcagtttacagcaaactagggataaattttcatcccaaattagtttctacttagtttcaagtccagggtaggcaaacaagcctgtggg

SEQ ID NO: 146825 - DNA, 528 bp, Homo sapiens
ctcctgacctcgtcatctgccttcctcggcctcccaaagtgctgggattacaggcgtgagccaccgcgcccagctttctttacaaagctgaatgttgataattgaaatagagactagtctgaaatgtacttctgttccacttgtgtaaaaagggtttcctaaatgaattaatggcacaagggagatgatctgcttcagagaataaactttgcaagtcacttcagttcttccgatggggtgctgattaatattcaaatgttatgttgagaaaggactgattttcagatctttgtgacctagaatcacttcccctatggtgcattttacacattgtgtggttgtagtatgtcaaatccttttttatttggagctcatgttatttagattgagtctatggtgaggttgtatgtaatgcatgatgccaacagcgctgggagagaaatgctgtctttatctcagtacctgtttatcttgagttgaaagtttgttacttgtaggtggattgtactctgtactgtgcttttgtct

SEQ ID NO: 146826 - DNA, 303 bp, Homo sapiens
gggcaggtgtatacgggagtgagcatgtgggtggaccgatacacactggggaatgagtgaagggggaggagtagaaatatatggatgagagatttctgggggtcaccatgtgtaaccagagatcaaagcaaatcttggggatatgatattataatgtagattgagtctatggtgaggttgtatgtaatgcatgatgccaacagcgctgggagagaaatgctgtctttatctcagtacctgtttatcttgagttgaaagtttgttacttgtaggtggattgtactctgtactgtgcttttgtct

SEQ ID NO: 146827 - DNA, 841 bp, Homo sapiens
taatatttcattatgtgtttagctcagaagtacaactgccggattgcaggatatactaaatagttttccaaggcttcctttaccaccctctgctcctgtatctaatttccgctctacaatgagggtaaaattatatcccattgtggttttaatttgcatcttcatgattaccagtgaggagcttttcatgtattatttagctattcatgtttcctttcatgtagaataactgctcttgtttttgcctatatttatagaagtttttgtatgttctgaataatcttttttaggtcatatgtgtggcacatattttatcctagtttttgtcttctctttttatttgcaatgtattgtcttatgataagcaaaagtttataattttaatgcatagagcttttaatataattgttttcacattttctgatgtgcttaagaaatcctcaatgctgtggtcatgaagttattctcattttttttcctaaaaaatttaaggagttgtttttcacatttcagtgtttatttggagaatgtgtgtgtatgtgtgagcaggtgtgtggtaggaggcaggaatccaatttccctttttccaacatgagtcctagtaccccttgtcaaatatgccccattaatgtgcaatgacaactctgtcgtatatgagttgccatatgtgtttgggtgtgtctgagttcccaaatcaattccatttgtctttttcttccatatccataataatgtgccgttttcattattacaactttattataggtcttaatatacagaatgggcaagtcacactacttgttcatcaggaaatcttaactattttccttttatcttccat

SEQ ID NO: 146828 - DNA, 461 bp, Homo sapiens
gggtagaaagggaatcggactgatagaggcagggagggagtgttggtcagaagttctgaactcaatttctggctttgttacttaaggtagaagacttactctctctagaaattagcttcctttttttatataatgagatagagctgagcagaacttatcaccttatctcctctacctgctcttttcctgttgttccctatttctttaaatggcaccatgacccagttaacaagtcagaaatctgagagtcagctttgacttctcctttaccctctgcattgattactcaccagttcatgctaatttcacctcttgaatttcccttgatctgctctgttctttctatcttcttggcaattagactaagcttaactccctccttctttcccctagtgactggactgtccatgcgaagagccacttcactacccacaggcttcctcctcaccctcccctctcaa

SEQ ID NO: 146829 - DNA, 590 bp, Homo sapiens
cagttacaacagctgttgagctgcagaggaactatttgtggtgggcaaattgtgcttcagagactattaaagatgcttcatgagagttgggggcatgggatgggaggtcccctagcttactgtcaggtgtcttactcctcaaggctcaggcctcaggtcagcttgtctgtcttcaggaacaagagcctgaaaacttcccaaatggcctagaggagtggagttgtaagcggcacagccttggccccaccctgccccaggcagagtgtctggcaggcattggggctggcgagtccactccaacagaggagcagctggaatgacccttctcaaagatctgcctcctcccaccctgactatcgcaaatgctgtgctctctagagctctgctcacaagactgtagggtcgagagtggcagttccaggcctcagcaagaaagcctttgcatgtggctgcaccagggagaggagaggcccagtagagccactgtaaacccaagccagctgcaagggcgtggcctatgggcacatttcccagggcacagctacaggaggcagtgctgaggcagaagaaggcccagaggtggatggacc

SEQ ID NO: 146830 - DNA, 324 bp, Homo sapiens
ttgtaaacaaagatctgatacaagcagccaacaaacatgaaaaaaatgctcaagggtcaggtgtggtggcttatgccagtaatcccagccctgtgggaggctgaggtgggagggtcaccagaagtcaggagctcaagaccagcctaggcaacacagcgagacctctgtctctacaaaaattttaaaccattagctgggcatggtggcacatgcccgcagtcccagctactcagaagctaaggcagaagggttgcttgagttcaaggctgcagtgagctacaattacatcatggcactccagcctggatgacacagtgagacccc

SEQ ID NO: 146831 - DNA, 453 bp, Homo sapiens
aacatcttgaacttctggacccctccccacaaagtaaagattggagtccatgccattgagttacttagtaatgtttttctgaagcgcctcccatgtaaccagaactatagggaggataaaagaaatatagcacctggttgataggaacttactgcatgttaaggagataagatgaatcctatggcttatcttagccaaacttaacatttgtgtccctcttttatattatttttctgtctcaaataagtgctgtagcattcaggcttgacggaaaagatagactttgttaaagaaaagtgcagaccatctttttggtttctgtagaatttgtgtggctctcaagtcactcagtgcccttcagaataggcagctatggacatggggggctttgtgaactgtcatctgcctgtgtcagtgagccttgctttggtatcaggcaaagggcccatcagt

SEQ ID NO: 146832 - DNA, 587 bp, Homo sapiens
aagagagaatgctaagtgccacagggtccctgaaataggtcccagaaatacagaaaggtaacctttgctcctgacctgaacaaagctgtacttcgtagctgtaagttctatgagattccctgtatccttcaggtaaactaaattcttgtttggactaaattaagagggtttctgtttctgacaactgagatttcttggccaagacattgatcaaatgtgtgcaatgacattatatttatgctccatatttttacacagaccaaaagttccttgagatcaacattgtaattttagctcattgattgactcgctaggtgatcttgagcaaaatatctctagttctttactattctgtattactgtccttaaacacgaacaaaattctatcactatgctttgacacaggtcagaagttaggagaaatgctgaagctacttgagaaataggcatactgcgcataattcaaggatgttactaagcagatgctagcttgggggcattcacagcagttctggcaactttaaatagctaatacagcttctgaggctgcccagctactgacacaacagggcttatccactgggagg

SEQ ID NO: 146833 - DNA, 123 bp, Homo sapiens
ggccactgattgactttttaaagtaaactttcaactcattgttttgctttcctgtctgtaaacataaaactgccagatgcaatttaatgtagagcctggactctgtaattccacagttttact

SEQ ID NO: 146834 - DNA, 256 bp, Homo sapiens
ctcctctctggcccaccccagggtgtttatggggcaagatggagcatggggtaccggccaggccctggagacagactgcctgggtttcagtctagtcctgtcatttactagctgggtgacttcacctctctctgcctcctttccccacccataaggtagaaacaatcacagtccctgcttcacagggaacttgtcaccattaagtcattattagcacttcaaaggcattaacaacagtccctggcacttaggaagt

SEQ ID NO: 146835 - DNA, 348 bp, Homo sapiens
gatactttactcattaccaaaaaattaaaagtattttagtacaaataattatgaaaataattactcttaactaaaggttgaatagttaattcattaggattttgtgaccagttttgaggctttggttacttcctttctgtttttttaagcgaaatattcttttttccctctgagatgcctgttataccatcagggatttttaaaataaagatttttttaatgattatccttgatttctttttttagaataaatttggtggagggcagctaaaactctagatagagactgcctacctgcttatagacagaaaatcaaacatcatttttgatgaaactcagctgatttca

SEQ ID NO: 146836 - DNA, 188 bp, Homo sapiens
atgatgttatggtgatttatatacttatctcacccttaagcttagaagttccttgtaggagggtttctatcttacttttttttttttggaaatagagtctggctcttgtctccatgccgataaattaaataggtcttcctaggaagcagtattcagccaaccacctctttctcaaacatcataaggta

SEQ ID NO: 146837 - DNA, 429 bp, Homo sapiens
gaacacagaggcagcagcccatggcagcgatgagagctatgcctcacctcctctgtgcctctcacagccatgccctccagacaagagctggaaaggcaggtggaaatttgacatgtatggacatatggaggtactggcattgtgtgtcattttttccttccattttggttttgagtagtggtgtgataagtgacagcttactacaggtgaaccctttctagttcttcaaaacccagtagaggtgttccctctcccagaaacctgatcctagggcgagaattcccttttcttcctctaggcttatggcatccttggcttgtgcctgggtgtggcaggtggcacctaggttcctggagaagctgaggaacccctccactgagggcccacaactgacccgtggtgcatcacctctaccgccccagtgcacag

SEQ ID NO: 146838 - DNA, 438 bp, Homo sapiens
cgactaggcagcctatggttttcagtattcccttaaatactaagctaaaagagaaggctttccccttcttttagtgtcaaagccacagtatagcatggtagcctctggttatggtcatgagtcctaaggcagaaaacaaggccttgggcagaacaaaggccctggggcataggtaaaaaaattttttaaaagttgatgggaaatcctctacctaagaagacagacgtctggtgtttggcacagtattggcccaggaggtgattaacaaccgcttctgaacaaatgtggagctagaaagaatttcagcttttatgggtcaccctctccctgctctgcttccagccttacccttttatttgttcttttgggaccatcattattcctaaaaatatgagggcatttttaaaaagtctattatttggtagggaaaagagatca

SEQ ID NO: 146839 - DNA, 433 bp, Homo sapiens
actaattattccactcaagaagctagaaaaaaacaaccaaaacaaagcagaataattactacaaataaaaccagaaattaatgaaatggaaaacaaaagatttgataaagtattaataagtaagtaaatatgacttttggaaagaccagctctacctagtttggtagacattctttggcagatatgactaagaaaaaggctaaataaataaatacattaagaaataaggaaggggatttaaccatagattctaaggagatgaaaaaaaagttattataagaaaatattggggccaggcgcagtggctcacgcctgtaatcccagcactttgggaggctgaagcaggcagatcacgaggtcaggagatcgagaccatcctggctaacacagtgaaaccccgtctctactaaaaatacaaaaaattagtcaggca

SEQ ID NO: 146840 - DNA, 401 bp, Homo sapiens
tctgacctccctgcccaaattcctttgtattggacgcaataatgagcctctcaggcaagacaattttcccagaacttcaatgtctatttctgtccgattagtgccaagtcctgaagaaggctgccaattaattcagagatgctataccaaagctggtcctctcctattcttgatcacgggatatacagatcaagcaacaatctccaggcttggtaggatggacactccctggaatacgtgatctctctaacactaaccctgactggctgagacagccctcttaccaaagagacagcagatactctgtgactggccccttgagggagccattaccaccatcatcactgcaacaaatgaaaacactttagtttaggtcagtctaggcctgaaaaccaggaaga

SEQ ID NO: 146841 - DNA, 700 bp, Homo sapiens
gccctagtgtgtgctgttcccctctgtgtccatgtgttctcatcatttagctcccacttagaagtgagaacggatggcatttgtttttctgtttctgcattagtttgctaaggataatgacttccagctccagccatgcctctgcaaaggacataatctcattcttttttatgagctcaagcttcgtagtagggaaaacaccggatattcagtctaaactaacattaaggtagggtatccaagataaaatgttttttctttgaaaaccactgaatatactttatggtagctttaccttgtttggctccagaggtttgcaaataagaatctattatttatatatatatattggtaaaagacaaaatattttttaaaaagtgatcttgagtcttctaaacattaaattggaagataaagtgccattttagagattacatagagacttggccctgtcattgattttaaaaatgaccttctcattgcactgatttttactccatgttaaagttagtattttatttatacattaaattagatttagagattagtaaataatgcttatatcaaggatggtgctttttaagctaattaggtaaaaattagggcagtgttttataatctactttaataaatgagtcttaccttagaattaatctattaaaaattaaaaaagaaaaattgaactacttctgagatagat

SEQ ID NO: 146842 - DNA, 156 bp, Homo sapiens
ctgctcctcttcctgccactcttcctccccctcctcctgttcctcttcctgccactctttcccctcctcctgctcctattcctgccactcttcctcctcctcctcctgctcctcttcccgccactcttcctccccctcctcctgctcctcttcccg

SEQ ID NO: 146843 - DNA, 590 bp, Homo sapiens
tccaccccatgtgtgccaagtgcatttgagccagcttgattattatttctcaaaaggcttccttattcctggatgaccgttacttgggcagcactaactcttctccactcctgctctcccatttaattgtccatggcagcctcagactccccgtttgattcatcagtccatcaactcccaaggattcttgagcaccagtcaaaggcgatcaatctgtggatgaggatgcagtccatggcgggaagttacagccaataaagggcagctgaagcactcatcaaaaatttaataatttgtggttcaaattagactgtgccaagaacttcaagaattaagaaatggggtaatgtagctgtggaggtcccagcgagaaaataatcaaattggtctttgggagacaggaagtcttttgaaaacagaaggaaaggaagaagagaattctggaagaaaacaaaacccatgagaagcaataactaacagcctgagcaacatggggaaaccctgtctacaccaaagatacaaaaaattagccgggcgtcgtggcatacacctgtggtcccagctactttgggggctgaggcaagaggatc

SEQ ID NO: 146844 - DNA, 312 bp, Homo sapiens
tggcatatcaggaaagcaactcagctttcatctgttagctatctgagttttcttattctctaagggtttgctattccataaccaaagggagaatatctgcattcacaggagagaagctatccaaattctaaaatgtgctcatttctggtatttagaaataagagaggttttgaagttatctccaaactgtgattcccaaatgatttcttctgagatttggtatctagattatccttttaaagtaagttgctttgtggtttgccttctgattattacatctgtatatctatcactgattcagccaaaacacag

SEQ ID NO: 146845 - DNA, 246 bp, Homo sapiens
aaaaagatatcattcatttcttttcaatggcacgcattgttatttgatggaaggaagaactgttggggatttggatagttaaagaagttcacatttttgctcttagaaggagtcttgctttgggtcagacagtcctctaccatttgaagttgacgtctaagaagatgagaactcaactttataaagtctcctcttgttttgagacaaaaggaaaaatagaggaaaaaccggaaagtccagctcaga

SEQ ID NO: 146846 - DNA, 385 bp, Homo sapiens
caaccccctcccctcagtctcacaccctggggctttgtactggcagcgtagagccccctgagctccaagcacagggcccagtccctgacaggcattccaggaacctcggtggaatcaataaagtgatttctagccaggcgggcatgtccatcaccagaaggttcgattccctttgtacacaccagggggcacagcaggagctgtgagaaactgctcccaattgtttgaattattgcctcaatgaggctactttgtggtaaaacaaaagaaaacaaaacgaaaatgcaagatggagacttgaaatttaaaagctgtgtgaactcacgtgtgtgttgtgagtgcctatagcttactggaatcatcatcttcatcaacatgattatat

SEQ ID NO: 146847 - DNA, 624 bp, Homo sapiens
gtagctataggcagccatgtttcccatcatgaggtctagaaagacacaggcagcccacctgtaaagaaaaatgtggcaagtcacagagaggaggaggtgtgaaagctgagagacagaacttccaggctgctccacggtgctcagggtctatgttcagcatgaccctcaggcacggctgtgagattccccaatgttcttacaatcaattcccccctgcctttttttctgtatcctaacactgacagacttctatagattatgacagttctgactggaaaaagggacaggtcagataaactttcagaaagagacctggcagcactgtagagaacaggcttgaagtccaaagaccagagacacttaacagagaaggcaggaagcttttatacttcataatatttcaaggtcatgagtgtgccctttcctctttctggaaggaccaactttcatacattgaatttttaatctctatctgagctattacagaacagtgcacagcagctgtgttgatttataattgattggccaatcttaattttactctagtgaaatatgaaacagctaagaaataagcctttaaaaaattcctcttaagctccataatgcagaagctggctctgtctc

SEQ ID NO: 146848 - DNA, 372 bp, Homo sapiens
ttcaagaccagtttgagcaacttggtgaaaccccatctctaccaaaaatacaaaaaagttggctagtcatggtgatgtgcacctggggttgctcagggggctgaggcaggaggattgcttgagcccaggaggtagaggttgcagtgagccgagatctcgccattgcactacagcctgggtgacagagtgagaccccatctcaaaaaatcaatcaatcaataaatcaatacatagaagatgtgcattggatcagccccaaaaggcgagatatcttgaagcttacaggttataggtgggtttagggattctttagttggcagttggttgaaagagttgagctttgcctaaaaactgggagtcagtagaaaggaa

SEQ ID NO: 146849 - DNA, 210 bp, Homo sapiens
ggggagaaggtgggtgtcaggaaacatcccaacgccagtattcgggatgccgggagagaacagggggcacacatccaatgttgtatttcaacaagtcacaggacttttgagtcagctctgaactggtttgaccacagagaaaggatgactcttatgcctagaaggtgagtgaactatcacttattttgctggaaaaaaagtgggggaggg

SEQ ID NO: 146850 - DNA, 297 bp, Homo sapiens
  misc_feature (269)..(269): n is a, c, g, or t
tgaaaattattccgtccatctgagaaggtcaataaattccaaataggctgggcacagtggctctcacttgtaaacccagtactttgggaagctgagattggaggattgcttgagtccaggagttcaggagaagcatgggcaacatagcgagaccccatctctaaaaaaaaaaaaaaaaaaaatttagctgggcatggtggtgcattcctgtagtcccagataatttttgtatttttagtagagatggggtttcaccatgttggccaggntagtctcgatctcttgacctaatgttcc

SEQ ID NO: 146851 - DNA, 148 bp, Homo sapiens
tgcatatcagtaaaaatgagtgccatgaaggaaaaagtacatagtgttatgaaaatcaccataggaggatttaatttagaatttgggggaaaagaaagtctgttttgataaagaaatttaggtccctctccctctcccgctcccgctc

SEQ ID NO: 146852 - DNA, 367 bp, Homo sapiens
cattcaagggcttgctggcttccaacttgctacttactgcattgaaaaatattccacacgatggaagaactattttccaaaacaaaatgctagtattcatcaggaggcgcgggttgtgcagtgtgaacaattcactttcgttaagtaccatatggccgctggtaggaaaacgctaacatgtttcaacagtacagctgggggagggctcctttattcaccgtgcagatggctctaattgacatctctcctaaaacaggtctccagcatttctgcaggatcattagagtaattagttattaaataccatcaccacttttagagagggggtctgatccttggcaacattccagcgtgatggaactgacag

SEQ ID NO: 146853 - DNA, 370 bp, Homo sapiens
ctgggattacaggcacgcaccaccatgcccaaataatttttgtatttttagtagaaacagggtttcaccatgttggccaggatggtctcaaactcctgacctcaagcgatctgcccacctcggcctcccattttgctaagcccgtgaaggtaaacctctgtgttttcttctaagcattttatagttttagctcttacatttaggtctgtgatccactttgaattagtttttgtatatggtgtaaggaaggtgtccaacctgattctttgcaggtagatatccaattatttcagtatcatatgttaaaaagacttctttctacaatgtttgtcttcacccttgtcaaaaatcaattgactataaatgttaa

SEQ ID NO: 146854 - DNA, 227 bp, Homo sapiens
taatacaactaaaattcacattatagatttgatatattcagcatgtatcttaagtactactggccagtcagaactattgatgaaatttaggggtataatattaagaagagattaattgacatgttttattgaacacctggcttgtgccttgttctctgcaagcataaaggtgaatataaaagaaacatgaacctcgctttgctcttacggagtttaccatcccagct

SEQ ID NO: 146855 - DNA, 340 bp, Homo sapiens
cctggtactgctggttcagggttctctcagagctgacctgtcctggacaccgtctccagtgtctactgggcccctgatgttgtctctgaagaatctgctgtggagctcagagtcctgggacatggtatatgtcggagttctccagagagacaggatcaatgtgttatacagatacagaagaggggacttactaagggaatgggcttatgcaatcgtggaggctgcgaagtccggtgacaggctatctgcaagctgaagaccttgggacatcaggagcgtggctcagtccaagcccgaaggcctcagcaccagggacactgatgatataactctcagtccc

SEQ ID NO: 146856 - DNA, 213 bp, Homo sapiens
aggatggtctcaaactcttgacctcgtgatccaccctccttggcctcccaaagtgctgggattacaggcgtgagcaattgcgcccggccgatttattacacttttgaaaagtttgactagtgaccacatgtacaaggaaccaaagcaacaaaaatagggcacccagttcccttcccaagagaccaccacaattccagtttcctgatggtgacc

SEQ ID NO: 146857 - DNA, 588 bp, Homo sapiens
ccgaggttggtggattgcttgagctcagaagtttgagactagcctgggcaacatggcaaaaccctgtctctacaaaaaaatacaaaaaaaagccggtgtggtggcagccacctgcagtcccagctatttgggaggctagggtgggaagatcaattgagcccagcaggttaaggctgcagtgaactgttaccatgccactgcactccagcctgggtgacagaaagagacctgtctttaaaaaaaaaaatctttttttggaggaaaaggtaatggttatagaaaaatcatataagcttaactgattattttaatttgttaagagtttagagaatagtatgatagtttcttgggagtagaccatatggtaaatgtatgtttttcaaacttactaaatgcaatcaaactgttttcagtggttcaagaagtatttgcaaattagagatgatattttgctttttttcatttcattttgtgaactggtgataactgtttttcaactttgttttactctgttttgtgttgctattacagaatacctgagaggaggtaacttataaagaacagaaatttcttctcttacagttctgg

SEQ ID NO: 146858 - DNA, 452 bp, Homo sapiens
gtagcagctagtgcattatgaaaattacaacacaccagccaaacaagctttactatctctgaaccacacactgctgtgtggccaagctgccttgccctgagcaagttcatcaagaattaccatggcaggaattcacatggaagaaaaattaaaacaaatagaaactagtactaaacttccagtgaacaataaaacttcagcaagtgggtgggtaagtggaggaatgaagatattttccaagtttcctataactaaaactggcacaagaagtatggggaaaagaggggatgtttagttctcaatcacacgaagtatctgctacaaatttgatttctgctctgctgggtcctttcttatctggtggaggaaacaaatccactttcaatgatagatcttcgttttttcctgttacccagaaaaatggtaccttctaatatcctttctgaacacat

SEQ ID NO: 146859 - DNA, 428 bp, Homo sapiens
ccaggctggccaacatggtgaaaccctgtctctactaaaaatacaaaatttagctgggcatgatgatgagtgcatgtaattccagctactcgggaggctgaggcaggagaatcacttgaaccagggaggcagaggttgcagtgagccgagatcacaccattgcactctagcctgggcaacagggcaagacaccgtctcaaaaaaaaaaaaaaagaaagaaaagaaaaatgaagtattgaaaaaagtaataaataaatatgttgctgtaatagaatgagattagtgctaggagcacagtaagaaggaagaattaaggattgctaaaagaaatatattgaaagaaaaaatgactttaaatgtaagagcaaaataattgcttcaagtgtagataactagaagcatgctgaataaaagtttcacagctggcc

SEQ ID NO: 146860 - DNA, 149 bp, Homo sapiens
taatcggctgagttgtgtccatgtgggcagtgcaggaaaggatgcagcgggacgctgctccagggatgtctttggcttccatcatgggggagcaggcgcctggattacccacatggacacaactcagccgattaatcttcctctcagaa

SEQ ID NO: 146861 - DNA, 227 bp, Homo sapiens
cccctgaaattaattcaaatcccagagggtgattcatagactctcaaagtcacaagaggctttaggagccattgagtctaacttcataaattggtaccatattctcttctaaaagagttccattattgtggttcttactagctcattcagaccactctgattattagacaatttccctgtattaagatgaatctcccttttcataattcactcacatgacactctta

SEQ ID NO: 146862 - DNA, 470 bp, Homo sapiens
cgatgtaccgcccattttggttcatgtggactattccaggaggacctagtgagcaacataaccaatctagaagcatgtcagtctaacaaaagaatccagttggatgaactagaattaagttttgagtccccattttggctgagatactactcagagggtagataaaccaggccaaagtgaggctgccaaactaagatccttttctgttgacagctgcacttcatggccaatcttctttctaggtttattgaccaggaggaagtgaagggagtagagtgagaattatttttgagttgattatttaggagcccattccaaagctcaaaaacaacagataatcgtggatggtagggagtgtggaagttccactggatatactttaactatcagcccattaattattggggtttttttggtaataaaagaagcactaatatcagactgcaaaagtctgaaaattaaagtacatg

SEQ ID NO: 146863 - DNA, 125 bp, Homo sapiens
aggataagtcagtgggctccacctgtcctcaccccaaggcacccagctaaccagcccaccaccactgaggcagggagacctgcccacccttgggatacaacagtgatgctaggatgcagcccctc

SEQ ID NO: 146864 - DNA, 381 bp, Homo sapiens
tggaaaagcaaaataaggttcctgttcttcaacagttgagggttttaagtcacaactaagtgcttggttgtgcttatactaggtacattcctataccacgggaaccaggtagtggctttcctggccatttgctaagttatggttagacaggaacaagtgtaaactagtctttgtcatagtgtagtttcctgttgttgaaatattcctttgctttctcggcttccctaacatgtaaattctgaagacccatcttaaactctccccagtgtcccaaatgaatttattccagtgaagggtaaggggcttgcattatgaacaataggtaggtttcttttccaagagctctggtctgcttttgttcatttactcatctcattttgt

SEQ ID NO: 146865 - DNA, 1187 bp, Homo sapiens
cttctgtggagaaccacctgccatcaaagatgctgtcattacggggaataacttcactttcaggaacaccgtcacttacacttgcaaagaaggctatactcttgctggtcttgacaccattgaatgcctggccgacggcaagtggagtagaagtgaccagcagtgcctggctgtctcctgtgatgagccacccattgtggaccacgcctctccagagactgcccatcggctctttggagacattgcattctactactgctctgatggttacagcctagcagacaattcccagcttctctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccctctctgggtcactggacaagaacaaacaggcttaaggcctggggtaagcacagtgttgtttgcagagctcactgctgcaaatagcagccag

SEQ ID NO: 146866 - DNA, 246 bp, Homo sapiens
cgaggtgaacctttatgagagcacacctcacagggtggggaaccagcatgtggggcctattgcttctcagtctgaggaggttccccattcccttctcttagcctactctcttggactcgataaaaataacaacaaggcctggtgtggtggctcacatccataatcctggcattttgggaggccagagctagaggatcgcttgatgccaggagccagcctgggcaaaataatgagaacttgtccctg

SEQ ID NO: 146867 - DNA, 162 bp, Homo sapiens
cgctgaaacacatgtataaaaaaggtatttatatatgtttttcctagtatacaagctttcaaagcagacaaaaacaagacttatacaagacccatctaccaaaaattagctggacctggtggcatgcacctttggttccagcaactcagaaggctgaggcag

SEQ ID NO: 146868 - DNA, 483 bp, Homo sapiens
aaacattgtgctcagtgaaaaaaaaagccaaacacaaaaagacacatatgattcaatttataggcaatgtccagaataggcaaatccatagagacagagaggaaatcagtggttgccaagggctgaggggaggggagaattgggagtgactgtttaatgggtacaggatttctttctggagtgatgaaatgattctggaattagatagtggtgatggttgcacagtcttctgaatgtatgaaaagccactgaattgtataatttaaaatggtttaaatggttaattttatgttatatgaattttacttcaattttaaaaagaataagccatagaaacaacttcccctattctgtgacccattcacttagagccttgtgatgggcagctaatgtcataatttaatttgtgccgggaagttaacagctaatggcatttcactgttagccctctaagaagccatttgcatgtaaagccaatattgc

SEQ ID NO: 146869 - DNA, 360 bp, Homo sapiens
ccctttacccatccatagcagccctcatgacactatattcgaattattatttacatgtcttcctaaagtgaagctcttgggagcaaggtcaatatatattgcccatcattgtatttcaagcctcaaaacccatgattggcaattaaatgattatttaatgagtggatttgtgctgatgtgccttttctaatggtcagcttaattgtaacctacaatttctgcaagttgatctattatttgctttgaccaaagtaaacatttgaatcatagagcaaaattttatagaacctaaaattgtctacaatcaggcttgatcaagtgcaattcctaacaggcagtatagtgtaatgcagtggctcc

SEQ ID NO: 146870 - DNA, 271 bp, Homo sapiens
agagtccccactgtctgtcctccccacagcccagtgactcagagaggggctagggtgaggccacctggcaaacatccccaagaaaaagagaaccaccaaatccagagagatgccttttcatcttagggagaggggcagggaagggaatcagaatatctgagttcctgccctactggggctcccctcggggaagacagagagtgcaagaaacccaggaaactccctggatgatcttgggtagtagtagaccttttgacctccctagtcagag

SEQ ID NO: 146871 - DNA, 446 bp, Homo sapiens
tagtaggctctcaggatgcacaatgaccctgtccctgcttgctggagacataagagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaactta

SEQ ID NO: 146872 - DNA, 264 bp, Homo sapiens
cagggtttacctgatgtccctgctctcttagagtcagctggttttttttaagcttttaaaaaagatgttgttttagacctaggtaaaaaatttaggtcttttagtgttttattgctatatcagtagcattatttgtctttaagtcttttcagatggctttttaaaaaattggcataaggttgtgcaggctgtgggaatggaaactgctgcgtgtacttgactttctggccccctaggcctggagagtgtttcatggccctctgg

SEQ ID NO: 146873 - DNA, 488 bp, Homo sapiens
agaggattaggtatagagtggcatgagatactacttcacacccatcaggatagctgttagcaaaaaacaaaaacagaaaacactaatgttcgtagcagcattgttcacaatagccaagagatataaacaagccagtgcccaacaacagatgaaaaaataaacaaactgtggtatatacatacaaagggatatgattcagccttaaaaaggaatgaaatgctgacacatggttagttacaacatggatgaaccttgcaaatgaaaccagcccaattgtcctatagaactgatgcttacagtcttttaaaataaagatagaaattgaccctcccagtcttaaaacttgagaaagttacatttgtcttatctgaattccttttttgggaaacaaaccataaggcctcccagatagttatcaaggaactgaaacttaccacatcaccacatctgaaccataagacaccagaccacctcacccatcacaattg

SEQ ID NO: 146874 - DNA, 314 bp, Homo sapiens
gggggaagagataacttaagttgtaatgatgataacggaaatttgtataataaagaaatctggcaactcccaaagttcaaagcgttcatcttttccgaataatctatcacgaagataaaatttgcttccctttaggcctggcagagtggttcaagcctgtaatcccagcacttgggaggctgaggcgggcggattgctgcttaggagttcgagaccagcctggcaacatggcctaactccgtctcttaacaaaaatacaataaattagccgggcatgggggcgcgcacttgtggtcccagctactcgggaggct

SEQ ID NO: 146875 - DNA, 395 bp, Homo sapiens
ctataacactgtggatagcggacagagggatggggacagagctgacactcaacacatctgaaatgacacctccattacaaagggtcggctgctctacattccctggagaatttcacttgctcctctgtttttcagatgcattgctctgcaaactttggtttccctgggtcttccttctcaggcctctcgtttctcctgaatgatttcataatcctcaacatgttctgtcatcgcagggagttgatgtgaacatgattactggggttatgaaccaaggactgcgacctcaataggggagaggcagaaaaaaaacacagctagccaccaaaatggatttcacagaccttggtcacaaggggataaatgagggcacccagccctgcagccatctctat

SEQ ID NO: 146876 - DNA, 110 bp, Homo sapiens
tgagaggtatgcttgctgtaccactgtcacagagaccgtgggttcaggagcctgtaattaataaagctaggtatggtggtgcacacctgtaatcccagctgcttgggaag

SEQ ID NO: 146877 - DNA, 229 bp, Homo sapiens
tccacaacagccaggccacacacctgcccacctatagacacagtgctgtctgatgccaacacgttgtggcacatgctgtgcctctgccagaaatgccaacccagagccttcgtggctcggctccagtgcctcctcttccaggaagtctcccacaccttccttggctacagctcatcagtccccctgctcttgtacaaccaggacactggggttaaacctcagagggaca

SEQ ID NO: 146878 - DNA, 254 bp, Homo sapiens
aagaacccagagaaccgaggtgctcccattgatagaaagaaagaccaggcagaaacaaaaacagagaggtgttggctctgagcaagaccttctacctcgagcagagaggcctgccccagagagaggcagcaggctagttcagcaacgttgtcgttcacagaaagaacgtccagggaaagaatgggcgggccttctttttgcaaggtcagagctcgtccagtggaaaggctctggggctgcaacgcacaggatgt

SEQ ID NO: 146879 - DNA, 232 bp, Homo sapiens
ctcttgcctccctcttatcaaaacccttatgattacattgggcccacctagttaatacaatataatcttctcattttaaaatccttaactcattcacatctgcaaggtccttctgccatgtaaagtaacatatacacaggatttgggaattagtaggtggacatctttgagggggtccgttactcagcttaccataccctctgtatccaatatatcactaagccctatttat

SEQ ID NO: 146880 - DNA, 501 bp, Homo sapiens
caagagatgatggtcatttgaaccagagtggtagcaatagcaatggtgagaagcagttggattctggatgtattttgaaggtaaagccaacctattggaaattagagagggattagatgtacagtataaaagagaaagaagagttaactgtagcttgagaaactagagttgtgaagggatgtacttgtcattattgatgtggggaagactaggggaggagcaggattaagaagggggcagagaaaaacaggagtgtggttttggacatgttaaactgaaaatttgtattagacatccaggtggaaatgtcaggtaggcagttgtacataaaattcttgaggttaggggaaaggtcaaagctggaaatatatatatatatatatcagtgtcaccagcatatagatcgtatttgaggctttgagctctacgagatcatcaaggaagtgagcatacctaaaaaatagaagacggctaggtatgagctgacaggtgaaagaaaaa

SEQ ID NO: 146881 - DNA, 93 bp, Homo sapiens
agacctccctaggaggtgacccacagatgagggccacagatgagagcttcttgctcttccaagaggcctaggtaaggcttctagtcagaatgg

SEQ ID NO: 146882 - DNA, 588 bp, Homo sapiens
taaaatattcaactaggttaaaagtgtcagacatatcaatttggaggcaagctgcaaaaatacacaggaaaaaaggtcttagaagttgagattagataaactcttttacgggatacaaagaaaaccaaaaaagtggaaaatgggttctaagaggacactcctgaaaaggcaagaaaaggaaccgacattcacttatgaaattcacacttcctgaatgtctactatggacagagcatgattccagttatggggaaggggaaatgaacacacagacaggtcacaaatgagcattggggaaagaggggaaagctgagggagcgctacatcatcacatcaactgagcatggacttggggaaataaggtacaccacaagctgtgactcaattcacaagcacaggtggaggacgaggttttggtatctgaatgcctaaagaaataaataaaatcgagggcagaaaataagtccaaggtttttttttgtttgtttgtttgttttttttttgttttttttgagacggagtctcgctctgtcgcccaggctggagtgcagtggcgggatctcggctcactgcaagctccgcctcccg

SEQ ID NO: 146883 - DNA, 541 bp, Homo sapiens
taaaatattcaactaggttaaaagtgtcagacatatcaatttggaggcaagctgcaaaaatacacaggaaaaaaggtcttagaagttgagattagataaactcttttacgggatacaaagaaaaccaaaaaagtggaaaatgggttctaagaggacactcctgaaaaggcaagaaaaggaaccgacattcacttatgaaattcacacttcctgaatgtctactatggacagagcatgattccagttatggggaaggggaaatgaacacacagacaggtcacaaatgagcattggggaaagaggggaaagctgagggagcgctacatcatcacatcaactgagcatggacttggggaaataaggtacaccacaagctgtgactcaattcacaagcacaggtggaggacgaggttttggtatctgaatgcctaaagaaataaataaaatcgagggcagaaaataagtccaaggtatttttaaagcaaggaaggaaagaaaatggaagataaaaagaatgaacataaaagtctcaagttaattt

SEQ ID NO: 146884 - DNA, 998 bp, Homo sapiens
cagtctctgggctcctgtccctctgccctccccctgctttacctgtgtcaccaaaactctccggggacagcaacacctacctcccatgccaccgtgatgattaaatgtgaaaacacatatgaaaggtcttcgtaaactctaaagtgctttatacatggaaaatagaattaatatctgtggaggagggagaaatagaggggcaccttgaagaatgaataggtgctacgtaagtggagagctgtgtgcctgcctgtcaaggaagtaagcactttataaaagtcaactcataacgtcaggcagggactattattattcccattctacagatgaggaaactgaattccaaaaagtttaagtaacttgatcaaggccacctcgttggtaaatagtaaagtttggactcacaccgaggaagtctggctacaaaatttgtgctcttaaccaatatgctcttctgcctccctcattgaaaaaaaaaatgtttgtaattcaatttgattccaatcaatacatggcttgagtgccagactgggcactggctgtgtaatgatgaagacagtccatgctctccagaagcataagcaaataagaaaatactccaaagaataaggaaataagatactacaaatatgactggcactggaataatgtaaagaagaatgtggaaatggaaaagaggaggagtgttccagtggccgtgcatttaacagagtagagaaccaagcgggtggataaagagcagttcaaggtgaggctgaaaaggtgatgttctggagcctgatggtggagggtccagagtgccaggctaaagtgacagggtgttagcctggagagggtgggcaactgtgaaggattttggatcaggtaaatagtatatcaaaaagagaattttaagagacttaaactaatgaaataggagaaggacgtttatctgggatcagcacagttactctagtctgtggattggtaaagataaataaaggttaatttttcaactt

SEQ ID NO: 146885 - DNA, 2965 bp, Homo sapiens
  misc_feature (585)..(586): n is a, c, g, or t
atgcacaggtgtacagaccacctctgttgatgcgcgcgcaggagactgtgagcagatgccacactaggtgggtgctggactggagcctggggaagaactagaggggctggaagggcgcagggaggtctgccagggtgaagggacagcctaggggaaacccagctcggaacccacaaggcagggcagctggagcgtgcagtctggtctccccgtgttcaagctctcactgtggggcttcatctagtgcatgacacccctgggagcacaaatgcctgctcctactgataaagaagcagggggagtgagcggctcccaagcagcggcgcaggagcgaaggcaggtctagacatccctgccctttttcccatcacagcagtctgcagttgctgctgaggtcgagtttccgaattgaggtgctgctttgctccctttccaactcaggctgctctaagctcttccagaaaggggctccagagggaactttgccaggacagttggagaactgccgagacaggcagggttcctggttccagagccccacgagaaaggggtctttgctttgcaccttcctgcagcctagcagcnntcctgcctcagagcaggacgaggcctggggtcttctaggaaagccctttgtacactgtcaaggggatccccacgccaaggccatttacagcctttgttcttccagcctgcggaccctcctgcctagccctgccatgttcgcagcagccagccagccagctctgcctctgcccgaggccagggaccccgaccttagagcctggggtttctaggtaggctgccctgcttgcctgtggtttggacaggagagctgggcttggcacaagtgggtgctggaaagaggcttcaatatgacggactttccgtctctggttaaatcacaataaaccactggaggagagctttgaggctgtggtttgaatcctgggtgccaggagacctttctcccacctcgctttccttgctggaaatgagggtacagtaggtgacccctcaggtccctctgagctaccactctacaaatcactctgctcagattttagctactgccattaaggcacagtgcagagagtttaaaaattgctgcagagtttaaaaattgcctgacatacaaaaattagccaggcgtggtggcgggcgcctgtagccccagctactcgggaggctgaggcaggaggatcacttgaatctgggaggcggaggttgcagtgagccgagcttgcgccactacactccagcttgggtgacagaatgagactttatctccataaataaataatcgcccaacagcaggctgggtctccatacccagcttttccaggttcacctctcgtggctgttttcacatggatagggaagacatgggtcatccttccctcccagactccccccaggacactgcccggccctctagacagcaggtggagtcagcagagggagcagggccttctttttgtggttaatgatctctgtcctaagcaatgccatggccccagactcacatacatctctaataaccagcagaggactgtttcacagaaactgctgtgttccagacaagcagggacaccgatttccctcccacttgccacgggagatgggaagaatgataccagcagcaggaatcctttttctgggtgatcgaaagacaattttcagtttaaaaagcatccttggaatggctgtgggtgaagccttctcctgaggcctgggatgggctgactttagcactttggctttctatgggtctttgaagtgagatggagtgaaaggctgttctactcaggtgtcctcagacttggcacctggctaagtgctgtccctcgcccagatgggaagaggctgcagtgactggccctggagctgatgttggcctatcccccaggatggttttagccacctggctgattgtggaaacttctccacaaaatgagatgaattatactgtcctcaacattctcccaataaatactcagaactactatcagcttaggccaaggcatggtgattatactttcgagaaggatagttaagcagagaatcacaggatattttctaactgacgaccggaggtgtgtgtgtggaaggtatccaggcctgggaagttgacacagggcagtgagatgaggacaggctaaagagccatggtaggttgaccccaagaggccattgtggagaatacaagctgaaatggctcttgccaacgcctgggacaagctattattttatcccaggaatccagaaccagaagaaacaagcaaatgaagtgattttttttttttttttggagtgatggagaacaatggcagttttgttttgtatactgtgagctctcaacagagttggatttatttttctctcatataaaccccatcccccaaacatttttttttttttttagaggtgatggtagcagacagtgcttgtcactaagtcctctcttggggtgggggcagaggtggtgaggagcaccggcttaggggaaaaggcaggcaagtgaggagcaggccgaagcctgggactgtggaggatgttcgctctgtttgcaggctgagctgcggaaggtaaaaactccaggccaaaggattctagaaatatgggcacaggggtcatattttcatgaaaaaataaaaataaaagcacagggtgggccgggcacagtggctcatgcctgtaatcccagcactttgggaggctgaggtggatggctcacctgaggtcaggagttcaagaccagcctggccaacatggtgaaaccccgtctctactaaaaatacaaaaattagccgggcatggtggcacttgcctgtaagctcagctactcaggagcctgaggcaggagaatcgcttgaacctgggaggcggaggttgcagtgagctgagattgtgccactgcactccagcctgggcaacaagagcgaaactgttttaaaaaaaaaaa

SEQ ID NO: 146886 - DNA, 279 bp, Homo sapiens
tctctctggctacttttaagatctttgcttttggagctttgtggtttctctacaccatgtccagatgtgggtttctttctttttctttttttttttgagacagagtctcactctgtcgccagctggagtgcagtggcgcgatctggactcactgcaacctctgactccctgaggcaggagaatcgcttgaacctgggaggcggaggttgcagtgagctgagattgtgccactgcactccagcctgggcaacaagagcgaaactgttttaaaaaaaaaaa

SEQ ID NO: 146887 - DNA, 1854 bp, Homo sapiens
  misc_feature (72)..(72): n is a, c, g, or t
tggttgcctcccaaattttttcccccaaacttgctttggggacaatttcatcactgtatcttttaaataatntatttttttgtgagacatagtctcgttctgtcacccgggctagagtgcaatggtgccatctaggctcactacactccagcttgggtgacagaatgagactttatctccataaataaataatcgcccaacagcaggctgggtctccatacccagcttttccaggttcacctctcgtggctgttttcacatggatagggaagacatgggtcatccttccctcccagactccccccaggacactgcccggccctctagacagcaggtggagtcagcagagggagcagggccttctttttgtggttaatgatctctgtcctaagcaatgccatggccccagactcacatacatctctaataaccagcagaggactgtttcacagaaactgctgtgttccagacaagcagggacaccgatttccctcccacttgccacgggagatgggaagaatgataccagcagcaggaatcctttttctgggtgatcgaaagacaattttcagtttaaaaagcatccttggaatggctgtgggtgaagccttctcctgaggcctgggatgggctgactttagcactttggctttctatgggtctttgaagtgagatggagtgaaaggctgttctactcaggtgtcctcagacttggcacctggctaagtgctgtccctcgcccagatgggaagaggctgcagtgactggccctggagctgatgttggcctatcccccaggatggttttagccacctggctgattgtggaaacttctccacaaaatgagatgaattatactgtcctcaacattctcccaataaatactcagaactactatcagcttaggccaaggcatggtgattatactttcgagaaggatagttaagcagagaatcacaggatattttctaactgacgaccggaggtgtgtgtgtggaaggtatccaggcctgggaagttgacacagggcagtgagatgaggacaggctaaagagccatggtaggttgaccccaagaggccattgtggagaatacaagctgaaatggctcttgccaacgcctgggacaagctattattttatcccaggaatccagaaccagaagaaacaagcaaatgaagtgattttttttttttttttggagtgatggagaacaatggcagttttgttttgtatactgtgagctctcaacagagttggatttatttttctctcatataaaccccatcccccaaacatttttttttttttttagaggtgatggtagcagacagtgcttgtcactaagtcctctcttggggtgggggcagaggtggtgaggagcaccggcttaggggaaaaggcaggcaagtgaggagcaggccgaagcctgggactgtggaggatgttcgctctgtttgcaggctgagctgcggaaggtaaaaactccaggccaaaggattctagaaatatgggcacaggggtcatattttcatgaaaaaataaaaataaaagcacagggtgggccgggcacagtggctcatgcctgtaatcccagcactttgggaggctgaggtggatggctcacctgaggtcaggagttcaagaccagcctggccaacatggtgaaaccccgtctctactaaaaatacaaaaattagccgggcatggtggcacttgcctgtaagctcagctactcaggagcctgaggcaggagaatcgcttgaacctgggaggcggaggttgcagtgagctgagattgtgccactgcactccagcctgggcaacaagagcgaaactgttttaaaaaaaaaaa

SEQ ID NO: 146888 - DNA, 327 bp, Homo sapiens
ctccccacgaagactcagctgtttatccactgtgtactctttccttaaccccactcttcagatttctcagaagatgcccaagtgaggaatttgcaaggtttcttttcactcttcagcaagccatgcaagcagctctctttcctgtcaatattgttcttttcagtttctcaaacgaactgaagttggaaggccaggttccagtgtataattcctgtatttgtgtgaattctgtgctgaactactgctgccttgggaaaggttatctgactttgatcccatagccactaccctgttctctccacctgtcttcttactgcatcacgaggg

SEQ ID NO: 146889 - DNA, 2016 bp, Homo sapiens
atcaggatgtctgagaggagagcatggtgtttttgcttcattggatccatgcaggtcttggagggtggtggcccactctttctgggccaagtagagggtggctcagacacccccccttcctccaggcttctcatctgtaactggtgaagcccggaagagcttgttgttcaagaggaaatcttgtgttacttctttatgaaggactccagcctggtggagatgaatgagtcctgaagatggaatcgaagctgtttgggcacaatactttaatcagcatttaatgacccagtcgaaaattcattgtttggacccaagcactggtgggaaaggcaggaggggaggcctgccttccttcctccctcccgagccctacagcaggccatggagtggtgagcgagttcgtacagtgccaaccacattcccagaaacttccagcagaggttaatcctgctcctctcaggtaggagacaatgaatggattttaacaaatggactccctgtgttagctaatgccagtccctactcaacctaggatgactccaatggcgcatgtccccattcccgggccctaaggctgcgctaacatgctatcctgcctgccccttcattctccaccctgccacattcccactcctttcccctcccaacacgaagccatgcctgagctggacacccttccataccaacccaggaaaaagtgattcagctccggtccaccctgggtgcagcggtccttctgccaagatgccttcatatcatacagctattattttcgggaggattccaagtgagggcagtcagggtgggcttggcccattctctagactttggaaggtaatgttctatagaggcctgttctgaagctttaccaggtcaaaccggagaagaacccaacaagtaactcatcccagcctaactattcttcaagggcaatcaacctacagcatccaagcacagagaaatcaaatccatggagaatcttcaaattaggctcagaatccatttgggtcaatgaatttactgttattaagatcttagttgtgttcaaccatgatttgacataccttagagtgagaagatattcttcctggcctcagactagttgaaggtagagagagagacaggcccttgggtgtggggagacctctcctgggataatacacacaaaaaaccaagagctgctcactgtggtgcaggagacagcagggcctgaagccagaggctctgtgtccttgaatacaatgttttactcctctgacccctgttactgtgatttggagaggcagacaatataggatgggctttgcaggcagggaggtccagttataatcccagctcttactaagttgggtaagactcactctgagacttagtttcttctgtcatctctcaatagaatcataaaggtactttcctcttagtgttgttttaaaattcagtaaaataatgcaggcttagcacagggtctgatgtaaattttcaatgaattatcgttgtcaatattgctctggaaaacaagagggcatattagaagatcaaaagtactgccaagcattgaagtgccaattctagatccagtctcagccctctgagaatggatatcattgttttcaagccattcagaaaccaatgtgaattgaacacctagtatgagctctctgagggaagagccaagtcatgcattttttatcttaaggggtcttcaatacctctagcccaaaacagtatctccatcaggattcttctctgatagtgttcatttcttttttctcaatggatgccttaaaaaaaaaatcctacaaggaaacctgtactcctcaaatacaccactcaggtgaccattaaatcatttacattggccctccctgtctccaggggggttgagcatggccatctcataggtgcccctggagttggggctggggtttggggtggcctacctcaagaactaaaacacttcatcctttcccgcctacctcacccagagccacgtcttccagacaggggcaacataga

SEQ ID NO: 146890 - DNA, 296 bp, Homo sapiens
tacctccctgcagcgccaagccggctccccaacctggtctgctgaacgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgc

SEQ ID NO: 146891 - DNA, 336 bp, Homo sapiens
tcttacagccacctccccacggaatcgcacgccaaggccaaagctcagttttccaacctaggctatgcccaatctcgcttcactgtaatctgttgccaccagaaaatgacttcccaaaagctgtttttgtgagatcctttgcgtcccattccacagcctaaaagaattcccaagagttgccaggtgaggtcttgtgacccacccaggccttctgcgttcactgttaatcgacctgacctttctaacagtttcccagcctgctcacatccagccacgtactcaacccccatcaactcattcactcaacaatctctgggcatctgtgatgcgatctat

SEQ ID NO: 146892 - DNA, 389 bp, Homo sapiens
acagggtttcgcttttgatgcctaggctggagtgcaatggcaccatcttggctcactgcaacctccgcctcccaggttcaagcgattctcctgcctcagcctcccaagtactgggattacaggagtgagccactgcgcctggccccagttaaacttttttaatggtaaaaggtttgagcagacacttgaccagagaagacagacaaaatggcaaaaaagttcatgaaaagatgtggaacatcgtacttcattaaggaaatgcaaattgaaaccacgatgatacaataactgcatccccactagaagaggtgaaatcaaaagatttctggtaaggctgcagggcaggcggaactgtcacgtgctgctggcagacacacaaaatggcacag

SEQ ID NO: 146893 - DNA, 200 bp, Homo sapiens
ccggtaaatgtagatactgtgccggaatgtagatactgtactgtgaggaatttctacggcccttactgccaaacctaacataaaagatgtcaatactgaaagagctgagggcataaaaagagaagtcaaaagtctaaaaaattacagactgacaggtcaatattataaacttgactaggtggaatacaacagataaaggc

SEQ ID NO: 146894 - DNA, 326 bp, Homo sapiens
ttgctctcggttccacttgttgacctccctcctgcctccactcaaattatctgaagctctggccctgttgctaccaggaaactgcccactaggtcacccgcaacttccatttcaaagccactagcctgtctcgctctgacctggccccatcaccagcagctgctgttaagacactctcttccaactctcacactggcttccgcctctacctccctcccagccctgtgggttcttcctccatctgcagggacatactgggactcgccagggctccatcctcacatctccagctgatcctccactctaatgtcccaacatgcgcctgt

SEQ ID NO: 146895 - DNA, 643 bp, Homo sapiens
gaggagatgacacgagttcaccaaggggtgagtagaagttgggaggaggccaagtcagaagagcatcttctagacaaaaggatggccttgaacaaaaatgcagagaaatagaagaacacagtgggtgttacaaacccatcatcttcatcctggggatattttcctgttaagaaaatattttccagcataaactctgttgagccaatttatttccttcatcaattttctaatgcaaggcaattcaatagtttcctatttttttgactttcacttttatgttatcagaattatttttgccatctattcttttcttcctttggcattgtatagtaccagtttcactggttgatctgtttgttttgttcacaccaaattgtactgaataaagcttttttcatggtgatagatgtacataggcctttaattcttccaactttgactttcctgggtcaaattttatatcaatcaatatagtctagaatcttattattttacacatcttttggttaaaaaacaatattttatcaagtatacttttcgccactctcacttttttaaatttcattttgattattctaccagcaagatgcattgtgaattaggtagactactgagcagtttttgtttcttagattatccgtga

SEQ ID NO: 146896 - DNA, 203 bp, Homo sapiens
ttctatagctgttttccaaaggattgtttgatacagtcgggagctcccgtgaccaaatctaaagcctgagaaccaactttctgtgataaagcatactaagcaaagaagactctgtggcattgtaaccgatgctactgagtatgccacaaatgttcatacaaattttgtgtatagcgctattgcataaatcgttttaatatggg

SEQ ID NO: 146897 - DNA, 243 bp, Homo sapiens
tgtgtgtttgcgccactgcacaccagcctgagcaacacagtgagacctacctcaaaaaaaaaaaaaagaaaaagaaaagaaaactgcttagtaagaaggaaaaaatcaaccctcggcgatgaaaagctttttatagaaatatgccttttctatagggtataagggttaagggcatgagttcgggacctcggttacagactattattacaactccctcagccggggtctccaggggtaccgagc

SEQ ID NO: 146898 - DNA, 524 bp, Homo sapiens
agtaggatggccatgtgatgttggcaagggtgcaaagacaattcattgcagaaaggtaatctttttaacaaaagatactggaaaaactggatatccatttgcaaaataatgaacttcaacctatacctcacgtaatatacaaacattaactcagtatacatcataaacctaaatagaaaatctaaaccataaaacttccagaggaaactatggagaaagtcttcaagacttttgattacgtaaagatttccttagctatgatactaaaagcaagattcataaaaattgtaaattagactatcaaatttggaatcctctgcttcttgaaagacattattaagagaattaaaaggtgggaagaaaatatttgcaaaacacatgtgtgatatggaaattgtgtctagaatatataaataactttcaaaattaaataagaaaacaaaataactgaatataaagaaacatatttaaagagacactttgccaaaggagatataaagatggaaaataagtacatgaaaaga

SEQ ID NO: 146899 - DNA, 269 bp, Homo sapiens
gaattccgtgattttttatatatagggattaggcttatatggagcttttttcctgcacattaaccatacctccaggttgtactaaaagcatgctgactgtttttatgctttttagttatataacatatgtattctatatcttatatggaatatataaattatatcttacaccaaggctttctttcacccttgtctgcttgtttccaaaagtttctgtttctttttcttaagagacaggatctcgctatgttccccaggcagtggctatt

SEQ ID NO: 146900 - DNA, 334 bp, Homo sapiens
tggagtgtgattgtatgcatcttctttaagaagatgccgaagataattaataacaatctgagcaggtggtatgtgtatggggaaaaggaggaatcaaaggaaaggcaaacatgtgaagtatataaattctgaaaacagcatgttagagttggaagagatttaggacaacgggaattttctaagaaatatggcacactccacattcttttaggtgtctacatatggagagagcctggtgtcaaagaagtgacctgagctttggcctcagaatgtcctcatttggggctgtgcatgggggtgtcaggaggtgatatccaccatcccgagtggctgg

SEQ ID NO: 146901 - DNA, 209 bp, Homo sapiens
aagtgtggattcaactataactgtctcctttccaccatttggtccttagctcaaaatatgaccttttctaaaaggccttccctgaccatccccacctaaagtggcttcaaagttactatcacagtgatttatttcacagaatttagtacttcacagaatttagcacaaactatatttcattttgcatttattggtttacttgacactgt

SEQ ID NO: 146902 - DNA, 254 bp, Homo sapiens
ctaaggtgggaggatggcttgaggccaagggttcaagaccagcctgggcaacaaagcaagactctgtctccaaaaaaataaaataaaataaataaataaaaacaataaagcgcagaagacaattgacaacatctttcaaaatgttgaaaaggagaaaactatcaagccagatattccagtgcaatatcctttaaaaatgaggttaaggtaaaggcattttaagatagaagcctcctttggtgctctgggggtac

SEQ ID NO: 146903 - DNA, 841 bp, Homo sapiens
attttattgcatactaaatctaattttggtctgcaggttgttgaacatgttagtttccttaagacagttgctatagtgatggcagcaaattcctttaatcttagtgtaaagtagtcattttctataggccatcattgctactcaggaattgtcaatgaaagcatctcattttattaagttcttgaatttttctcttagtttcttaagaaaatttaaaaaatttgtttttaacagatcatgatatctactgaactagtattttcatttcctttttatgaagtttcacacctgcttataatatttcagagaaataatatagacttctacaagtaaaatagctgtctgctattttagtttcaaagcattcagtataaaaaagtatataggaattttgttgtgatatataatgaaattttcataattttgtagtagctttttctccctctcacaaatgaatttactgaaatcttgaaatgggccaaaatgatgctttgctcctaaatatttaccgttaacagttagggtggcaattcttaattttctatttaagttatatacctatcttggaaaatggccaccttcttcctcctttgccaacattttaactttatcttattttatgttcttttttagtatgagtgtgaggaaattttacttctataattttaacaattgtttgaagttatttatgataacatctgactaaaatatgtctgatagtacttgtttttattgcttttttaaaaaagagaatatgtttagaaaaaaattttaagtataagcatgtaggccatatttatatataaacatgaaagttaagtgtggattaaggttattgtat

SEQ ID NO: 146904 - DNA, 128 bp, Homo sapiens
actctccagattcccaaataccaatgtcctgtaccagattcttggtacatggaccagatacttgaacacttaaagcactgttggtgttgtactttgagagacacagtgtaagagctgtcatttgtttg

SEQ ID NO: 146905 - DNA, 232 bp, Homo sapiens
gtgtgtacccacgtgaggcctttggagatgatgccgtcagtgagaggaatctgccctggcattccagggccagaattagttggggcatggatggagacttgggatcctgttgtcaaccacagaggtctcctgatgtggctctgcagggacttttcagtcttagctcagctttccaacaggtccaccttctcccctagaccctggggacccagtccctttccccttctgtaat

SEQ ID NO: 146906 - DNA, 372 bp, Homo sapiens
atttccaataaagggccagagagtaaacagaaagttttgagggccatatgatctgttgcaactttataaaaactctgccagtgtaatgcaaaaaccgctacaaatatatgtaaacaaaagaacatggccatatttcaataaaagtttatttgcaaacacaggaaatgggccagatttagtctatgggccagtctgcgtgaccctggcttaaacaatgacctgaagataaagtggcagacagatctgaggtgttcagtggcagaattttaaaaatatttatcttcattcctactaagttttcttcacagatacctgtggtcccttttataaccaaactctcaagtttctcagcttatattcactcttcaaaac

SEQ ID NO: 146907 - DNA, 264 bp, Homo sapiens
gatcgagctggcccccaagtgatagaaaaaaaagataaaggatatccacacaaactattcttaaagaggggtgttctagaactttgtattatttatgtctgaagatttgtacagatcctcaattccatatctgcaattcctaaatcaaaaaagctctgaaaagcaaaagactgtatgcaacttttctggcagtaaagtctgacctgcactgacataaggctatttatagtctttataccacttggtatgattttgttttttttt

SEQ ID NO: 146908 - DNA, 147 bp, Homo sapiens
tgcactaaaaagtagaaaaaagtgatataataaatcaaaggagacctaagtaaatatgtagattagaagactaacagattaaagatgttaaccatcctcaaattgatctgcagacttaaggcagttccaatcacagtcccaaaagga

SEQ ID NO: 146909 - DNA, 220 bp, Homo sapiens
ttatttattagtatttatcctcattaaaagcttccatcacaccagaaaggatactaaggcctgctaaaacacctcacatagttggcactccatgaatgttgatttccttcctcatgttcacttttctgattctaaggtcaattttaccttaattctcttttgaagtttttttcttttgaaaaaatgtacatcttttttcttttaacgttatatatgattg

SEQ ID NO: 146910 - DNA, 213 bp, Homo sapiens
aagggagaaagaaaatacttaagaggccaagtgaaggaaattttcaaagataagaaaatgttggcagaaatggaaggggcattagagagagagggaattgactaaatgctgtagtctcagctgggcagtttttgagttgggataaacttacaagacagctccttctgttgggggctgaaagatgcaggcaggtgggtctgggtcctggcacag

SEQ ID NO: 146911 - DNA, 199 bp, Homo sapiens
ataatggcaaaacccgcaattacttttgcaccaacctatatgataaattggttgaaaaggaagaaataatcttgccattattcatggatataaagctgtcaaaagaatctcctgataatgtatttagagagtgaatttagtaagatcactgcatacaaagtaatcacacaaaaatcagctttatttattagcagcaaat

SEQ ID NO: 146912 - DNA, 319 bp, Homo sapiens
gcaggtacggcatgttggaaggtgtaccatgtgcccttaaaggtgaacccagtgcaccttcatgaaccgtggtacacctttaagaacttggtatgccttcatgaacacttaaagtaccagggggcacttcatgaaacatcattaagtttctcctaagtcattgcaaaatgatcagaactcttttgtcgtggacagcatttcttttgtaggtgtttagagttgccaatagctccataaattgttaaaagcaaaatattgaaatataacctaataatccagggccccatgttttgaaagatcactgccaaatctttcacgt

SEQ ID NO: 146913 - DNA, 348 bp, Homo sapiens
agctaaaaggttagaaaagacatacagaggagggaaaaacaagccagatggcagcaagaggagaaagacacaaagaaatgagtgatgccgtgagagacctcactgtccatgggaagactgtggcttgtctctggacagcctgagttcctcatgggtctgatccacatgcatcctccaatatagccccttgtacagaaagtggtctgaatgaaactctgttctttgcaacaaaaaatccctaactaaaacacttccttcaactcccccttaagatgaagttttcccaggaggtgcctcagtgccacaaacaaacagattctgggcaagcccaccccctccagccccccg

SEQ ID NO: 146914 - DNA, 730 bp, Homo sapiens
aacagctgtgataatggcactacttacagaaactgagaactcattatctctaaaaaatggtatctgaatcagccaggactgtagaaccaggatgtctctcaattcaagaacataactgggccaaggaatactagaaataatgtctttataatcccatttcttcctgaattcctagggtaatgccaggatatctcaggtattgccttgtcttaagctacagccacaggtgaattgtttctctgaaaactttctccatagctgcacattcagttgtgctcacttcatttttcagctttttctactaaaaatatttgatggcaggaagatttcagacatgcttcagtcagtagaatttcaaaaacattaacaacagtttctgcaatctttgcactttgagcaacaaagcagttacgatttcacaatcttttatgaaagaaaactggaaaaggaaaataagagtcaaggattccagtcattgctttcagagactgccactttatttggcttcagtttagagttatttaatctgagaagagcaactgatgctttaaagaggaaaagaccctagacaagttcaaggaaagatcatattaacaggctccttgtcaaatttctttctttttttttttttttttgagacagagtgtcgctgtgtcacccaggctggagtgcagtggcgcgatctcggctcactgcaagctccgcctcccgggttcacgccattctcctg

SEQ ID NO: 146915 - DNA, 209 bp, Homo sapiens
caactgatgcccctccatggatccatcatcaccccaagtgagtagctcacgttagggttcacgctaggttttgggcatcctatgggtttggacactgacacgtgtccccccttgcagaatcaaatggaattgtttcacggccatcgaagtcctgtgtgccccgcctgctgcggcattcttgtttcgggcatgtggtttttcatcatttc

SEQ ID NO: 146916 - DNA, 301 bp, Homo sapiens
gaactattattaaaagagccataagaaaacttcttgagtcttaagtttattacaaaacctacagcttaccttattctcaagaaatattgaaacatttttcctgtaagcaagaaaaagataaggataccattattgaaattaaatatatatattttgatatctcaacaaattaggaacaaaggggaatttcctagacttggtaaaaaaattacaaaaaccatacagctaacactgcaatgctgagaaacttgaagctttcctactatggtcaggaagaaggcaaaaatatacccttttacca

SEQ ID NO: 146917 - DNA, 291 bp, Homo sapiens
ctgggattacaggcatgagccaccgcggccagcagcttttttccttttttgaaggattacttattggcgcatgttcttcccttgaatattctgtgcagaattggtacaaagagtatatgttgagtattttgaaagagctcagaagacatctattaaagcagacatgagtttgtttgtttgttacaacacagggctgtaaaagctgagtaggagattgttttatgaagtatacttcgaatcttaagtaaatcacagttatcggaaaatcagtcctttgtttccctgttcata

SEQ ID NO: 146918 - DNA, 290 bp, Homo sapiens
aaacggagggaaatattttaaaatctcaaaagcaggaagataaacctggtagctcttaatgccattcgattctgctatgtttaggccaagaacttgaagagaaccctgtgtgtgaaggagggagcctctcctcacttctaagaggaacacatgacggacactgttggtgtccacccacaggttcccttcgcggggagccgatgatgctttgatggggggcctaggaggctgctcttggcctcaaggcagaacttcctttgtgaggcttctcactccagagatacgggggg

SEQ ID NO: 146919 - DNA, 355 bp, Homo sapiens
tgtaatcccagctacttgggaggctgaggcagagaattgctggaacctgggaggcagaggctgcagtgagccaagatcacgccactgcactccagcctgggcaacagagcaagactccatctcaaaaaaaaaaaacattcaagaaagcatttgctgtctgttcccatcacccagcactaaatggaaactgttctcttgttatgtgtacttgtgtttacctgctcaccagattgtaaaatctcaaaggcagagactggattttaaaacagcttgatatttgcacagtatttgagagtctgcacagaacattttgagatttgttttctcagtagttccttacaattcccatattgta

SEQ ID NO: 146920 - DNA, 457 bp, Homo sapiens
ccaggcagacactcctgattgggctgggaacattcaggggtatctgttgagcctgagctccctaggttatagaaggaatctagagggggatgaaggactcctgcaggagaaaaccaaagtcctcctggaggaaggaatcctcaattcaggacccaagatttttcaaaaattaagagcagggctgggtgcagtggcttgcacctgtaagtctcagcactttgggaggccaaggcgggtggatcgtttgagctcacaagtttgagaccagcctgggcaacatggcaaaacccccatctctacaaaaaatacaaaaccaggggtggtggtgcacgcctatagtcccagctactgtgaaggctgaggtgggaaggatgggttgagcccaggatgtggaagttgcagtgagctgagatcatgccactgcactccagcacagagcaagaccttgtcaaaaaaa

SEQ ID NO: 146921 - DNA, 425 bp, Homo sapiens
aaataaaggaaaatgtttaaaaaatttttttttacaaattaaattacaggttgtaccaatacccatttgagttctatgaaaggaaatggcaatcttttcttcttccatgaactcagtgattagggttttccttttaggctatgcctaccttcacatgtggctttttttcttcttcttttctttgagacagagtctcactctgtcacccaggctggagtgcagtggcgtgatctcggctcactgcaacctccacctcctggcttcaagcaattctcctgcctcagcctcccaagtagctgggattacaggcatgtgccaccactcctggctaattttttgtacttttagtagagatggggtttcgccatgttggccatgctggtctcgaactcctgatctcaggtgatctgcctgtgttggccttc

SEQ ID NO: 146922 - DNA, 135 bp, Homo sapiens
cagttgctactggcattgagtgggtggaggccagggaagctgtcaacatcctacgatgcataggacggcccccaactgagaactacccagtagtgccaaggctgggaaactccgctttgtagtcacatggctccg

SEQ ID NO: 146923 - DNA, 585 bp, Homo sapiens
caaagatatatcttaaaatcactccagaaggtgcccttgtaaccccttctaatcatttgccaccccataagccaccactgctgggatttctgtcacctttgaacactgttttaagctccaggttggcatcagttcactgaaatgcctttttgataaccctgttatggatggctgtggtctaggagcccatttaaagtgattctgcaccctggatcctttagcagttatttactcactgttcattcaacagatatttggtgagcccctactgtgtaccaaacactgtgctattcctagaagcttagcagtgactaagacaggctcaggtaacatgctggtggagctcacagctagaagggaccacagaaagcaagtaaacaagaaccagggcctacttctggactttgcctgtctccaggctgttttaagtcaccctattctggcccatcagtttgcccaataaatatatactgagcagctaaagtgcacccagagaggctgcgcatagattctcccctccgtgaagcagcacagcatgtgcttaagagctcagattttggaaggagacagccttggtttgaatat

SEQ ID NO: 146924 - DNA, 288 bp, Homo sapiens
ccacagaggcagagtcttctctcatccaatctgctgcaccctcagatggccaacagcttgtccccacctctccccaaactgatggcccactcagagcatggtccttgtgtccacagcagcatcccctgtgtcctagctagaaatgcaggttcgtgggccagccctgacctgccaaagtggaggctctggggccagggtcccggaaaacattaacaaggcccccagatgcttcttctgtgaactgctacttggtccatgggggaaatagcacatatgcaggaagtgctg

SEQ ID NO: 146925 - DNA, 407 bp, Homo sapiens
gtatttcataaattgatatcagaggtgaatatataacaatgccaagtagaaatctagaaaggttaaagaaaatgagaatttagaaataaatgactgaatttagcaaacaagagttaaagagttttcagagcactgttttagtaatatgagtaaaaagaatggtagcaaacctgataaactcatggtcagaatgaaaaatagacaaaatgcctgcatataaattttaacaaactttctattgggatacttgatttccaagtggcaataaagtacaaaaccaattattgatacattcaactacccacagttgcctctatcaaggagaatttttactttattttgtttggttttggcctctgtgcctttgatcatgttttcttacccatttcaaaatgcccaaatcttaa

SEQ ID NO: 146926 - DNA, 460 bp, Homo sapiens
actggatgcaaagtgtcacaaatggaaagagacaaggaaaacataatgaccccatgcaatgtggtattctgcactggatcctgggacacaaaaaggacattggtgagaagctggaaaaatctgaataaattctagctttgttaaaaagtattgcaccaatgttactttcttagttttgatcagtataccaaatgttattactaccaggggattctggttaaaggacataagggaacttactgtactatctttgcaactctttgaataattttagatttataatagacatgcttttcttaagactgatcataccaagttgttgaggacacagaccaacaagaactgtcatatactgttgcttgaaaaatgtaaaacagtatgtagtacaacaactttagaaaacaatttggccacactgggcacagtggctcacgcctataataccgacactttgcatcga

SEQ ID NO: 146927 - DNA, 1007 bp, Homo sapiens
  misc_feature (491)..(491): n is a, c, g, or t
ccagttatacagctcagcagcaccagcggcatctcttatgcagagtctcagacggtcatcccggtcaaaaaaggtcagatctataccgtatccggcttgcttaaaacggatattgacagtttaggaacaagcggaggagcctggattcatgtctattattacggcaattcaggaagtgtcaatgattttgccacaaagctggttaccacagataccgactggaccaaatatgtcaaaacattaagaccccaagaagatggttattacaagatccgcttagaaatgaagaacgcctccggaaaagccttcttcgataacctccgctttagctacgccaatcaggtcacggaatatctgtatgatgccaagcagaactatgtcacccaaataaagaaccaacaggatcaagcagccacctatgatctggacggctacggccaagtcaaaaaggttattacaccagaaaaccagctgttgtaactggccagttncaacagctcatgatgttggcatgaccttgtatctccacttcatacacactaatactgtggaggaggatcaagtcgttgggtttagcctaggcatgccaagggtatggcatgagcatggaacacataatgctagaactgccagcccagtcttaatacttagcactggttgccagtttaaaaaacaatacaaaggtataggtaaaatgttaaaggaaacttgtactaatttatgtcctttgaagtgacctttttgtgtctcatggactctgggctgtagtacctgactatcttctgcaactcggatggagaaaatgccccttccttacctggcaggcagtgagccaggttggacattagatacatagtcgacttcacctactctgtgatttagcttccagctttacagtttgctgtcttggcagcagcttgtgcatggtgaacttttctgactagaacagttaataacccccacagatgttgggagcccagttttgcagctgttgtaactggagttgg

SEQ ID NO: 146928 - DNA, 326 bp, Homo sapiens
aggacttgctgatatatgggatgtgggataaaggaaaagagaggaaccaaagatagcacctagatattttttggcctgggcatctaggtctaagatggtgccatttactgaggtaggaataggtgaagtgtaggaagaatatctcgagttcggtgttaagcaggttaaacctgagatgccaagtacactgatttccaagtggcaatgtcaagtaggcagtgctatatttgagcctggggctcgggcaagagaccagaaatgaaatgagataatgagatgcatatacacacagtctgaagaaatgacttgtgaaacttggccaagac

SEQ ID NO: 146929 - DNA, 564 bp, Homo sapiens
tggcctgtttgaataaaaaccatttgatttagaagatgttgaatttaggaaattattaagatgatgtacatcttattaccgtagaagatataatttataaatgttcaaatataaactcatctaatcataatgtttagagggttttatacttgatgtacctaaaaaaaggtagaaacatttttcaaaatcagcaaagttcttttaaaatcataaagtaggccgggcgtggtggctcactcctgtattcccagcacttcaggaggccgaggtgggcagatcacttgaggtcaacaagggcaaagacaattttttgagagccatgaaggcatcattatattatggctcactacaattacgttcacaacagtgaccttctttgagtcttaagaaaaagttgaattaatttaatgtattcagtgtactatatttaattgtaaaagttatgtgttaaactgtaacttaaataaaatcctacttatatgagataccacatatcaattatggctagataatgcagaataggaaaaagaaaaagactgcagctgtgtacagtcctattctgtg

SEQ ID NO: 146930 - DNA, 431 bp, Homo sapiens
tgtccttgaagcttgtatctgatatcagcactggattgtaggacttgttgctgattttgaccttgtattgaagttaactgttccccttggtattaacgtgtcagggctgagtgttctgggatttctctagaggctggcaagaaccagttgttttgtcttgcgggtctgtcagggttggaaagtccaagccgtaggacccagtttcctttcttagctgttgtaactggacaacagtgaccttctttgagtcttaagaaaaagttgaattaatttaatgtattcagtgtactatatttaattgtaaaagttatgtgttaaactgtaacttaaataaaatcctacttatatgagataccacatatcaattatggctagataatgcagaataggaaaaagaaaaagactgcagctgtgtacagtcctattctgtg

SEQ ID NO: 146931 - DNA, 337 bp, Homo sapiens
ctagatgactattcagagatttgtgctgagtgaaaaaagcaatcccaaaaggttgtatcttgtaattccatttatgtatttttcctgaaatgacaaaactgcagaaatgtagaacaaattagtggctgccaggtgttaaggagaaggtgaagataagagaaaaatgtgtgcagctataaaagtgcaacatgagggatccttgtggtagtgaaactattcggtatcttgcttatatcaatgtcagcatgttacttgtgattttgtggtgtttgatttttttggcgttgttatagtttttccattggtggatattgggtgaatagcccatgagatatat

SEQ ID NO: 146932 - DNA, 331 bp, Homo sapiens
ccggtaaatttgatactgtgccggatatgtagatactgtgagaatcagatataggcgtcaagtgtacctgggaagttgaaacagtgctggcatggggctaagaatttgggctcaaaattaaaaatagttaggtgggaactccattactcccttttgcatgctgtgcgaccttgggcaaatcactgagctgctgaaagctgcaatttccttctctggaaaatgggtgtaataatagtggcacacattcaaggctgtttacggatgaattgaaatcagttcaataaaacatgcaaaggtcaagcagactcgtgcttaaaatatgccttcatta

SEQ ID NO: 146933 - DNA, 656 bp, Homo sapiens
taagcatacattaaaagagatagtcagggactatctcttttaattagtcagggactaattagccaggaacagacacacctaactcacgtgatggtttcattttccttccttctgcaaggatgagatcagtcacaaactctcacatttggccttttagggtggatgcaattttgcaagtttcagaaatgtgaccctatctcacataaccaagagatctctggtctgacaaattcctgggcaggacagcctgtggcatcctccctaggcccactgtggatccatggcctcagcaaatacatgtgctttgtaaaaattgagaaagcagaggtgcaaaagacagctccatcggcccatcctataggcctatagagacccccttcctcttcaaagcaatactgcaccaatcagagagagaatgggagcagagagagagtaagaagatggacatccccagaaggaaacagagtgaggagaaatgggagaagataaacaaaaagaagaaagctgaatattggaaagatggaaaagatggcaggcaggagaaaaatttacactaaataccttgaggtttcccctttccacccccaaatgcaggctcataagcagcagcatgcaagacagcgagtttctagaaggctgatcaacccgtcttctaa

SEQ ID NO: 146934 - DNA, 179 bp, Homo sapiens
aaaggccccctgacgggctgcacttgaccctggttccagatcctcttgactccccatcgtctgtgccccaaaacgagcagcagccccaccccatgtgtccccaggatgaagaggggccacggcagcctccagggagcacccgggggcaggtacctagtccgtctcacaggcccacgggg

SEQ ID NO: 146935 - DNA, 233 bp, Homo sapiens
ccttacctcaagtgatctgccagccttggcctcccaaagtgttgggattacaggcatgagccactgcacccaggctattttgaagcaaattccagactggatattattccatgcctatgtgtcatacttccacgtgtgtctctaaaagataaggaaaaaaaattctgccacatctagaatgccattatcactgtttaaaatcacacaattccttattctcacgtgtttgtgta

SEQ ID NO: 146936 - DNA, 238 bp, Homo sapiens
ctaaataattaccttactttattggaggctcagattttgtgagttacagctagttatgggcagagttcaatacagtagtttttctactgtatagcatacattctggaaagacaaattgctaattatttttttctatgaattttctaagtatctactgaggtatactgtgctagttgctggacattcaaacaaaatctgaaaactaagttcctgacattcaagaacagtgtcatggggg

SEQ ID NO: 146937 - DNA, 305 bp, Homo sapiens
ccagaggcaccaaggaggctagaagttaggaaggtagagaaaaaggggagggaagattgtgctgtgtataagatgcctgttgtaaaaattgcaaaaatgactgctagaggcacgagggaactatccgagtaagttgtttattgagtaatagtgaattcagtttgaggaatcttagagatgggtcaattggtaattttatagatggaaccatgagattagtaactcaaggcgttacaccatttaatggcagatatgtgatgaaaatccagtgtctttccctccttgcaccaccctctctccatgat

SEQ ID NO: 146938 - DNA, 266 bp, Homo sapiens
ttcttttaatgatggggtatgcaataaaaatacagcagtgcttcatttagccaaaggagctggagcaaaaaagacctaaataaataaataataaacgtgcatgggccacttaccaaaactaaaatcatttcattcaaccttttacaggaggtgcatgcagtattttgaaagcaaaaattctcataacacaaacctccacttaaaaatcactgccaagggctggaaccatggcaggatgttatttctttttcaatttattttttaat

SEQ ID NO: 146939 - DNA, 253 bp, Homo sapiens
taattagcaagagagtatttttatccccatattatgagtaaggaaactgagactagaaaaagtgtactgtttgcctagggttgctcagctggtaagtggaagagcagagatttgaatctgggttattcttacttcaagtctctagttctacactgtcaaatgttgctgcttctctcctaacataggttatgttattggggctccaagtctaatgatgatttagttggtcatccatataaaataagattcacca

SEQ ID NO: 146940 - DNA, 140 bp, Homo sapiens
actcttatccttgaccccattctccagtcactatctacctctccctagttacctccagcatactatcaatctcacccactctctcctcactgcctccaatccttctctagcaaagaattgttggctatgtgtttcccttt

SEQ ID NO: 146941 - DNA, 396 bp, Homo sapiens
aaaaaaagaaggcaggtctcttaatagctccaaatgtttttctaatatgtaaaatgggtattaaaaatgcctaactagcctggacaacatagtgagatcccgtcctacaaaaaatttgaaaaaagcttcttatccctgtagtcctagctacttggggcgctgaggtagggggatttgcttgagtgcaggagttttgaggttacattgagtagagatcacgccactgcacatcagcctgggtgacagagaagaccttgtctctaaacacaacaacaacaaaactgcctaattatcacagcttgctatgtgattcaaagtaattctttacagaaagtactgtgggcattatgaactaatttgtataaattctagttattactgttgtttctgttatta

SEQ ID NO: 146942 - DNA, 357 bp, Homo sapiens
tgattccgaagagtcaacatgggcacccaagtcttctgtctcctcactgagtttcttactgtgtcatagtgctaataacatccaaattatgaaataaaactagaaaactggaggagtaaatgtatagtttacaattgttccctctctctcaagctatagaagaaagtttataaaattggttctaatttcatccagcactgcattttgcttcttttgttaagcgctatgatatacataaaagttatgagagaacttctgggataatttaaagcaaaacaccaccagatcactttctattcaaaatttgtgtactccaacaacctcctgtctttattcaatgttggctttactttttaa

SEQ ID NO: 146943 - DNA, 407 bp, Homo sapiens
ttcacaactctaacgtcaacacaaggctccctcaattgccttgctgtaaaataggtgaataggtgtagtgggagattcagtggccaagcctgggtcccaggtaaggtgactaaccatcccagttttcctgaacagagaaatttcccaggaaactttgggttttaaagccaggaaagtcccaggtaagcaagggtgagttgatcaccctggcagggaactgattcattcaattctggataattgaataaagtccacatcctcaccgggaacattctactgaatgataagaagaagttccttctagttttgcctgtttcttttccaggatctgggtccatgggacccctaccttatcaactgtccccatacccaggccctggctctcatccctacattgacctccaccc

SEQ ID NO: 146944 - DNA, 307 bp, Homo sapiens
ctttgtgccgctgggactgataaatatttaagctgacttcctccctcgtgaagcattttctgggttctttggagatttccggtcctgaaactgcaaaacatctacagcacctatggcaaaagccagtgaagcattctgtttgtgaacaggctgttttccccattattctactccatggggaaacttcttgtctcccagtagtccccttggggaggatttcagatgtctccaggacagtgctctctcccccttggcacatctgtgttttgtgaaaaatgatcatccatcttttacctgacaaactttg

SEQ ID NO: 146945 - DNA, 375 bp, Homo sapiens
tgcgctttcctgagctcatgctgatgctgaccaaggggtgtgggggctttggagagccaatgcctctgatgatcacccaggaaacatgccttgctcatcagataaggccacatagtacccacaggacagtctcctggctgcaactagtcagaccagtcctgagaaggtctctaacaaggcaggctaagagaagtatggggatgacagcatgcacctctgtgtccagggggctgtctggctggcgtgggagatgtgtgtcgctcccaaacaaggagtgcgttacagaacagtctggacactgtccagcttctcccgagtgaccaccaggcccctgggtgggccctgcacgagcaggctgctgccttcccagacaga

SEQ ID NO: 146946 - DNA, 529 bp, Homo sapiens
tggccccacctcaccccagaaacctctctccccaatactgggtttctgcttttcccagcaccagcctccgtattcttaggaatgcttaccaggtccgtggccctgggctctcccctgccatcacgtcagggtgggcagtgctcggcctcggacttgtcttcctctcccactccccagtgagtcagggctctttctacacggggtcagctgactgtctcaccaaatggccctgccgcctgttcagccttgtctctggctttatgtgtccctgtcactacacacctgttgctgggtcaacaccaagggagggagttggagggccataaatctctcttcctgccacttcttcgaatcccttagtcacagctgtcacaaatacttctgaagcacaaagtaccttgcccccttaagcctgatcatgtttccctcccctaagcaagcccttaagtttcttagcccaatcaccagcacctctaaaggcatctaaaacttcattcggtatcagagaattataggggtggggaggtgc

SEQ ID NO: 146947 - DNA, 266 bp, Homo sapiens
tgatctgtcacttaagtggcctacctagggcccaagccaggctgttaactactacactgtactgctatccacactttaccttttagttttttgctttttgccattctgcttaatacctttcaatttcactatgtgatttgtatatctctttagccatattaagacaatggaattattgatggaagtctgagagcaaactactatttttagtggcttcctttacccacaggatgtgagggaaggtctttctcagtctggcctccaat

SEQ ID NO: 146948 - DNA, 444 bp, Homo sapiens
tctcctgccacagcctcccgagtagctgggattacaggtgcctgtagctgattattgtagctgattactgacagtgtaacttcagtgtccaatacagaagtcccagccacatgtggccatttaaatttagacaaactgggcttggtgactcatgcctgtaatctcagcactttgtgtttttttttttgagacagagtttcactcttgttgcccaggctggtgtgcatgcagtagcatgatcctagatgaaaccttgaactcctgggaggatcacttgaggccagaagtttgagaccagcctggccaacgcagtgaaaccccacctctacaaaaatacaaaaattagctgggcacttgtggtcccagctacttggaaggctgaggcaggagaatcgcatgagcctgggaggcagaggttgcagtggagtggagatcacgcaactg

SEQ ID NO: 146949 - DNA, 805 bp, Homo sapiens
gtctaattcatagtaagcactaagtaaatgttagctgtaataataattatttttagatttttggattcagactctgctcttctctggcccttatttattcataggacaaattcagcatctgctgcatgctgggccgggtgcccaggcacctggggtacacagactatgtcagaagaaggtcctcctcttggagtttaaggacaaaaaaacaagtgtattagggttgtgaaggagagatgaagggggctacagcatcgcctgtaaaaataggacgtccaggggctgggcttcttcccctaccccctcacccctactacgttcctcagcttccagagtctgcaggtagattccctcaagtcctctgaaattcttctccagggacttgtgaggagcttgggctcactggacctgtctctactagggtgggcagagcaggctctccccaaaacaacagaatcttggcttcccagccccagcctggcagagcactagcctctgggttttaatgagctgccctgggttagaaacaggacgtgactgtggctggctgagaatcctgaagatcttattaaagaatcatctcccttgtactttgggctgaaatgctctttccaaccaaggatcaaagcaaacttgacacacattctctcattaatctccccatcccctggggcgggagcagatcggtagctgttttctctggttctcaaagagggaagctgatgcgacattgacctggtgtggcttgtggaaagacctcccccttggtcagatgctgaacagggaccaggacccaggcatccta

SEQ ID NO: 146950 - DNA, 421 bp, Homo sapiens
tccactagtgtaggcacacacccgtggtcccagctacttgggaggctgaggtgggaggactgcttcagtcccggaggtcaaagctgtggtttgcaccactacactccagcctgggtgacagaacgagaccctatctcatgaatgaatgaatgaatgtaaaatgaaattaaactaaaccaggctgggcgtggtggctcatgcctgtaatcctagcactttgggaggatgaggtgggagtattgcttgaggccaggagtccaagaccagcctgggcaatatagtgagatcctgtcactactcttaaaacacttttttaaaagacttttcctcctttctcacttgcttagagtcatgaagctcctgagagcagagccagtctattcttactaagcagcacactatccatcacttcccaagtggc

SEQ ID NO: 146951 - DNA, 371 bp, Homo sapiens
agagatgaaattagacaaaatgatcactggtaaaatatgggaattcattctgttcttgctacttttatgtatttttgaaactttctataataaaaaattattttcaaaaaaacaactgaataggtggccggagcaagggtgggggaggaatttcaccacccatctttttgtaacttttgaatgataatatatttatattaccttttgaaataaaagttttaatattgtcaacatctaacatattagatttaataaactaagcattaaccaaaacataatggtacgtttcttcccacaaaaataaagaaggagaattaaagaccctgaacaccatgctattcaataactcaagctgtacgtgtgcaggtgag

SEQ ID NO: 146952 - DNA, 251 bp, Homo sapiens
agtgctttatgtgtaacacttcatttcatttttacaacagctctatgaatttcgtactatcattatccttatcctacagcgaggaaactgagctacctagaggctaagtaatttacacaagatcaaacacctaggaaatggtaaaaatgagatttagtctgggactccagaactcagtctcccctgccctgcccttttttttttcttttttttttttgagacagagtcttgttctgtcacccaggctggag

SEQ ID NO: 146953 - DNA, 113 bp, Homo sapiens
actggctgctggcacaaaagagtagggtatcacaaagcatgaaactgtgtaaacaggccaaatttcagggactttttgaggcatttcaaaaatctagccctacccattagtga

SEQ ID NO: 146954 - DNA, 748 bp, Homo sapiens
gggatagggagaggttggttaaagaatacaaaattacagctagataggaggaataagttctagggttctatagttctggagggtgactatagttagcaataattcattgtatattttcaaaaagtgagaagaaaagattttaatgatcttaacataaagaaatgatcaatgtttaaggtgatagatatgctaattaccctgatctaatcattacacattatatacatgtatcaaaatctcaccctgcacatacaccatggaataccatgcagccataaaatgaacaagattatgccttttgcaggaacatagatggagctggagaccattgtccttagcaaactaatgcaggaacagaaaaataaatactgcacgttctcacttataagtgggagctaaatgatgagaactcatggactcaaagagaggaacaacagacactgggacctacctgagagtggagggtgggaggagagagaggaccagaaagatgaagaagcaggtataagccaaatgttgagagttagagaatgccagcctgcagttgtcatcacccaggcttagtacctgggtgatgaaataatctgtacaacaaaccctcatgacacgagtttacctatataacaaatctgcgcatgtaaccctgaggctaaataaaagttttttaaaatctcactctgtactgcataaacatgtatgaatattatgtgtgaattaaacatttttaacatcctttaacaaggtatca

SEQ ID NO: 146955 - DNA, 415 bp, Homo sapiens
tctgttccccttcctggaacactctcctccttcagtattcatgactttctcaggtctttattgaaacgtcactgtttcagtgatatctttccagataagatttaaaattgaattcttaaaaaaagaacttacaggaatacacatcttggggcagggtggggggtggatttaagttctcctgcaccaatactctctatcttccacctttattttcctttatagcaattatcaccatctaacatactatatattctctttacctattttgtttagtgtttgatttgctccactaaaatagaacttccattgcgtgcaggcgtttttgtcagttgtgttcactgatgtatctccagtacctagactaggaatgttttagtagctaaatacattcctaaaggaatgtatgtctctggct

SEQ ID NO: 146956 - DNA, 322 bp, Homo sapiens
gctgaaccttcatagtattcagtggcaaaaggctgaaccttcgtagtattcagaggcaaaggctgaaccttcgtagtattcagaggcaaagcctgaaccttcatagtattcagaggcaaaggctgaaccttcatagtattcagaggcaaagcctgaaccttcatagtattcagaggcaaagcctgatccttcatagtattcagaggcaaagcctgaaccttcatagtattcagtggcaaaaggctgaaccttcgtagtattcagcggcaaaaggctgaaccttcgtagtattcagaggcaaaggctgaaccttcgtagtatt

SEQ ID NO: 146957 - DNA, 419 bp, Homo sapiens
atcctatgcctataaacaatcccctccccccagaccccagcaggcagacacacaggtggctggacatggcgagaagcacatcaggaggcaccagcacaccagcaggccacccaccagcagaacgacatttggctagggcagccagaggagagcccagtccacctagcggtccgactccaggggaaaaccatctcccttctgactccccaatctgctgagagctacttccactcagtaaaaccttgcactcattctccaagctcataagtgatccgattcttcccatacaccaaggcaagaaccctgggatacagaaatctgtctttacgataaggcaggggtataactgagctaacacaagctgcctatgcatggctaaactaaaagagcaccctgtaacacgcgctcactgggacttc

SEQ ID NO: 146958 - DNA, 604 bp, Homo sapiens
tgattagttgaccagtgagctatgcactctgcctggagcattactgcaaatgagcctaggacctattgagagaaggtcccaggggtgaagtaacagtgggaggccttacagttgggaagtgaagcttaggtcttccctgttctccaggccagactcaaactctgtgcctgatctgcttcccaagagaggaactccttgggcagacctggagaaaaagtggggattttggatggtccccaaaggagggtaggggtagaagaggagtcgaaacagagacaggaggaagtccaagacaaactttccttccttaatacatagtgctcgggggcatccttctggctgtagcatctgcgtaatagctgctcctaagaatgcaacgtgagctgaattcaaacatgaatttggagccagtacctgaatatgtgggttgttctatgccaccgggccccctgcctgtttaatttctccttcccctgctgccaaggcttccgagaagttgctgtgtaggtgcttaatgcttcggagatggtcaggtatgagtttaaatcctggtctcgggcactttaattgctaattgtgtagcactgagcaaaaataataggga

SEQ ID NO: 146959 - DNA, 357 bp, Homo sapiens
tcctgggtagtgtacctgccaagcaagccactggagtgtgggaagaaagttctagcgcttctatttcttgccgtgtgtaacattttattatgaaatatttaagacttcctcaaagctccaaagactattcttgggaagacctatttctgtcacataaagaggttaatctttactactgtggagaatggtttggtcctgccgggtgggagggcccccctcctgcagcgtagtgtacctgccacaccctcctccctctggcacagagcttttcctgtcctgccgctgagaaccccggtggttgtagtggcatgtaagggaggcagggggcttcagcgtctccagcacaggttcaaggac

SEQ ID NO: 146960 - DNA, 344 bp, Homo sapiens
ctcccaaagtgccgggattacaggcgtgagccaccacacccagccttgagacagtttttatgtctgtttcttcatttgtgcttcatgccactgttgtgaggtaggccaggcagggaatggtgacttctctttttacagataggcaaattcaggttggactcctgtcccaaattggtaccagacccaaaggacctgattcagggttaaggtctttcccttccattacttaaatcttccttctggttcccactggaggtggtggtgggtggtatgtgagtttgtgatgtctggatccagccaggaagaaaatcccagcatccattaactgtgaccttgtgcaagac

SEQ ID NO: 146961 - DNA, 324 bp, Homo sapiens
gtgtggaacagagggtgcagaaggaatgatggaaatcaaggtttctcaggcaatgcaaagtgcccacatgccctggacaaggagccgggttctgctcccgaggtgacatgaaaattgacatagggtaagtttgttacaaacacctacgaagggtgaagaatgttccagatgaaaatgcccaagactcaggcaaagtcggcttcgagtagagctgggaggagctacaggtactggagcgacatcccgggggctctggacggtgaggggacacagtcagtgtctgaaaggccagagtgaggctgggttcgtacccacatagccaca

SEQ ID NO: 146962 - DNA, 465 bp, Homo sapiens
gaggcaggagaatcgcttgaacccaggaggtggaggctgcagtgagccaagatcacgccattgcactccagcctgggtgacagagcgagactccatctcaaaaaaaaaaaaagaagtgtaatatttgatacgaaaaaaattaattagaatgcatggccaacgtcgtgttccccagctctgtgggtttacacatatttttccacaaacgaaataacacatgaacagcaaagcttagggctaaaaagcatacccatttagacaatctgtaaatatatacttggttgaaataacactgtgagagtttgtgcacatttctttggttgttttcgtcatctgcatcatgtctgaaataaagtgaacacctgagactaccacagaaccaaaacaccaccaatcctgtggaagctacctgacttacagttttgaaggacttttgacagccatggggagaattgaccctagggg

SEQ ID NO: 146963 - DNA, 651 bp, Homo sapiens
ttcttagggagctaagaagtataatagcaaagccaaatgagggaaggagggaataaataggaagccttgcgtgtgctggtggaagcacagatgggggctgctgttctgggaagcaatctggcattacttaagcaaattgactagttatctactctgtgacccagcaattccgttcctacaggtggacacaggaatgtgtaccagaggtccccaagaggacatgtccaaggttgtttacttctgttattagtggtggaggggaatgggaggtaactgagtgagcattgcttgggggagaggaaaaatggcgggtgcacgtcatggagttgtctgtagctgtagaagcaaaggattagataaacataaggaattcaaatagattttaagaatatagtgcttggtgaaaagataagagtgtgaagtacataaacattaaatcctttatgtgagtttaaaattcattagcccagcacagtgcacattttgtaagagtacttacataaagtacatcttacataaagatactccttaaacacgttagaatggctgcctgcgtgggatccagagcatgggagtgggctatggagatgaaaaggaataaagaaagaaaataatgataatgtgccatgaaccgggaagtataagcgttga

SEQ ID NO: 146964 - DNA, 375 bp, Homo sapiens
aagaactcaatgaaggacctgccactgagtgctaggaaaccagcaagatgccatcctcatggggcagacaggtgctctccaagtgcaggcagagaaggtgctcaatcctggtgtctgttgtcacatcagaaacctgaactaaaaatgtgaagccgcttcctctctgaaggaggagactcaaggggttttatctggccacagcaggcagtcatacttcctcaccagactccccacttaaaaggtccagcagaaagggccacaggctggaaaatcaactcaaaggttagacccttacctgtcctgtccccaggcattcaccttaataaaaaaaatcactcaagaactatagggattaaatatgacactaaaaataca

SEQ ID NO: 146965 - DNA, 137 bp, Homo sapiens
ggcctccctacccccagaggcacctgggagagtcaggtgaggtactaaagattctagctctacctcgccatgcccgactgtgagcaaagaggcaattcctgccacacgcagctgatttaaggcataaacgagaggga

SEQ ID NO: 146966 - DNA, 256 bp, Homo sapiens
gaattgaactttcaggatctcaagaaccagctcaaccacatgtctgtatcctcaatcaagcaagctgtggattttctgagcaatgaggggcaggaaagggcggggtactggtggcacccccggtcaggtctgtgtctgagctgagggctgagcagctgctggtcaggtcttgttggcccagcagcggagggggtggctgagacgcctctgaccgaaggcattggggcgagggatggcagcctgagctgcagccagg

SEQ ID NO: 146967 - DNA, 414 bp, Homo sapiens
catctccaggaccttggcactaaaggtgccagtaagatcagaaacaatagagatatcaggggaaagatcctacaggacaggcggaaccaatgagcctcctttctcctcactcaacactgggcttgggtcagtccagtatatccttgacccaacacttgggtcagtccagtatatcctctgtactgcccagggaaatcagaatgagagggacagtagcttgtcaaacccagtcctgctgaggaactcaggcctccaggctccagggaaaaggctgaaaatgaaagagctttcctagatacagagtgactatttttgagctgactctaataatctactatttcaactaccagatcatcctctcatgggatcacaaagacaggcccaatgcagaatctttaagaaccctagaaatct

SEQ ID NO: 146968 - DNA, 465 bp, Homo sapiens
tcgagctcggtaccagttcgacggagactctcttctttcaatattcatgggtttaaatcaccttttccaaaacaatgccttaattctgagatattgtctatgtctaataatctgtttacagattttgttttcatggcagtttatttccatttcacctaaagtgcaatttcaaatccaagaaccaagatatatgagtttagtattccaaatgatatatagaaataacttaggcaattattccaattttgtatattttaaaataaagcctgcctcattaaaataataatagtttgtgtgtttctagtccagtcatcccaagagcatagctgcatccaaatgcatatgtaatagaattatcttcaaatatgctctaagcaaccagaaatactctctagacaagatataccataacactttaaaaaactgagttatgatatatcttgtctagagagtctccgtcgaact

SEQ ID NO: 146969 - DNA, 247 bp, Homo sapiens
gcatttttttccagttactaaatggctgaacctgaactctgcattcggctcagagacaggggaaatatctacagttctctctactatcctagaattggaattgactgcagattaacacttatcaccagagtgcaaatgagaagatgcaaaagaaactctatttccagcttgtctctctttatgggaaagcctcagtttttttctttccagttctctgtttcgttttgcttttcccccttgcagcaca

SEQ ID NO: 146970 - DNA, 511 bp, Homo sapiens
tgctctagtaactgtgtcctgcctccccactcctgatccctcctgtcagtttcccactagctaacccgtcttccagtagggtcctatcctgggggttattacaaatgctggtagcagcatgtcatggaaagtttgctctgtttactttaattgttgttgctttacttctgcctgctgcaaagaccccttttctttacagtccatcgtttccaacccatgcaatgcacaacctaataccaactgagctggcaccactcctttgatgtattttttcagaggaaggttatttttgctggcttgaaaggttttcttttctagctttaggtaaaaatcagcaaagattccagttcttatcaattgagtgcttaagtaaacagagcaggtgccaaagtcaataggatatggaaaacaagattctgctgaagattatttgtaatggggatcaactgctgacatagaatcaggagttcacacttgatgaaaaagaacatgaaagaggaaagagcccaaa

SEQ ID NO: 146971 - DNA, 134 bp, Homo sapiens
actttcttttttcaccattctttttctgaatttgattactcaagtatctcatatgaatgaaattatatagtgtttgtcgttttgtgacttgcttatttaacttaccataaggttcataaatgttgtagcatgtg

SEQ ID NO: 146972 - DNA, 279 bp, Homo sapiens
aattagcttgcgacaggcataaaaaggaatgagatcatatcctttgcagggacacggatggagctggaagccattatgctcagcaacctaacgcaggaacagaaaaccaaataccacatgtcctcacttgtaagtgggagctgaacaataagagcttctttacccctttttccctgagctccttcaaaagttaggtgacttgcagcctctacttcttggcaacctcattaacccattaaagtttggctcctttgttttccgttaaagactgcgcatttc

SEQ ID NO: 146973 - DNA, 128 bp, Homo sapiens
catttcctactatatttccacttatacatcttcctttctgatcatatgtctaaatgttttacataatggcagtccttataaacatatagttatcctgcttttctcagcacaacataaaacatttctat

SEQ ID NO: 146974 - DNA, 328 bp, Homo sapiens
actcatcatatgagtaggtattcttatccccatcctacggttgaggaaacaatcttggagaggttaagtaagttgttttgttttgttttactactggtcaatattggagctgaggttcaaacccaggaagctgactcctgggtcaatgaagcccttttgggaaacatttcacctctggtattggctttgggctttgaaacacattgtcctttattgctttttaacaatgaatgagctttgtatatgcaatttgccctgcttccctatgctctctttcctaaatgtgactgttggtgtcttgtggcctagaagtgcctccagctccccg

SEQ ID NO: 146975 - DNA, 144 bp, Homo sapiens
ccatggttttcttgattttacacatgaggacttcaggcagaaggcagggaagctgaccaaggacatatggacttttggaagtggcaaggcccggattctctccagaatctgaccacagttcccacttttcacctgatgactgcg

SEQ ID NO: 146976 - DNA, 390 bp, Homo sapiens
agccttttgactagtattatcatccttaactttggagttatcatatagagggaaattatgtatattacagtgaaatttttgtgcccacagttcagtattacttgagataaaagagaactctttaacattaaaggatccttctatttttttctcacctttactggtctgctttttttatcctagaattataaggaagctttaaaatttgctaatataatcccattcctttcatcttgttctttgtctctagttttcttgtttaaaagttttagacttcttacagattttggtcagtgaaacaccagggaaagagtccatgaccagtaatttcaggaaatgcagtgtgattattttcttacttgtagaaattccaatgcatgttgaagctcc

SEQ ID NO: 146977 - DNA, 239 bp, Homo sapiens
cccaggattatgctcggggggtgattaatcatgatgtatggttggtttgtcacagtttggcaggaagtgggaccaatgactgctgagagtcatcacaatactaatagtataacactaatagtattcataatttgttatttgctaatatatacaaatatagtattatactatactataatagtattagttatagtggtatagtatgtgtatatatgtttgtgtatatgtgtatgtataca

SEQ ID NO: 146978 - DNA, 536 bp, Homo sapiens
gtattccagttacaacagcttcacaggaagcctctctcaaacaaacaaacaaaatggggagggaaggggaggaggaagtgagggagaagagagtatgggaaatgaaaagtaggttaatgtacactgcttcccagatactttagttctcgacccatgcctagacaaaagaaacctgccactaccactgctagagtcaaaagttcctctgtcatccaacaagctcagaacgaccaacgaatctccaaacagccttggcagcccaacaataccagcaaatgtcaaaccaaaatcctggggctccaaatctgtcattacagtttcaactgaggctcacctcggtctgcttaagttcaatatccgcactcccaggaaatcctatttaaagagtctttctggcttccccacccatttgccttcctgaataaagaaagaaaactactataaaccatcagtcaagctggccaactacagaaaagaagcaattaacggatttacctgcactatctttggtaatcactgagctgttggaagtggcg

SEQ ID NO: 146979 - DNA, 494 bp, Homo sapiens
cataaggactgcagacttctaagcacgttcaggttgttggcatcggttttaaatggtgatgccttgaatgcaatgatacagtgggtttggtccccgatgtaattggagccttaaattttaaataattctgtatgaattaggactaaagatgcaacaagaaactttagcttctaagctcagctgctaacaaactcaaagtattaataatgaggtggagctacataaaattgctgatatttggtacatttagttctcaagaactgactgattatacaaaaacagtaatagcaatagtgaacaactagagggtcaggcactgttctaagtgttttttattatttatgtcacttaacagaaactgacaatttgataaaacaggtaagtttcacttgacatgggaggggtggttcttaggggaagcccttttactgaatgtaggcagatctgcagtttaatttcctttggacagcgtttattcctctacgatctccagg

SEQ ID NO: 146980 - DNA, 523 bp, Homo sapiens
tataagacctttcactggtactccacaaacagtaacatatgtgtgacttgctagtgaccttgttaacatgcagaatctgatcctgtaggtctgtggggcctgagacactacatctctaataagcttgaccaggtgaatgtggtaaatatcagcagtagtgggatgggttgccatcagtcttcttcttatgcaatgtcctgggaagaatacagcaccatgtgtctggtattgccgctaaggaagcatgacctgagtccggtcacgaggaaatacagatcagattgagggttatcctgcaaaatgaaaagactttactctggcagggacatggaagtcaggaagagaaaagggaactattccagattgattgacactggtgagatgtagctctggggtagactcctggactagaaaggaaagacattgttgggacagctgacaaaattcaaatggggtctatggattggattgagagtgtagtatcagtgttgatttcctgatgtggaggcttgtatgctggtta

SEQ ID NO: 146981 - DNA, 281 bp, Homo sapiens
agcatgaagagggacagagctgctgaactcttggctctcagggccacagtcacctggggcccttctttttccagggggctgcttcatccgccgaagtcgcagccttcttccttggggacgtgtttacagggtcacttggctcctttctctacctttctggagggtgggggaaacccagccccattcctggcacctaaagttggaaactgagggaggctcctgggagtccccgtccctgagggaggggtggtgtctttggggtggctgggtctgagcagcgt

SEQ ID NO: 146982 - DNA, 315 bp, Homo sapiens
acaaaagaaaaagagatgaactagagacaataagcatacccaacttttcaaacagtttggtaataaaggaaacaaatggcatggtagctaggagatgtgaaatcaagagaaacattgcagcatgttatgttggtgggaatggaagaagaaagaaaaaagataaggcagtagacaggggaaatgacttggaggggttgaatgggatcctgggcacacaacactcaaatgtttattgagttgaactgttgctacccttaaacatgtcttggaaaaaggtggcctactaattcagctttctaaaattgtatacagaaa

SEQ ID NO: 146983 - DNA, 324 bp, Homo sapiens
ttgccagggcggcagggaggctactgatcctcacgcacctggtcctgggttccgccaggtatgaccctctctgtgccacagtgtccctgcagagctgataggagagtcttccttcctgagcctcctccatctctcctgcacccttccagaaatgatctgtggaccagcctacctttttttgcaaatgttttattctttagataatatacaaattttaaacagtcacagaaagataagaatataatgcaaaagagatttcttttccaacaacccccttctggaaccacttgagtgtagtgacatattgatgttctgctaccctgg

SEQ ID NO: 146984 - DNA, 351 bp, Homo sapiens
tatattctcagaggcaagtgatagaatggccttgggtacattttgtaatggaactatcaacagcagtctccttcgaatgcacatagctcctttcttcccctttacatactcaaggttaactttttggcatttttctagatttttgtgtggggatggctatgtaagtataagaagacttgttaaatgattgttttaaaactgtggttctgggccgggcgccgtaatcccagcactttgggagactgaggcgggcagatcatctgaggtcaggggtttgagaccagcctggccaacatggtgaagccccgtctctactaaaaatacaaaaattagccttgcatggtggcgtgc

SEQ ID NO: 146985 - DNA, 192 bp, Homo sapiens
attcttataactaataaagatctcttcagataagagcatgagtgtatatatatgtatgtatttctttttatgagacggagtttcattcttgttgagtgtgtgtgtgtgtctgtgtatatatatatgtatctaaatccttgcataccttgttcaattggagaattctcatgtttttcatttatcattgtaaca

SEQ ID NO: 146986 - DNA, 726 bp, Homo sapiens
agtttgttaaaaacaaataaacaaaagaaaaacttgtaggtgaacagacactataaaagactgcaatggcattccaaaagctgggagaaaatatttgcattgcccatgaccaacaaagtttcgaatataaaaagtcagagtcagtcaactacaaaaagaaaaccaaaagaaaagtgtgaataaggcatagacatttcatagaaatatttgtaaacatattcgcacgtatctataattagagaaaagtaagtttaaactgaaattcttgtgtcatactcatcatatttccaggtattaagtgtataacactgtcagcattagtgagcaacaggaactggcatacactttaggcaaagtgaatctttctacaatccctctagaaatctatttggaatcaatggtaaagtttagctataacactgagaaagcagttccactgctaagtatatgtcggggcaaggggccttaaactatctaggacaaaggaagaatgttttttaaaatttccagtcttttataaaatgtgacaaaaataaattattttaaaaaaggcttgaacccaggaggtgcagggtgcagtgagccgagatcacgccactgcactgcagcctggcaacagagtgagactccgtctcaaaaaaataataataaaaataaaataaaaaaagaaatgttaatacacttccagaaaacaataaatatgaaaacatggacataaaaaatata

SEQ ID NO: 146987 - DNA, 310 bp, Homo sapiens
tgtgtgcgtgtgtgtgtgtatgtgtgatgagaacatttaagatctgctctcagcaaattccaagtacacaatacagtgttatatacattagatctgcagagcttattcagcttctatctgcaaggttgtaccctttgaccaagatcacccgtcctcaactgatgttctactctatttctataagtccacctttttagatttcacaagtaagatcatgcagtgtttatcattctgtgcctgggttatttcacttggtataatattcatattcttgtaaatagcaggatttcattctttttttaaagctgaa

SEQ ID NO: 146988 - DNA, 645 bp, Homo sapiens
gtagctaggattacaggtgtgtgccaccgtgcatgacctttgtctctaatttttaaaaaacagacaaaaccttaggatctgtcttagtttataaaggggcatctattttgctttcagataacaccgtagagctgaaacattttggaaatggctttctaagggtcacgtctgatatttcaggctttgcctggcccataagtagactggatagtacttgtcaggtcctgaatatcatcctcaggaaaataatattctgcttctgctgcttttatccgtttttactccctctccttcccctggtcccaccatgtgttagctggtaataagtcaggtatcctaggatcataagttataattaagactctgaattctttaaaaaatgtctgaaagtcttccccaggtttaggacatttttaaactatgacctgtttttatccgtagcatgtaagtcaggaatttcatgctacattttcaggttgttctgttttataaggaaacagttgaactgttcttttcagagaagaaaggcaactcagagttagtagactgtgaatattcaggagtagatgcagtattcaggtaaaatgggagcagtaggagttacattagtttatctgtctttggtgtgggaggtaatcttgcgtt

SEQ ID NO: 146989 - DNA, 710 bp, Homo sapiens
taaatgtttaaggagatggatgtccctattaccctgatatgataattgcacattgtatacaggcatcaaaacatcaagtatacccccaaaatatgtgcaactattatatgtcaataaatatttaaaaacagttagattaggcagttagttcagaggagcaatgtgggcctggagatgcacactggggagtcacaacatgtaaagccatggcaaagattagacccctgaggaggagagctagagaggttgatcctctgtgcactggagaaccaaacaggggaggacaagtggaagactgagcctgcggagaagtcagaaatagacaatgaagaattaatgggaagtgtgatatcgaggaaacccagaaggacgatgtttcgagaagcgactgagtttttatatttaccagtggtgctgaggggatgagtaggacaaggaaaaaaggtgatctttggagatggaagtgtggaggtggttggtgatggtgactacagaagttttggtataggggcgggaatggaagccagatgtgattgatttaaagagttaacaggaggtaagagagtggaaaaggttgttgtgcaacttctaaaagctgactgtctttgaagcagagcagaaccatggaaatgggtagaagggaatgtgggatcaaaataaagcattctgaagacccgggaaaacaagggcaagtgtgtgtactttgaaaa

SEQ ID NO: 146990 - DNA, 435 bp, Homo sapiens
actggtgtgctcaagaaggaagaccttgggtgtggggaggtaaggagccacaggtctacttccttggatatgcattctcatgactccatccacaccagttgctgtttttgttttgcaaacagattgaaaaatgagtggaagacattggatctgctatcttactggacttccaggctaatgaggcacacagtaaggcctcagtgcaggactgtgaaagacagacaaattagtacatagctttattcagaagatttcaaatgaacaatactcccaggatttctgaaagtgctatgggttaggggttaaagcagggagtctgtaagagcagatgaaattcggataccagctctccacttcatagtatgtgaccttcctctgcttcctctctcccaagaacctgttctccagatctttggaaggctgactctctccttt

SEQ ID NO: 146991 - DNA, 435 bp, Homo sapiens
tttaaaaaaatgtaacaagtaggcaaatgcctaaatatagacatccactgcatcaccatagggctgtgcacacagcagctccctcaactgctgcatgggggtggtcccattttaccccaccccactttcccctgcctgactcacttattctcaatgactatggaggggggctttcccactcctctgaggaggagacaatacagctttctttgccccttaaatggagatgtaaccacagggaaccagataggcccagagtatgaatgaaatggattcgcctgcttctgctgctgttttgcttccaaatgttggctaaaacaatctctctcctaaagcctatactctatcagtggatattcttttttaacctatctccatccttttttagagggaagaggtacttcaaaacttttagcctcctagagtgctatattt

SEQ ID NO: 146992 - DNA, 700 bp, Homo sapiens
ataaatgagaaaaataaatggaatgaatgagtgcatagtgtgacccatatttgtattagatcctcaatggaaaaataatttattgcttttgtaaagtgcctgagaattggcaaagagcttattgactgccttccctatcagactgtaagcccaacaaggtgaggtttttgtctatcttgtttatctctgtgtctcagtatccagaacaatgtctgacacatagtagaagctcaataaacacttgttcaataaacattcacacagcatctccacaaggccaggcacaatcaatttccactgtactggtagagaatgtggggctcaaaaaggtagaatgaaagcttgcatactataatggaaaaaaccataatatttggaaccagaatacctggcttcaagtcccatttataccacctactagctatagatttgggaagatcattgaagccctcttgttcctacttttggtgtggtcctttgaggctgtggcttcactaagcattggacaaatggaagttgctgtggttgatagtgttgtcaatgctgcctaaacactcagagataagactattacaattcttagaatgggttctgaaatgaaagaccttcaagaagcatgcgaaggcatctaatatgaattataaaaaggaagttgcagatctagaaaacaatgattgcctgaacatgcagagctccctga

SEQ ID NO: 146993 - DNA, 190 bp, Homo sapiens
aggatttaatgtcctgagggtgtgggatgctaaatacctttcagtagttgggagtgggagggtcccacttaatgaaggattgtcctgtccagaatgctgaaggcacccctgataagctatctcttttttttttttttttttttgagatggagtctcactcagtagcccaggctgtagtacagtggcatga

SEQ ID NO: 146994 - DNA, 461 bp, Homo sapiens
aaaaacctttctctccaggttaacaggggctggggctggggagttagtgtttcaagggtgtagagtttctgtttgggaagatgagaaagcgtcccagagatggatagtggtgatgcctgcacaacaatgtgagtgttcttaatgccactgaatcgcacacttagaagtggttcaagtggtaaatcgtatgttatacatatttagcaccattttttaaaagcatgtctttccagctgatgacaactgaaaagtctagacaaaatacaaaaaggaagcatctgaggtcactgaaagacaaacaaaagcagggaggttgcggagtggagtcaaaacttagagaatggccaggcacaatggctcacgcctataatcccagcactttgggaggccgaggcaggtggatcatctgagctcagcagttcgagaccacccagggcaacatgatgaaaccccgtctcgct

SEQ ID NO: 146995 - DNA, 390 bp, Homo sapiens
ctccctattgctctacagtccaccctctctctgtcccccaatgcctctctgaccttctctgtctctggccactcctggctcactccaccccagatgtgtggggtttgcctgctcctggaagccacctgtttagcacagtcccacctcagggcctttgcacctgccattgtgtccacctggctcccacctcctgagaccctgtctctacaaaaaataagatgtcaaaaaatcaaaaaattagccatgtggaggggcaggcgcctgcagccctagctactcgggaggctgaggcaagagattggcttgaacctgggaggcggaggttgcagtaggcccagattgtgccattacactccagtctaggtgacagaccaaggccccatctcaaaa

SEQ ID NO: 146996 - DNA, 459 bp, Homo sapiens
tcgagaatcaatcccagttggtcatggtgtattattatttttttagatattgttggatttgatttgcaacaattttatttagaattttttcatctgtgttcattaaagatactggtttgtagttttcttatgtctttgtctgctttcattgtcagtataatgctacattatcaaaggagtttgaaaatgtctcctcttagtaccttttctaaaaatgtctgtgtaggattgttattttttccttaaatatttgatagaattgtccagtgaagctgtctgggcctggagttttcttcataggaaaattgattatgaattcaattgttttaatagatacaaagttcttcagattttctcttctccctccctccctccttctctctctctcttcttttctttctctctttttattcttcttcctcctcttcctccctctcctcccccctcctgttgttgttc

SEQ ID NO: 146997 - DNA, 371 bp, Homo sapiens
cagtgccagtcacacaaaggtcatctgcaggctccctcattaacatccctctcggtctttgtctcttttcccttagttttgggttagtgcctatgacatttgccactcttggctgggttttacaaacaaggctttaccttgcctgcctacatatccagtggtgctaccaggttaccacaagacactgggatcagaaaagctggaattaataaacaaagaagcaacattaggtggattaagacccagcctcaagggctaggaatgcttttcttttttttttttgtgacagagtctggctctgtcacctgggctggagtgcagtggcacgatctcggctcactgcaacttccgcctcccgggttctaagcgat

SEQ ID NO: 146998 - DNA, 331 bp, Homo sapiens
caccaaaaaagggcacaaacgcgtcaacaccagctcaagcagagctatgaagctgctttaatggatgagtcctgaatcagacgagatactagactcagtaatctctaagttcccatcccaatttgaaattccatgactctaaggtatccttaagaataaagattcatcattagagtgcaatataaaattaaccttatgaggtatgcaggtcttatctgtgttctgccattttttaaattcagtattagacaaagttagttgacctagtctgagccccagtttttttagaggggaataatggaaacctacctttcacagctgttgtaactgg

SEQ ID NO: 146999 - DNA, 119 bp, Homo sapiens
tgaactaagattgaattcactttttaattttaaagcttctgtagctttgattctctttggacatcaaactgatttatacgagatatgaatacaattgcatattctgctaaattacctat

SEQ ID NO: 147000 - DNA, 317 bp, Homo sapiens
tcagtcggtactgatgactgcacacgagtatgggaactaaggcagtgcctgttcccatgtaagtgggggtagagagcacaagtatcacctggaagatggcaatcacccacaaaaacagacctaatctcccattcttaaatccagtgacttccatttccttggtcttcaacaactaataccaagttgttacggggaaatattatgtctgaaatccatcaggctgttttcccaagacccacaaaataccacttttctagtcttattttcaagggtggagggctgtttggatgttctgtctctccactaacctatgctac

SEQ ID NO: 147001 - DNA, 139 bp, Homo sapiens
gaattgtggtccagaaatgtgaggtccctgccctggaagagccatctgctaattagtggcagatacagtgacatgaattttcatagaaatagtcacaggacccaattagaagggatgtaaaaatgaagcattgggattt

SEQ ID NO: 147002 - DNA, 364 bp, Homo sapiens
cccacatgcccagctcgatgggcagctgtgggcacacggctgtgtcctgggcctttctgaccgtatatcccacaggtgacaggagtggcctggcctggcccccagcaagctcgacacctgcaggctgttagtttctgactgtgggcacagatggggcttaattgctcccagttcctcgacttggcctttgttctgcatgctgctgagctgacaaacagggccatatgctggagcacatgctgccggtgcctgcgtgtgcatgtacacgcgtgtgcatgttctcggagctctgatgccagcctgacattttcccttggcatactctaaggaaaacgtgttccagcccaggcttcttggagcggag

SEQ ID NO: 147003 - DNA, 139 bp, Homo sapiens
gcggccgcctactactactactgctcgaattcaagcttctaacgatgtacggggacatgaggaaagctgctgcctagaaagactgagccccctcccctgccctctccctgaaataaagaacagcttgacaggaagaaaa

SEQ ID NO: 147004 - DNA, 566 bp, Homo sapiens
aggacagaggaagaagaaacaggaggagaaaacagaggtcggcacaattagatgttcccaagtgcttgaaagtcatggctgtgcttgtggttgattgcgggtggctgtgaaagcttaaagacttaaggagtgaatgagtggaagtagaggcaattcctcttttttggaaggtaagtagaaggaaggtgaaagatgccattttgttaggaatccctggggagtttccttgaatccgtctcttcgtttccattctcacttctgtcactcctaaccagatttgtttccctctttcctagactgatattaaacccccctagcttatttccctgtgtctgcctttatcctcatttcttttcttttttgtactaggaactcctatggcagtccagtgaaggccatagactcctcagaatgaggcttttaaaggaataaatgaaaatacagaggatatgtcctagcaagttcaaggatccttttaattctatccatggaccacttgggagttcatggaaccccatcaagaacccttgcaagaataagatggggatagtgtggggtgagaaagt

SEQ ID NO: 147005 - DNA, 420 bp, Homo sapiens
gatgctggttgctttcttgggacatgagtttagccatggtggcaggccaggtgccaagttccccttgagctactgtgagaactggagagtcagggcctagtgattcggggcagtggccatcacccccagctgttgagagcggttacttcctgcagggctctgccttccctgaattgggagtgcacagcctgtgctttacccgactgcaggcaagagcagaagctcactgagcaccagggcaggtgacggggcatcgctgaggtccaggggcaggagggaggagcaagagcaggtggccttgggcctgggccttggcgctgcctggagtttgaatgtggtgggcagggtgtgaaggagatactggagttccataagggagcgatgggagcaggaggaaacggagttagaatcatccatggg

SEQ ID NO: 147006 - DNA, 405 bp, Homo sapiens
gaataatttatgaaaagcactgacaacagtgcctgacacataaaagattagaagttattttttttctggattggtatccaaaaacccctttaattcataaaatgtcttaatttcaggccgggcacggtggcagacacctataatcccagcacattgggaggctaaggcaggcggatcacctgaggtcaggagttcaagaccagcctggccaacatggtgaaaccccatctctactaaaaatacaaaaattagctgggcgtggtggcgggcgcctgtaatcccagctactccagaggctgaagcaagggaatcacttgaacctgagaggtggaggttgcagtgagtcagtcacgccactgtactccagcctgggcaacaagagcaaaactctgtctcaaaaaaaaa

SEQ ID NO: 147007 - DNA, 428 bp, Homo sapiens
gtgactttaacttctctacgcctcagatccctcatctatggaataaaggtaaagtacctagctcttaaagctattatgaagattaaacaaaagaatccacatcaaagcacattgctcagtgcttcctataacacattattgcactttattgtttacttgtttaactccctctactgaagtgtcctgaaggcaggactctgtcttatttgaatccccagcgcctagcacagtaccaggggcaaatgacttgagaaatgaatgaatgagctcaaaatacaacatgaggtttccactgctaggtgccaattgaatgtgtgatacacatcaggcatcttagtggatcttcttagacatccagacaaccagggtccacccaagacctactgaataagaatggccaagagtggggcctagggatctgtattctt

SEQ ID NO: 147008 - DNA, 260 bp, Homo sapiens
gatgtaaaaaaaaattaatccaagctcatccattcttcaagttaaaaaaaggcagggtaagaaattatcattttcagtctgctaaaaactaactagacagatatatttagcctaatacatacatccctttctcacctgagattaaaattttattccttgcctcactaagcagctgtttctaactttcaggtattgtaatttgaagcctcaatgctcattagaaattctaagagagtattcctaaatccccattaaactat

SEQ ID NO: 147009 - DNA, 686 bp, Homo sapiens
gcttctgctaccatttacatatgcatattttagcattatatgataagttgcattgaggacatttttcttgcctttgattagattaaatcttctttaagtaaggggtagtatcttcaattttgtatttttagtgtggagcacagcacagggttggtaaattggcaacatgagggcaggaatttcttatttcttttgttcactaatatatgttaagcactagaacagtgcttggcccatagtagttactcagtatgtatttgttggatgaatgaatcctgtatgccaaagataaaagtcttaatatttaagaatgttcttttggcactatattggttcagatttgacaaaatggtgtagaactgattaataggtaaattccaccagaacttgcagtcaaccaacacctttgctttagactgcctcctgtttgggagggcaagaatttagctaatttggatcttgagcttaataaacactaacatggtcaaaagtcaattagcaggagagaaaaatggaaataaaagagctaaatattttgcagattcattaaccaatctatcattaattaatccttaaacattgtatgttagtagccactagaaagggaaatcttcttgtggggaagatatagtgctgggaaatttgtaaattataaactacaaagttaaagtagtaaataaaggaaa

SEQ ID NO: 147010 - DNA, 232 bp, Homo sapiens
ggccacgtggcaggacaggaaggagggtttgagagaaagttcccagaatcctctgaagtcagagatggctcccactgcacgttgcagaatattgacagagctcaggaagctgaaatgaatgggtgggcttgtggaaaggtcaagggaccagaggggcacagagcagtggatgccagcaatggctttggagacagtcggagctggctcggaacccgccttgcacagccttctt

SEQ ID NO: 147011 - DNA, 1016 bp, Homo sapiens
gcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcacccc

SEQ ID NO: 147012 - DNA, 342 bp, Homo sapiens
ctccgagcagtggtgtggaataggaagagttcgtcatttatcttttccatatttgccaaaaacgtcctttcgttcttatcctatgttcacagcaatgttttgacctggttttccaattagttgataccaagaaggagaagaatggattgctgagattaatattttattcactgtaaacataaaatcagaggtcctgcctgtctccttaagagatggcatgttagtccccaagactccactcaacattaagcaaactgagtaaaataaagtttatgaccttgcaaagctgaaatttctctagaactaggtgatttcttggtagacatctatactcaagcattg

SEQ ID NO: 147013 - DNA, 470 bp, Homo sapiens
caaatgatataggcagaggataaacgggaatgtttggatgaaggcagcaaaagtaggaagtcttttcttggggctgtggtttgtggatagaaagcccggtgcttcccacagaggaggctctgtcggtctgtggattgagtgtggcttcgcatggcagcagggatacgtgacagtcattgcatgggccggtgggtcctcagatcaagtactattgggccccatagcacttaagtcattgtctaggaaaaggtcatgacataggtccagcttcctccccaagaactgctggaggttcttctggggcaggaggggtcgctaagctgtaacaccgtaaatgcctgtggcatggccgtctccgcgtaccagcccaccgccttcaccactctggccactgcagatgaacgctgctgctgctttttcagaaaggtttagtgctcttgacctccatgcctctctgccccgccatataa

SEQ ID NO: 147014 - DNA, 555 bp, Homo sapiens
  misc_feature (555)..(555): n is a, c, g, or t
ggtggcatattgcctgcggagtcctcctgggcccttgcaggatgtggccaagatgcttggtgctgcagatagtctcccggaagagaggggcttacacattcttggtaagctgtggctgggtttagaatgattccttgggaaaaggggtagcaaagtaactttgtcctgaagaagccccaagtatcctgagcccagcagccttacataaagtagtattgcatagtgactaccatttcagggtctggatttagacttggctttgagtcctatctctgcagcttttagtaactgtgtgacattgtcattgacctctctaagcttcagtttcctcatctataaagtgaagataatattccttaatggtcagggttatagtgaggactaagtgagggagggctcagctgccagcttggcatcctcagcccatggcagccgtgtcatggctttgtgctccagtttgttgccagggcctggtgtttcatggttcactctcttgtctgactgtttcccagatcaggcaagagagtctccgtcgaactggaccgagctgattan

SEQ ID NO: 147015 - DNA, 208 bp, Homo sapiens
tgcctggacagagtcctgagcactaaaatgtcaagatcagatgaaaaaagattagctagcaaaaatcactgagaaggaactctcattgaagttgctgaaagagaagtgggcatctggtgttgcaaaaccacagggctggacacactgtagacattcaaagagagttagtttcttctttaatggaaaagtatcattcatccattttagg

SEQ ID NO: 147016 - DNA, 167 bp, Homo sapiens
aaaggtgttagtcaaacaaaacaaaacagccactccaagacatgaaggagtacacattgtatgatttcaattatacgaagtataaaaacaggagcacttaatctgtgatgttggagtcagttgggtcacccctggggaaggctgtgtgtgcagaggaaacaggcttc

SEQ ID NO: 147017 - DNA, 156 bp, Homo sapiens
taggaacagtcttgtcccagcgcaggcacgaggagggctcaggaatctggctgggagcattcctgccgtccctactgaggagctgccactgtggaccaggacacccccctgataggagcagactcccggggtgtagacactgcttcccttttcaca

SEQ ID NO: 147018 - DNA, 752 bp, Homo sapiens
cccccgtcgtccaaaaaaaatgtttttaagttctgtgataatatgatgcaggtatttaccacatttttgtggcatataggctgtaaaacatgaattcaagggttttagtgtttcattttaataaaaccaggaaaacttttacgcagagaaaattgagcagaaacttattttttagtgtgttaagtataatcacaaagcaattacttcctttaaaaaagcaattatattggaactttatatctaagagcctctatccaaggcataaatttggagtgaagcctgttcatttcagggattttattactctgaatatgttaggttgtgccccagtataatcatgtgcaaaacagaagtttgtgggttcctaatatagtgaatctccattgaatctgacttaatttgacgttacttagtgcagagcatcacagtgatggatgttagacacatccagagacatgcactttcatttaccacctcagaaggaagcaagaactttagacctggaatcttgacatagaacttgggggctctgtaactttcttttgttttctttactgttccctacttcccatgggcaatatccatagaataagcacccgctcctccccacacctgccctcttccattctctcatccctgtgttttgtacttcttttctgctgactttacctttcattctttccctccctcccatgtgccttaggaattattattctcctaatagtcttcctcattgccttagctaaaacctg

SEQ ID NO: 147019 - DNA, 368 bp, Homo sapiens
tggcctctgctctgctctgtgtctgcctctggcactgcttctcaatccctctgtccctctgcccctatgactgcttgctctcttggttttggtttttgaatcctatctctctatctcagattttacatttctccatctctattggtttctgttcactttcagctttcaacccgtccaatacctaccctttccctgatatttgaataccttcctcagctttctcactaggcaagaaggcccaaagtgaaggattatggtagaggtcacaagagctgggggtattttccaagaagaccaggtatactgaggcggggaggagtggcccaggaggtataggggatggaagcagcagagaggacaggtccgag

SEQ ID NO: 147020 - DNA, 463 bp, Homo sapiens
tcagtcaatatcccctcctgttacaatggatgatgaaacgtccatgtttctagttaaagccagccttccacttgtgcagtaaagcacaccccgtcttgcctgcccagtaattttcatccctcttctgttaacaccaattttcccattttactggatcacacccatcaacatataaatatgctttgtttttccagctaaaaacaaaactctttactccttttctcccatcatcaactaccccatttcttttgcagcaaaactcttcaaaagactcctctaggtttaccgtctcctattcttccctgcccattctttcctgaaaccattatgttcaggcttgtagtagctcttcacacaggtggtcagtctgccttcgtggaaatgctttttttcatttggtttctagcacgctataatcccatggttttcccttgtttcactagctgctactcttttggagcca

SEQ ID NO: 147021 - DNA, 283 bp, Homo sapiens
aacaactatggatattaatggttagtacttatatggcccttactaaatgccagaatctgttttaagagctttatatgtattttctcatttaattgttacagctaccctataacatatcatcctccaaagtgcagagaagttaagaaactttctcatggtcacataacaagtaagttgtagagatgatgtggctaaagtgaggacctttaatcactgaggtaatcagacaggaggccagaggctgaagcccagtgagtgagagtgatgggagatgatgaggcag

SEQ ID NO: 147022 - DNA, 388 bp, Homo sapiens
catgtgaattaaacaactgtgaaataataattaaaccataagtgcaaagttataatgaataaccttctaatgctctcaacttgatcatagtcataggcaatacattggacaccgaagcaattatattgaactgaagaggacaaaaatcttaacaaattacttaatcacatacagaaaaccaacaaaactaccctcccttttcatactgcatataggtaccttttaaaattgttgaatctcaataaagaaaatatgttaaatatcatcaaccctaaaagctggcccagcaagctgggattacacctgtaatcccagcactttgggaggacagggcaggaggacagcatgagcccaggggttcaagatcagcctggacaacatggcaaaa

SEQ ID NO: 147023 - DNA, 200 bp, Homo sapiens
gtttggtttgaatacttcattcgaagtaccttagcaacactagaaaagcaaatgaaaaaatgggctatgtagtaattacataaacttgtgcagtgctccaacttcaggttgaggagtgtgttatatggattttattaactacataaggacatgtgttatattttatttaggatgtcggaaccatttaaagtatctgatac

SEQ ID NO: 147024 - DNA, 299 bp, Homo sapiens
tcgtgaaatctgcttatggataattcaaatctgcagcaaaatcattcgcctctgacaatcgtcctgtttctaattcatgcctttgtagtttattcgatgtgtaatacatcaatgagtctatagattctaatatcaatgtttttttcttttctgcaagataaagttgaatttcataatatgatacactagcagctaatgttatctgaataaaaatttgacaagcatgaaatgtaacatattctgtattattaaggaaagaccatagtatatagtaaccacacaaaatgcacacatatata

SEQ ID NO: 147025 - DNA, 332 bp, Homo sapiens
tccaggctgccgtggagctccgcaattgtgagctacacccaggtgagccaccacctctcagaccagagacaactgcagtctcttcctcccaggggagctcccaggagcccagtgagtacgctgccccggccatccactagcccagaccccacgctccaaggaaggagaccacagtgagcccagatggtgcagcagctggccccatggacacaagaccaccgtcatttcccaagtagcaacgctgagggaaggaagggccaaccacctagcttgagtaagccgcaatggacttctccacgtggtttacagtaacttagctgtgttccagaact

SEQ ID NO: 147026 - DNA, 175 bp, Homo sapiens
aatgagagtgcaaaaagtaattgttaaacgctaatctcaaaatattgcatactttgtaaatccatttatatagtattctcaagtgacagggttatacagatagagagcagattagtggtagccaggtttagggatagtaaaccatggggaaaactaggtgacgggcacacaggaa

SEQ ID NO: 147027 - DNA, 300 bp, Homo sapiens
cttggcaatgagagagagtgtgggcagtgaaatgcgtggggtccctagaggagggggggagatgggagcccaggaggggctgcttagagatcaagaaatctcaccccaaaggctctgggcccccagatggtccacactcaggatgcagtggagtgactagaatagatctcagagtgggagtgggttccccagggagaccctagttcctggaggggcacagggtgcttcacctgctcatttttggacagttcagagtgactaagaccctgaggcattcaatgcagggagcgttagcgactt

SEQ ID NO: 147028 - DNA, 465 bp, Homo sapiens
ttgagacggagtctcactctgtcacccaggctggagtgcagcggtgtgatcttggctcactgcaagctccacctcccaggttcaagccattctcctgcctcagcctcccaagtagctgggactataggcgcctgccaccacgcacagctaatttttttgtatttttagtagagacaggttttcaccacgttggccaggctggtctcaaaacttctaacctcaggtgatccaaccgcctcaaagtgctgggattacaggcgtgagccaccgcacccggcccagactccttaaaatgtgagaagtagcactgaggaatgtgatcagatcatggccttgattgacacatggggtcgctttccacggttggccttcttgttctccacggcatcttgtgcatagccatttgccatttcaggagctcagcatgcacatccggtatttctgtgcttggttgtctttctggaa

SEQ ID NO: 147029 - DNA, 414 bp, Homo sapiens
taaagataaaatcaaattttttttgcaaaggaattacaatatgtaaaaatagtctgttcaaatgaatctggaaatattttctatccccaattgacatactgttctctgataaatttgtgaggcccagtaggtaatcctgtataatattcattttaattcatatgaaagccatacacctctaaccttaaaaattagtaaacttaaggtagtcacatttcttaggaattattcatatctgaattttgtacattaaggaagtttattcatatagacacttaaaaatattaagcaattctgatttaatggtttccagagtatgatcttccctacctttatgaaaccacacattatttaataatttttctcttgatgaatgaagtctctgtaattaatatcaaatactattacatgttt

SEQ ID NO: 147030 - DNA, 457 bp, Homo sapiens
tctattctctattttctatgattgtctctagaaactttgatgatggtttctagaattttccttaataaaacaggaaaaaacatatcactcattatggccagccccatgaaataggatattttagtctttaaaattatctcagttagtgataggatgttactgaaatgcccatcagtagaaacaagcacttttaaacacaatgataatgaaaataaagtaccatttgagtatctactatataagccactttacaaatacctcactaactcataactctacaagactgatactattgtcctcattttatagctcagcacactgagactcagagaagttgattttagcttgtccaagatcccacaattggtaagtggtacagaaaaatttaaatgcaagtttggctccaaatcctgtacttttctgtatagatttgtgttatatctcccaaagttcctca

SEQ ID NO: 147031 - DNA, 484 bp, Homo sapiens
cctggagctctaatcaagatgactcttcttccccatggggaccatgggcccctatgcaccctccatttccctgtatttcccacagagcccatcatggtcctgagcacttctcagtaatacctgtatgttttaaagggtttatgttgcataaagccctttcatcacacattgcatttcaaccttatagtatttctgtaagggacacatcagcatgtcattattccaacttcaaagatgagagaccgaggtgctcaaggtgatactgctgggtcgatgtgaagagggaactagaatcaaatctgttgcccccatccaagagtttccctgccagcacaccagcttatggaacttaggcaaggatggagtgaatcctcccacttgctccctccaacacaaccaaggcagcctctgttcaggaagcgcttcccagggtggggagcggctgatcctcatgacctctgagctgaggagggaatagcaggaa

SEQ ID NO: 147032 - DNA, 368 bp, Homo sapiens
gcgataaacacacacttattgaaattcttttcgccaggcgcgtggctcacacctgtaatcccagccattgggcccagccagtttatcttcctaaatgtgtgcttctatctctgctacttagtttatcagccttaaatgaagtcttttgaccctgtgtataaaagctgaggcactccctctccatttcctgtttcctgtcccgaattttgattatgtgtatgttgtcgtggtttgtaaacacttacattttattatgtagccacggttcacaggtgttttcatcttagctctctggttaaaatggcttaactgctcagtgccagttgttttgctatacagtaagtcctcagttagtgttgccagtagat

SEQ ID NO: 147033 - DNA, 286 bp, Homo sapiens
cacagcactgagcgccaagggaaggtggcccaagggcagtcttaagacacaatgtcaaacgttatgaatgggtaatttctaacaagctgaagaactgcaacctgctacattgtaaacgaagttctggagagaactgaattttctagaaaaattcttattgggaggaaaataacctaaaacaactttttataacatggatttgtttgattttaccttaaaagaattttactgatgccttgtgtttcaaaaccactcaacatttggatattgttagcaaccctcctga

SEQ ID NO: 147034 - DNA, 240 bp, Homo sapiens
aacacctcaccatgcctctgggaacctcatcgtatcagggctgcccgacagcagcagagcaagcaggggcagagggcggcatgagtttcagctgctctgcaccttggccagcacttgatgctatcagtttcattactttagcctttcgagcaggggtggtaccccacgtggatttagtttgtttccctaatggccaatactgagcatcgtttcagctgcctgactgtcatcctatatctt

SEQ ID NO: 147035 - DNA, 150 bp, Homo sapiens
tttgtggacataccattttggcagactacaaagtatgaggcaggcaagctgagcatcgatagtggagaaaatacccaacctggtgcccctagactagacacggtctgagagtgagtctctagtcaaactttagtatttgtaatagcctaa

SEQ ID NO: 147036 - DNA, 347 bp, Homo sapiens
tagagaatacttatttgtcatgtgtgaacaaaagaaaacacaaaatcaagggaaaaaatggggaaaaaactagagaaatagccaagttaaagttctactgacactagggattattctgggatctaagaaacaatatgcctaggtttaagtaacccacaaaatccacttttccagcaaggcagtttacctggctttgtcatcaggcatctcagtggatgaccacctaaaactattagggataatttttataggtaaaattatggctatcatacaaatataaaattaacatatgccaactttgtaactcattgattaatgagggaaccaataagatgttacatagacca

SEQ ID NO: 147037 - DNA, 733 bp, Homo sapiens
  misc_feature (21)..(21): n is a, c, g, or t
cagcggtcctctgggatgctngtgtctatggagtagccattcttattcctttactttcttaataaacttgcttttgccttgatctgagaacctctccctgaattctttcttgtgtaagatccaagaaccctcttttggggtctggatcgggaacctttcctgtaactctttgacataattttgctgagttcataaacacagattctgctacattcttacagtatcatgccccaggaggccaaaatcctagattactgttttcagaagtgtttacttcaaactcgttatcttgagtggagttgagccctgtctgtgattggccatgtttcataacatgcatgggaaaactgcaactgatagtcacagctctgttttcttgaggccttcttactggtttcttacttctattgttttcacagttcattagtgatgacaaagagctgcaacgtaactgtatttaccattagctcatttgttgcctgctgacagtatgtggcatatctttattcctcatcataggtagcatcatcattacaaagctgggcttcatcagggacttacagagagatttgtacacccacattcgtggcagcggcattcacaatggccaaaaggtgggaacaacccaagtgttcatcgacagatgaatcagtacacaaaatgtggcatacatgaaatgaaattttattcagccttcaaaaggaatgacattctgacacttgcatcacatgaa

SEQ ID NO: 147038 - DNA, 475 bp, Homo sapiens
aagaatgcttgcaaacttgcttcctcatatacccatacacatatgcagaaacagatgtgcacgtgtgtgtacatatatgcattcatattgtgtatgaattctatgcatcacacagctgaaagcacaagatggtagatacccttctgcttttgtctcttaacagtgtaatttggaggtcattcctaccatatttatggggtcacctcattctttttttgctgactgcataggctatcattgtaatcgtgtttaactggctgttcccagtaggcatttgggttgtttctagtcgttctgataaatagggctgcattgaaaatccctgcagtaggtacatgggggatatttcctagaagtgtgattatttggtcagtgcatgtgtgtgttaaattttgagatctggccaaattactctccataaaggctacctcagagtgtctgtttctctgctctcttttgaacctagaatgtcatc

SEQ ID NO: 147039 - DNA, 635 bp, Homo sapiens
ccaggtttccccacctggctcatgttctgcaggagctactgtgtccttggagctgaggtgctgacatcgggccttggttaaatgtgtttctctgaggggtccctttaaaggaatgcccttaatccccctcaggaagtacagaggaggttgggatcacattaagttgcctcttagtttctgttttacaacttggacaaacgtctccctttgatcttggcattaaagaagcacgtcagagaatgttggagaaggctgagttttgatctctgggcactggcaaaaaggtgggaaggacccaggatgagaagagccatctggccacggatgaataataggagccactaccaccttcaagcctgctttgatccctgaaccatttgctgacactagagtttcccaaatggggcatggatggggacacccaggacttctcagttccatctcattccttttcattgcttccttctctcccttcctaacatggtttctcacctatgcctgatgctttaaaccaacagacctcccagggtttgaaatcctcttatgcttggtctgagaatctgggctagactcccagctctgacactgtgattacttttgtgactttggactgattggttatgtgattttgggaa

SEQ ID NO: 147040 - DNA, 854 bp, Homo sapiens
  misc_feature (29)..(29): n is a, c, g, or t
  misc_feature (37)..(37): n is a, c, g, or t
tgtaatcatagccctttggaaggccaagncaaatagnttgcttgagcccaggagtttgagaccagcctggcaaatatgccaaaaccccacctctacccaaaaaaatatttaaaaattagccgggtgtggtggtgcacgcctgtagtcccagctactcaggaggctgaggtgggatgatcacctgaggctggggaggtcgaggctgcagtgagccatgactgtaccacttcaagactccagcctgagtaaagacccatcccaaaaaagaaaaagaaaaaattttaacatagaatgaccatatgagccagcaattccactctcagttatatacttaaatgaaaacaggaacccaaacagctagttgtacatcaacataaacattattaacaataggcacaaggtggaaacaacctaaatatccatcaacagatgactggataaacaaaatgtatatacatacataaaaagcaatgatattcaatggtacgctgtcatgaaaaaaaggaatgacatttttgatacgtgaatgaaccttgaaaatatactacgtgcaataaatcagacacaaacggacaaatattgtatgattctgctttatgaaatatgtagaataggtagattcatagggacagaaagtagattagaggttaccagcaatttggagggagaggaaagaatgggagttattggttagtgggtacagagtttctgtttggggtgatgaaagggttttagaaatagacagtgatgatggttacataacattgtaaaagtaactagtgccacttgaaaatggttaaaatgacaaattatatatatatatttttttaccacaagaaaaagtctctgaattt

SEQ ID NO: 147041 - DNA, 490 bp, Homo sapiens
ggagtgtcaccagtgacatctcactctcctcgacttccacagcaggatcatccaggtctcctgaatctgaaaagccaggcctgagctgcagcagcttcccggtggcatgccgcctcctgccctctcaccatcccccctattccccaccccccgcacggtggtagaggcgctgcaggctggggagtagcgctagggcacgttggcggtggccgtcaagctctacatcctgcacaagtacccaacggtggacgtcctccgcttcaggtatctgctgaagcaggcgctggccactggcatgtgccgcagcctcctcgccaggcccctcaactccgaagcaaggggggccactggcagcttcaaattagatcccaagcacaagaggaaaatccagcccagggagatggccccctgatggtccccaggagagcggaaaaggccaaggggaaggacgccaagaaaccaagtgaggccaaggaggatcctcctaacg

SEQ ID NO: 147042 - DNA, 419 bp, Homo sapiens
acgaagccccgaagatttgaatgaaatggcttcaaatattactagtcatgaacatgccaagaaaaatcaactgccataatcagaagtataattcatgaccactcatgtgattcatgttgggaaaatataaaatatccatttaatggctcatgaccacctcacaaaatgactcagagaagaagttaagaacagagggtgaccttacaagaagcagaggccaaacatttgaggagaggtagaatgtgtgtcagaattgtgagaagtagaaacctgaactctgcagagaagtagcagtgatcaaaggcagtgctgagtccacttgagtttagtggtgaatacagaaaaggtagatttctctgccctcattgtttttgttctcaagactctcttggaagctcagttgtgaacattggaaatct

SEQ ID NO: 147043 - DNA, 336 bp, Homo sapiens
gattgcagtgagctgagatcgtgccactgcactccagcctgggcaacagagcaagactccatctcaaaaaagaaaaagaaaatgggcaagtgactcagcctctgagcctccgccttcttgtctgttaatagtaacttccacactggacttttatgaaggttcaacgagataaagtttgaacatggattataaactgacttactccacaaacaagtaaacagttcttggcattaacaatattcatttgtccaatttatattaatcccccaagcctctgggccactcacctcttttcaggaagtgctccctggcatcagctcactgttctctgtgcaa

SEQ ID NO: 147044 - DNA, 203 bp, Homo sapiens
cattaaacaggatctatttagagaagggttgtttatatccattatttttccatcaacaacctaatttggcctatttttaaacttgggaaaaatgaatggtgcctcacagtggattaccacaaccataatgtcatggtcatgcctactaaggctccatacccaatattactgaaattattgacttatccaattggcagctggta

SEQ ID NO: 147045 - DNA, 364 bp, Homo sapiens
ggtagcccaggctggagtgctgtggcgcgacacagtttaccgtagcctcaacctcctgggcaagtgatcttcctgtctcagcctctcgagtagctgggaccacaggcgtgtgctaccatgcttggctgatttttaaaatttttgtagagaatggggtcttgccatgttacccaggctggtctcgaactcctgggctcaggtgatcctcctgccttggtctctcaaaatgttgtgattataggcatgagccccagcattttttcttaaaaacttctaggtttttctttaaactaaagctttatatgtccatattttggagtcaactattctagattgggtaagacaaacaggagtccttaagtat

SEQ ID NO: 147046 - DNA, 296 bp, Homo sapiens
agtggggacccatgatggagcagatggttgggggagagcatatgatgctcctgggaacagcatgcagtttccaagtactagggtgataactctgaagggacataaaccaataaccctccacctctccacctacactagagtaaggagagaggctaattctagcagtagtcatgctaagtggtattcttttttttttttttgagacaaagtctcactctctcgaccaggctggagtgcagtggcacgatctcagctcactgcaacctccacctcccaggttcaagtgattctcctgc

SEQ ID NO: 147047 - DNA, 486 bp, Homo sapiens
gagaagaaggaagggtaaaaataatttagtaaaatcaacacttatttgcaggcacttaacaatgctagacgctgttataatcactataaatattaaatctttatttagtcctatttgtacccctagaggcacttactgttattatccccattttatagataagaaaattatggcactgagaggttaagaaacttgtccaagcttgtaagtggtggaagcagaatttgaaccaagcagtcttactctagaaagagccttagccactgtgccatctttcttgttatgtgcatgtgtgtgcatatacatatacatctatgtgaacatattcaccaatgcattagctgagctagaccataaatatatgtatcagcggatacatgaatatgcacaatattttaaaccctcagaaaaaggacaatgtaattaatgaagaaaaacatgaaggatatgagaatggggaacatagataaaaataacaaccttatt

SEQ ID NO: 147048 - DNA, 351 bp, Homo sapiens
atggaatacattaggaatgctgagggcacatggaaaacagtgacccattctacctagtggggttttaaaataattatttttaatgtttaatgctttagggaagaaagcagggagatgaaacatgaaagatgaacaggaaatggtaggagatttttatgaaggtagaagagacagggctttgggaatggaaaagcccaggttaactcccagatttctggcttaggcaactgagtggcaccactgtcagagcctagaaatacaggcttgaaaggagagatgctaagtgtagctttgttggctctttgataaatatgcgacctgcacgtggagctatccaggaataacaagtca

SEQ ID NO: 147049 - DNA, 399 bp, Homo sapiens
tactcttctgacttaccaacagcctcgtgtgttgttatttcaaaatcataaatatggctgtaatcagtatgtttaaggtgctcctttacacaggatttttaaattttttctttagtttgatagcttaaaccttgctgtttaggatattttggttttccaagaatgatttattcaggtcctgattttaaacctttgattttaggatattagcgtgcatccaaaggaccttaccttcttagtacttaaatttgtgattacccgttctggtttttagataccctaaagcacagtttttaatcttgtttgtgtgtgccacaggcccctttgagaatgtgatcattgttattgaccataggcacaaaatacacacaaatacttaacatacacaattttgcataa

SEQ ID NO: 147050 - DNA, 456 bp, Homo sapiens
cctgggaatggggcacagttgaggaccagcgtggaggtcagtgtggggggaattaggggaaagcgacatgaaaggggaatgaagtctgaggtgggcaggggccggctccatgaggctcatgggccccaggaggggttcacaatgaaagccatggagataggagggtgccggggtctgttgggggagagcatccgcaatttctaaaaacaaaggtccagggttttcatgagacttcctgcatgggtcaaaccacttaccctggaagcccctagaaggcccctctggctacttttgggatatgagcaggctgctgaactcctagtgacaatacttccctacccaccatgacccacaagctcactgagctgagcacagcccccacacacacacccactcacagagctccccccagcagcctcattgcctccctcaggaaaccttccaggcaccacatgg

SEQ ID NO: 147051 - DNA, 385 bp, Homo sapiens
cgcagctcactgcaacctctgcctcccaggttcaagtgattctcctgcctcagcctcccaagtagctggtattacaggcacccaccaccacgcctggctaatttttgtattttagtagagatggggtttcaccatgttggtcaggctggtctggaactcttgacctcaagtgatccaccctccttggcctcccaaaatgctgggattacaggcgtgagccactgcacccaggctgtttgtttcttaatgactagaatcagggtaaacgttttcttagacattgtttttcaacacaaaagataaaattgtgagtgcaccactgtgcatcttgctttatctactgaacaatgcctctttgagaaccttccctatcagtacacaaaga

SEQ ID NO: 147052 - DNA, 783 bp, Homo sapiens
  misc_feature (617)..(617): n is a, c, g, or t
  misc_feature (631)..(632): n is a, c, g, or t
  misc_feature (637)..(638): n is a, c, g, or t
ttgacaaagttccattatggttgttagaaaatctgcttagtctgtagtcactactatgaattttattaaaagtcactagaactccacagtcttcctttaaaaagactagctctaaagagaagtaaaagatgagtaacagtttgtgttattgaatgctgattatgtgccaggtactatgcttgaaacctcacacatttcttactatttatttatttattttgccagtacaacagaatagattttatttctcttagagacagggtctcactctgttgctcaggctggagtacagtggctattcacaggcacaatcccactactgatctgcatgagagttttgaccttctttgtttctgacctagacaggttcactcctccttaggcaacctgggggttccctgctcccaggaggtcaccatattgatgccaaactcagtgtggacacccgactggcatagcgtactacagccctaactcctgggctaaagcgatcctcccaccccagcctcccaagtagctgggactataggcacgtgccaccatgcctggctaatttttgtatttttagtagagacagggtttcgccatgttggccagtctcgtcttgaactcctganctcaggtgatcctnnctcannctccctaagtgctgggattacaggcgtgagcccccatgcctggcctgtttccccaactataaaatgacctgcaatagtacctaccacaggggtatacttcagtttgatctgctaaccgacaggaccattgcggatcctctagatc

SEQ ID NO: 147053 - DNA, 245 bp, Homo sapiens
cttccagaatgggcccttatttcgcaagagtccgtttcatcccaaaataaatacatgccagtttttcactatctcagcaaatttagcatctctttacaaaccaatgtgctaccagcggcctcaaagtgcctgtgtcatgtccctgcttagtggatttgcagcagctgtgaaatgtcaagtcaaaatgccatggaagatctatacaacgcctcagcagaagaaagggcaagaaatggtaaaatgct

SEQ ID NO: 147054 - DNA, 515 bp, Homo sapiens
tcctcatgccattcggttctctgctcaaatgtcccttagtcaagttctcaggaacctcttatccaacaaaatatatctcctgccatcctcaccaccaccaatcttctaacccgagtatattttctccataacaattatcactgatattagaataaatttgaaagttgttgtctgtaccactaaaacatattatttgaggccaggaccttgtccagccaccacttgtatccctagcatctagaacataccagtacagaggaggggcttaacaaataagaggtgaatgatgggtgaatataattggtatgctgcttttgataagcaattttataacatgtgtgtccgaggcgggtggatcacctgaggtcaggagttcgagaccagcctgaccaacatggtaaaaccccgtcttttctaaaaataaaaaaattagccaggtgtggtggtgcacgccagtaatcctagctactcgggaggctgagacacaagaatgacttgaccctgggaggtggagg

SEQ ID NO: 147055 - DNA, 770 bp, Homo sapiens
atatatgaagaaaagatacagtcattttcagacaaacaaatgctgacagaattcgccattaccaaaccagcactacaagaactgctaaaaggagctataaatcttgaaacaaatcctggaaacacatcaaaacagaacctcattaaagcataactcacacaggacctataaaacaaaaatacaagttaaaaaccaaaaacgaagtacacaggcaacaaagagcatgataaaagcaatggtacctcacacgttcatactaacattgaatgtaaatggcctaaatgctccacttaaaagatacagagctgcagcatggataagaactcaccaaccaactatttgctgccttcaggagactcacctaacacataaggactcacataaacttaaggaaagtggtggaaaaaggcatttcatgcaagtggacaccaaaagtgagcagtggtatctattctcataggagacaaaacaaactttaaagcaacagtggttaaaagtgacagagggacagtatataatggtaaaaggccttatccaacaggaaaatacgacaatcctagacatatacgcacctaacactggagatcccaaatttataaaacaattactaagaaattgagatagagagagatctaagaaatgagataggcagcaacacaataatagtggaggacttcaatactccactgacagcactagacaggtcatcaagatagaaagtcaataaagtaacagcggatttaaactataccttggaacaaacagactta

SEQ ID NO: 147056 - DNA, 339 bp, Homo sapiens
acacagggtcagtctctagtaatctcacgattgtgccatataaaagaatgagtgcagatacaaagtatggggtcctcaatctagagacctcatcatgttaaaaattcacataaattctgcctattcttacgggaatttctatgtgtgatcctaataccttttagaaaaaaaaggtcccatgaccaaactgaaaataccaggtgtttctctctagagtccttttgacctctgccaatatacatctatgttctctgcccctagtgattttaattgcacattctcttgaataaacatagtccacatagatgtcgctaatggcaactccagcaaaattgcagg

SEQ ID NO: 147057 - DNA, 811 bp, Homo sapiens
cattttcagacacctgcgggtcacgtgggtggatgggaagctgggcacctggtgaggggtgaggatgttgagagccagagctgcgttttgtctctgttgatgtggcgaggccctgggttggtcactgggatttttttttttttttgagacggtgtctcgctctgtcgcccaggctggagtgcagtggcatgatctcggctcactgcaacatctgcctcccgggttcaagcgattctcctgcctcagtctcctgagtagctgggattacaggcgtcaccacacctggctaatttttgtatttttagtagagacagggtttcaccatgttggtcaggctggtcttgaactgatctcaggtgatccgcccgtctcggcctcccaaagtgctgggattacaggcgtgagccaccgcgcccggccggtcgttgggattttaacagccctgaggcccctcacgctgccaggtgccagcccaccctgcagccctgctcccctgcccacacgcagaagccaccagaggcttctggactgagcccccactgtcctgcagccgggctggcctgtccacaccacagggcgtgctcagctactgagcagaagcgtcacggacagggcagatcaggccaggacaaagctcttccgccacaggcgggggtctgaaggcatctcagagggcccccaaacaagggacgctgcctggaaaccccgggacaagatgacctcggttcagatcttagcaccttctggcaaccttagagaaagcttctggagggaggggctggttcccaggatgggcagaagccggaaagtc

SEQ ID NO: 147058 - DNA, 628 bp, Homo sapiens
ggagatagcagtgctgaatcatacttcactacagactccaattcctggctcaagggaatcctcccacttcagcctccagagtagctaggacacaggcaggcgccactacgcccaggcatgtaaagaagggatcttgccatgttgcccaggctggtctcaaactcctgggctccagcaacccaccgtctcggcctcccaaagtgctgggattacaggcgtgagccaccgcgcccggccggtcgttgggattttaacagccctgaggcccctcacgctgccaggtgccagcccaccctgcagccctgctcccctgcccacacgcagaagccaccagaggcttctggactgagcccccactgtcctgcagccgggctggcctgtccacaccacagggcgtgctcagctactgagcagaagcgtcacggacagggcagatcaggccaggacaaagctcttccgccacaggcgggggtctgaaggcatctcagagggcccccaaacaagggacgctgcctggaaaccccgggacaagatgacctcggttcagatcttagcaccttctggcaaccttagagaaagcttctggagggaggggctggttcccaggatgggcagaagccggaaagtc

SEQ ID NO: 147059 - DNA, 419 bp, Homo sapiens
agcaccgtgtgaggagtgctgagtcagaaaacaaatcttgtgggcctctcatcgtaaattgtgaaacgtttctggaaagcaatgcagcactgtcttcctaaattaaaaacgtacccaccttttgacttgacaattacttatctaggactttattttgtagagacacacaacagtgtatgtacatcattgcagcattaattttagctgcaaaatagctgcacactacttaaatgtcatttaaataaattacaatacagtcatgctagggaatattatgcagctgaatgtggcagtttcgcaggtgcaatacggaaagatgtcaccaacacactgttaagcagacagcagtgtgcactgcagctcccgtttgtgggtgcccatgtgaagagcacaatgaatttacccccccgcccctccac

SEQ ID NO: 147060 - DNA, 434 bp, Homo sapiens
agcttaccccttactgggattacaggcgtgagccaccacacccagcagtgttgacattttctatcaagagtactgctgagctggcgccctttggccagttactgaactgacggatgcagaaatttacacatgttcatgtatacacaaaaggaaccctaattccatggaactggccttctcaagcttgctgatttcttagttatgagtaaatttgggaggctgcagtgagagaattgcttaggcctgggaggttgaggctacagtgagccaagattgcgtcactgcagtctagccagggcaacagagcaagaccctatctcgaaaaaataaataaataaaaacaagaggacctaacataatctgagtcaggaggtgactattgggaaggttgcttggagtttgaatggcattctaactgagacctggaggatagg

SEQ ID NO: 147061 - DNA, 230 bp, Homo sapiens
cacagcccagccacccaccgctgaaatgccataaggccaggaaggggagggggcatcgttttccaccccagaacgtggcttctctgatgctcagatgtgcagccttgacgccccgcctcccagctgcacctcaccagcagggtctcttgcacccaactccctcctccacccacagcctgcagcctggcttcaggctgtgggtggcatcgataaacaccgggtaccgagct

SEQ ID NO: 147062 - DNA, 274 bp, Homo sapiens
aacagggagactgtgggtgggcagcgccccagtatcaagtgccaggagccgatgaaggccctgccctattgggtgagcccactgccgaaacctggcagccactcaggttcctccctgcccccacccccacacccgacctgctcagcctcctcctaaactacctggaattggctctgcctatttccagtccttctctagggcattattatttccagcccagaaggctgaattataaatgaaattcttgtctgcagtcctgccctcttacaaactg

SEQ ID NO: 147063 - DNA, 259 bp, Homo sapiens
ctgtgaatatatatctgtgtgtgtctgtgtgtgtatctctgaaagaggaaccaaaagcaaccctgcaaagataaaatataaaaccccgctcctgtcagggaatgccgactgattacagagagtcttaggaagttaactggaaacttagggcatgaaacagttcaacctcagcacattttttccaaggcaatgatgaaagtttggaagcatagggcaatgatggtatcatcactcagatcctcacacctgtcccaacagc

SEQ ID NO: 147064 - DNA, 216 bp, Homo sapiens
ctgaattctcagcacagtagagtttattgaatcctgggatttctgtcctcagagagtccttgggatcatctagttagaattcctttcaacttacaaatgcagaaactcacccaaaattcttgtgttttgccctagttcttgaggctggttatctgatttcaccctcagaactgtaatctaggtctttctgcaaccctatggaggggtctagtgagc

SEQ ID NO: 147065 - DNA, 458 bp, Homo sapiens
tccactagtgtaggctaataatgataaggatgaggaatgcctaggggcaataagtatttagaatccgcagaaccatgttttttgcagaaggtactctctattccttaattaagagattaggcctggcatggtgactcatgcctgtaatcccagcatttggagaggccaaggtaggtggaccacctgagttcaggagttcgagaccagccccgccaacataaaagtgagctaattcaatttagtattgtatttaatattaaaccaaaatgatttcatagattgcaatagagtaccaaatataggccgggtgcggtggttcacacctgtaatcccagcactttgggaggccaagaccaccagatggcttgagtccaggagtttgaaaccagcctgggcaacatggtggaaccccgtctctacaaaaaatacaaaaattgtccaggcttgctagtgcgctc

SEQ ID NO: 147066 - DNA, 442 bp, Homo sapiens
agtgcagttcttggggcttcagcttcctcactggagccataggcttaatcctgaagcctgaaatcaggaaggaaggtcaagctgtccatcctccacctctgagcatgacctcacccccaccacctctgctgccaggaagcctggtggggaatttagaatccatctacaccttcccttctcccccatttgtttacagagggggaaactgaatcccagagtggagaggaatttggctaaagttgcaaagcaagacagtcaatagataagtattgtacacctactgtatgtcaagagacctggtctctgctcttatggatcttctggttgtggaaagcagggagcagacattgagaccgtcctatttccatctaactcccagccatccatggaagagaatacagcctcctaccttctcattcaaggtgctctgggcttggcttga

SEQ ID NO: 147067 - DNA, 302 bp, Homo sapiens
ggtcctatctgtgtcggggttgggactggaactgtgtttgggagctcatgcattggtttttttcagggcagtgggcaaaacgaaccagtcgggctataacttgacctacagaggagagggatcacagagctctttgaggatgctggggccctctcacaaatttatttctcatagaacggttcaagtgattctcttgcctcggcctcctgagtagctgggatttacaggcgtgagccactgcgcccggccaacatacaaatttttcttatatatttaagattctgcaaccccgaacacggata

SEQ ID NO: 147068 - DNA, 716 bp, Homo sapiens
ccactgccaaaattgtacattctacaccctagagtaataaacttctctcttggtgctagaaaaacttaaatcatactgaatgttgggatgtttggggatgctatgattagacttcctttagttaccatgagcctaattaccaccgccaaactattttgcttacttgttggctgtgtccatactggtgtgggataaagtggagggaattggttacttaaaatatttgcagctcttccacaaactaccattgtggccttaaataagacactttaactctttgagttttagttggtttatatatgagacagaagagttgattggataatttccctcttctctgttgaccctcaagctcagtagttttaatcttgtaaattttgttgtgcttgtcctgctttttcttttggggaacaggctactctttgaagtggactagtagtatcttggtgttctaatgagtagatcaacctatgacatgagagccactgcatgccagggcactgttcagtcactgatgtgccttatctcatttgagacacctaaagaggtttaggagagcagacactgatgaatcttagttgacagttgacagtgtgcatagacaagtttaaataacttgctctatattacacagccaatacgatacttcctctccccctgcaccttcatgctttcccgcagtttttgtttataatgtcacaactttatattgaaca

SEQ ID NO: 147069 - DNA, 168 bp, Homo sapiens
tctacttccctccagtcactgattttttaattagattcatgattacaactctaatcttgttacttccctgctcaataaccttcagtggctcccctctgcctttaaaggaaaacaaaaacttactagactttttttttttttttttttttggagaccctgtctcactct

SEQ ID NO: 147070 - DNA, 537 bp, Homo sapiens
tatttttagtagagatggggttttaccatgtgggccaggctggtctcgaaattctgacctcaggtgatcctcttgcctcagtctgggattacaggcataagccactgtgcctggcctagatgagaattttaaccttttataatctcatcccgctctctgtttcagttctttgttaaaatggtatgcagtggttacattactatgcctgtataaatattccatttagttaagtagcctactatatttcctttgttctgaagttaaaaattcctctttatttgattaatctccatcttcctatgtactccagcaacctctcaaaatgaatttccacatagccaaaccaccagataataatcttttggtttctgttgttttcctggacacctctctgctagatactttctctgtcctgcttcaataatggactggttattaattatgcctggttgcacaattaatgccttgggaatttcctaagggtctctcctgtatgcgataccctgtttttttgcaatacctttctttgttggttta

SEQ ID NO: 147071 - DNA, 378 bp, Homo sapiens
taaaacagtcccctgagtatagattctgagaactccaaaaatggaaccttcagtgactggtagcagggatggtttcttttttgaattcaagggttctgttattgttctctgtgtcactagcttagatgtagagcctgatgctctttgaagctgatcatttcttttgagcttataaatgtttttgctctgaggtgacataaatagaaatttaattacttggaaaatcataaccaaagggagcattttatttcctactgtttggtggaagctgcatttttttttatgccttgtgctttggcatacatacatacatgtatttttggtaaaaattgcattgtaaaggaacttcagaaatttcaaatgttgatggaactgcct

SEQ ID NO: 147072 - DNA, 412 bp, Homo sapiens
ccttgccttatcttgctgtgacactgttgtgcctacctgggtctcctgcagatgcttacatttcagatggccttggcctgacattagactgcatttggaaggggcctgtttaaatgaagacccttgacggtagttaacaaaatcaccttcacactgtcttaagccaaagagggactgtcctaggggaagcttggtgactcacaggaagccaggacacactgcagggccaggccgcaggtgggacccgggctggagagtcctcagaaccagcctgccaggctttctgcaccagtgtgtactgtcgctcaagtgctgtcacttgctctgtggcttcttgtccttcctttgtctttttctactcactggctcctctgctgcttcaaacccattcccctcacccatagctgtctca

SEQ ID NO: 147073 - DNA, 423 bp, Homo sapiens
atctatttactgttcccagcccctatcactttgttcttataaacatattcattccacatgcatcactgacaggcactgctaggaaaggaaactaacccatcttggccacctttacacatcaggtacttatactaaggtgatttctatatattacagtattgaatcaccacaacaatccagtgacgtaggtatcattacatattattatccccaattaagacattagggaaatgaaacgtaggaagattcagagaaagcacaggaaggtgaatatgcccaagatttcacattaagtaaatggaatgcaggattcaaatttacccctgtctgaatctaaatctcattctctttccatggcatcattctctctcctctctaggcctttatagaggaaatataggcccaaataaaatatcaaaatct

SEQ ID NO: 147074 - DNA, 177 bp, Homo sapiens
acagatgaccactgttcaagctgaaaggaacctgagggttgatccccttcgacttcttattttacagaaggagtaagccagggtaggcacctgtcacatagtctggtggtggtagaagtacatctaacatctgggtctccttcctttcctaactttaaattaagaactatatccatc

SEQ ID NO: 147075 - DNA, 257 bp, Homo sapiens
tgctggagttgcaggcagaaggagccaccacacccggccaaagcctggctcccttctgaggctgcgtgacatcccatcgtgtgcacagggcacgctgggctgacccacttgtcctcctatggatgctctagctgccccccactcctggctctgtgaatcgtgctgtggtgaacctggatgtacgcgtttcaggctggaagttttctgagatatgtccctaactcacttccccaaagggtgtctccactgacccactc

SEQ ID NO: 147076 - DNA, 175 bp, Homo sapiens
ttgaaaaattctttggcagtcatgtttacttgaattgatgccaggataggaccatggttcacaagcctgacttctcagaactgacagtaaatcttcagaaagacaaaaacaaagtacaatactcaaggctgtctttcccccagtccccaataagaattgccagggcccagacctg

SEQ ID NO: 147077 - DNA, 636 bp, Homo sapiens
agttccccagcctacccctctgcagaacaccaacactcccctggccctgatccaggttcccacctctggcctggactcctcccagcagcctcctcctcacacttgtccccttcatctcctcccggcacgtgccagcgaaacgacctactttaaatgtaaatctgattgtgtcctgccccactgagagttcttcagtgtctcccagcaatgataccatatttcctaagttggtgtgaccctacacctaggcgtcaatggacatcaaccactggggttggacatcagaaggcccagcaggaacacggcatattgttctggaaaccaaatttccttcacagcaagtacttgaagatctctgtttagactattctacacatatcacatgaagataaatgacaacacaggaatcattctcatgtactagtggaaggccagtaaagggtacatatacccaatctaccctatctcctcacacacatgtgcgcacacaggcacacgtgcacacacaggcacacacaactcccctctgcagtgtggcaagtgaccctggagggcagttgcctttaggttcaggcatgagtctcagcctggcacacagagcctgtctacccttacctgccaatccctgcctggaac

SEQ ID NO: 147078 - DNA, 429 bp, Homo sapiens
gctgcaatatttgcaggaccataaacaatagtttcaaagtaggaatatcaatagtgttctagtaacgataaaagagttgaatgcaatttaagatcctgcggcagttttagaaatagattttaaagaaatgatgatttctatgtttaagaagatgagttggaaacttgaaaagagaattctagaactgaaaaatgcaaaaagtgaaattaaggactccatcatttaacagattagacacagctagagtgaatttgtgagtaggaaggtgggccagaaggacatttccagaatgatctcaaaagtcaagggcaggaagttggagaaacagaaggcaccgagacagaatgtgcaggcagacacaggaaaggagacactgaacgggtcaaaagcacgtctgaaaggaccctggccaagaactaccccaaatgg

SEQ ID NO: 147079 - DNA, 440 bp, Homo sapiens
ggatggggagatcagtgtggtgaagcagtctgggcaggcttcctggaggaatggccccagcacagaagtggttgacttggatttcatcagcatcaaggcaggagcagagagtgacagaggacagacccctatggggagaatcgggagctctgaattcctgttctgactccacctctgaatcattctgcctccgctctctgtgtgtacctctcctcttttattcaccaatggcagctgcgggatctgctgagctaacctcaaaggctgccatgaaattcaaacgagacagtgtatctaaagacattcatcgggaactaagtaccacattaatatcagggacaatcattagccgtggatcaggaaagctaatgcaaaccttatgatcataggagttttccctgctgagttcatcgatggatggcaagtgcttaggacagcgc

SEQ ID NO: 147080 - DNA, 768 bp, Homo sapiens
caatatttacatatatatgtatttaaacatcttttgccatgtagtccattttattttattaatatcttttttggtgcactttagggcagactgtatttttgtctaattgttatcattatatatagtccttttatttgtggctgttttctgttggctcccaactatgagtaattatgaaattagcttgcatctcttcttcctctctccctttctccgtttcagcatctgatttgtaaaaaaaaaaaaaaagccttttacttctaattaaaaaaattattagtagtcaacaaatttattatattttatgtgcattcttttcatgttgcattggacctgtattgatagaggacagagccataaattactatactctttcccttacaactgccataaaagcttcatttaggaaaagttctctgtagcattgattttaccatatgtcttatatccttttcatactaaaagattctttaatagtttattgggcatatggtgctataaatatacattcatgtaacactacttcctggaacctcctaaaaatgaacaaaactaaccaaaaatagagaagaaaacagctaaaattcatatcacattttatgaaatttccagtgaagtgtggatccatttgcaggaggatacagagatgtggcatccccgcccatctctggctggttgcaggtgtctaagcataggtttctgaaggtactactcacagtcgttacagcagagctaggagctgatggatgaatagaccattgccaaaga

SEQ ID NO: 147081 - DNA, 820 bp, Homo sapiens
gtgggactcgtcaccagtcttcgcaagtaactggaaccagctggaaagtcatcagggcccagggcattgagcacctctggccattgctctagggccatgtgacctcccatctcagaactttctctgcttcctggtggatgtgttgaagaatggcctcttggccctacagctgttcagctccaaccccacagccagctgtgctgagtccttacccatgcttcggacccctgtgatataactcacatcccatacgattcccctccctcctggagcactggatatgggcttctcgctgccctgtctgaggcctacatctcatcctgtgccttcagcctggaggtcgtgccctcctccacggctcagattcccctgacactgatctctctgtgcccatctccttccttccccttccttcttcggtttgttttctttctttttaaccagcctgattccataaatgcccgcatcctcccagctgttttaacaggaaagctgcttgactccaggtccaagagaacagctccttgctgctgcttccggcttgttcacctctctccctcactcccggccagtgtcatcttcctatggaccgttccagcagccaagctctcccagcacctgctctgccccctccaattaatttgccatgctgctgttggagatatttccttcaaacatatttctaatcccatcgctttcatttctaaagcctccggtacttttcctttgcctgtaggagtccgcacttcccgcacgccctccttgcccccgtctcctccctccccagcctcacatgccactcaatacctagatctctaac

SEQ ID NO: 147082 - DNA, 234 bp, Homo sapiens
caaaaaaaaagacccaattctacctaggtgagaccttatagtgtccagcacaatgctcagtacacatatggcaatgccaaattctctgaggccttgtgatgatgctgctattggagagtgggaattcttctaaagtgtgttttcctggatccccagaggaatgcaatcactgccttcctcaaagaccctcattatgagaggtagcccttggcctgtggcttcctggcttgacag

SEQ ID NO: 147083 - DNA, 457 bp, Homo sapiens
gcttcctctagtagaattaaaactcaaaaggtgaaataggaaatgggcaaatgaaaactagaatttagcatctaaaaggaagaaaatcagctctcttagagaggaagacaatcagctctcttagacacccagccggcagagtaggagaggacagtctcaaaggctcctctggaccagtcaaaacagaacaccaacaaacaattgcttagcctggagatacagttttgcagttgtgttgaatacagtgtgtggtaccttagaaattcaaaggattttaaagtaatgactgaagctgtgaaaaactgagaggtacaagaatgacttctttcttctgatctcaacaactcctggctctataccacattctggaatgtagaagtaccaccctagaaaggggattctcaagaccctccaaaagttatctgatgcctgctcatctcctttggaatttggggtg

SEQ ID NO: 147084 - DNA, 382 bp, Homo sapiens
ccctccactgaggagggccgtagttctgttgagaaattgtcagagttgataagctaagggtacagtcacagattttcttgttcagtctgcttaacagaaaggctgttccaacggtagggggagagaaagggaccgtgtttcattcctagtgtaaacattggaagtccaggtattttgaagattacctcatttttcaaaggcgaaacccctcagtcttcaccccaggaaaatgggacgcctcacgcctcattttagctgggtctcctgagtagctgagactacagctaatttttatatttttttgtagagacaggatcttgctatgttgcccaggctggactagaactcctgggctcaagtaatcctcttgcttcagcctccc

SEQ ID NO: 147085 - DNA, 209 bp, Homo sapiens
cttagattctctacccttctctatttttcctgtcttagactatcctaagaggctgtccatgcatttcactgctataaattcaccaacccagatattccgttcttctcctcacttctatctcctcatgttttctaaatagctccttttcagtcatttcaactctaccgtcatgctttatcagattttagggccaggcgcggtagctcacg

SEQ ID NO: 147086 - DNA, 246 bp, Homo sapiens
agttttattaactaaagagagaattaatggcaccaagtaaagtaactcagctggaaaggttttgtttgttttctttcttggttgtgtgtggtttatttaaacatctactatttttttaaacatctactatttagattttttttaaacatctactatttcttcataaggatgctgtatatcaaaacctccaaaaagaggtcagaatagccagtctaagtaatcaggacctgttggcccagtatttag

SEQ ID NO: 147087 - DNA, 455 bp, Homo sapiens
accgccttccagcttgggattcctctgcttggtaccaccccccaaaggggccacaaagccttccctaagccaggaggtctctgccagcatcttcgtcacgccccagcgcagagcacacagtaggcactcggcatgcggggtccgtcagagcaaggccaggtcttcctcttggctctgggtgcgtagggcccaggcccggcctggccccgcccagcctccacagtccctcctgaggacttctccgtggattttttgaggaacaccaagcctggagcatgacgggcccagctctctgggagtggggatgggaagagggagagagaaacagtcctccccacttgacactctagaagcttccatctgggcagcatcaccatgtattgagcgctgcgctggacatgtcaaccctataggcgccactgtgtccatatcagagagaggaacactgaggccca

SEQ ID NO: 147088 - DNA, 399 bp, Homo sapiens
tccacctagaaccttaaaatatggcttaaggtctttacaggtgtaatcgagataaagtcatactggacttgggtgggccataagtccaatgactgatgtccttctaagaagagggaggggacacccagtaggaagacagtcatgtgaagatggaggcagaggctagagtgctgcagctgcaagtcaggaaacgccaagaaatgctggccaccatccgaagcgagaaagaggcaaggatcctccctagagccctcagggggagtgtggccctgctgccaccttgatttgggacttctgacttccagaattgtgaaagtcttaatttctattgttgtaagccacccagtttgtgataatttattacagcagccccaggaaacaaatacagtatttttatga

SEQ ID NO: 147089 - DNA, 289 bp, Homo sapiens
ctctctctctctctctctctctctctctctctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggc

SEQ ID NO: 147090 - DNA, 520 bp, Homo sapiens
cttgtgaccctgcgaagcgccctcctggcaagtcccctgcaggtgcggtgggtgccatgcaggagggtgctgagcttggatggaagcaggccctctctgcggcagatggcggctctcaggacgccatgggtctgcggtgtcccttacccactgggggggctcggcagcctgaggagctccctcttcctgatgcagagccctcactgctcactgccatggaggaggcaggagatcccgccggaccccgcttggagggctgggcctggagcatgcatgggtgcggggtcaacgcctcaggagacttggagcttgggagccccctgttctgggacacttgtggccgtccagctgctgccctgggaatccacacctggaaggtgggttagggagccatccttgggggaagctctgcttttgagtctgagaagtcgtcccaagttttgagggtccctgtgctggcttagaagtccatgtaaagcttgatgggggatgaaagtcagctgaggcctgccggtgataa

SEQ ID NO: 147091 - DNA, 1827 bp, Homo sapiens
  misc_feature (19)..(19): n is a, c, g, or t
  misc_feature (21)..(21): n is a, c, g, or t
  misc_feature (25)..(27): n is a, c, g, or t
ggcgccgaggggaggaaananacannnacgccgcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggc

SEQ ID NO: 147092 - DNA, 2258 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaaaaaaaaaaaaaaaaaaaaaaaaaagaaaaaaaaaaaaa

SEQ ID NO: 147093 - DNA, 2093 bp, Homo sapiens
  misc_feature (64)..(64): n is a, c, g, or t
gggcacgggtgacctcccggctccacctgaggaccccagagaaacctgagacttctaagcctcnacgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147094 - DNA, 1681 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggttt

SEQ ID NO: 147095 - DNA, 3386 bp, Homo sapiens
gtgtcccacttggcagcagtgcaggtgagcgtggtgccgtcaccactggcctgtcccaggaactcatcgcccgccacgcatgaggtcagcgtgcggctctgtggcacggtcctctccccatggcaaggattgggatcatctttcatgtctgcagacagcatgggcgaggctgactcgccattgctgtgagctttgtatgccgtcacgtgcacaaggacgtttgcgtcagctgcttctgtggtttgaattaagacctcagcttggcttggatgggggcatttctaaggcgagcgctgtcttgatcctgaatgttttctcattgaatcgcaggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggccttcttggggctggagtggccgagccacaggtgcacgggcctttcaggctgggagctcgctgtctcgtatttccccaacgcctgcgccctccggaaaggtggaaagcccggcctttgccttcatggccatttcgtgtcccagtagggtggttgggcggtgaaccagcctgacagccttcagggcggccgcccgattccattgtgaacaccgtggggtccagtgtcagagaagggcagttacacagaaacggggttcagtgtggcctgggcgagccagccccacagagctgactttccactgggcaggtgggagaatgcccgagctccgttgagcccagtgccagagggagctgggacagccggagggggccggcggggagccctcctagtcacccaaggcaggggcgtgtggtcaccccaaggtcctgctgggactcctgccgtgccccgcaggtcacactccgagccccgccagcaggacagccctgcgtgcctgagtactgcgcacgttcatcaggtggtacctgagggtgccacgggcctgggccaggaatgagaggcctgagcggggcctggaagagcagggtctgcagaggagctgtgtgtggctgccccgccacttcgagtgagggccgagcgtgccctttgcttcccgcgtttgggtgggaagggcttctgtggggtctcctggctcccacgtcccctgctaggatgcgtggtcggcgttgttggcccttcatgtccgtcagcacacacgtgagcggggccacgggcagcccggaggcgggtatccagacgcctgccctggagctgcttctccctgcctgcgtctggccctgggagtgttggggctccagcctttctcagacagcagccccacggagcagctgttgcccgtgcacctcccccgctcagggagggcgcaccctgtgcgagagtttgggttcgtgggaacaggctgtgccctcggaagaccacctgtggtgctggccctggtgtccgtgctgacgccaccctctccttccaggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147096 - DNA, 3087 bp, Homo sapiens
tcgagctcggtacctctgattacgcggctcgggaagctcttcgtgggcggcctgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggccttcttggggctggagtggccgagccacaggtgcacgggcctttcaggctgggagctcgctgtctcgtatttccccaacgcctgcgccctccggaaaggtggaaagcccggcctttgccttcatggccatttcgtgtcccagtagggtggttgggcggtgaaccagcctgacagccttcagggcggccgcccgattccattgtgaacaccgtggggtccagtgtcagagaagggcagttacacagaaacggggttcagtgtggcctgggcgagccagccccacagagctgactttccactgggcaggtgggagaatgcccgagctccgttgagcccagtgccagagggagctgggacagccggagggggccggcggggagccctcctagtcacccaaggcaggggcgtgtggtcaccccaaggtcctgctgggactcctgccgtgccccgcaggtcacactccgagccccgccagcaggacagccctgcgtgcctgagtactgcgcacgttcatcaggtggtacctgagggtgccacgggcctgggccaggaatgagaggcctgagcggggcctggaagagcagggtctgcagaggagctgtgtgtggctgccccgccacttcgagtgagggccgagcgtgccctttgcttcccgcgtttgggtgggaagggcttctgtggggtctcctggctcccacgtcccctgctaggatgcgtggtcggcgttgttggcccttcatgtccgtcagcacacacgtgagcggggccacgggcagcccggaggcgggtatccagacgcctgccctggagctgcttctccctgcctgcgtctggccctgggagtgttggggctccagcctttctcagacagcagccccacggagcagctgttgcccgtgcacctcccccgctcagggagggcgcaccctgtgcgagagtttgggttcgtgggaacaggctgtgccctcggaagaccacctgtggtgctggccctggtgtccgtgctgacgccaccctctccttccaggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147097 - DNA, 1705 bp, Homo sapiens
gctcggtaccccttttggggtctttgctcggttgcatctgttgtacctgagaaacattttttaaacaaaaaaattcaacacaaaagaattttttaagaaaaaaatgctactggcctaaataaggtttatagttaagtatttagtcttaagttgtaagatgctaagtgtagtcataagttacccgagggtgtgtctaaagggaagggggtgctgggacccgcagcctcgccctaaaccagagctcggtttgtttaggtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147098 - DNA, 1275 bp, Homo sapiens
cctgagccttttgttttacggtatattgtaaacttttatgttaaagaaaaaatatacatttacaaattgtgagatttttaagagaaattttctacgatgtatactggcttattttttaatttaaaacggggtttccgtcgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147099 - DNA, 1467 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccaggcagccgctgacccgcactcctaagggcccacagcggacaccagaggggcttttgtctgcagagcgtcttccaccagcagagcctttggaagctcccccagggagccccacccaggaccctttgggggatgcctcagtcagggccaggctgaccctgacccctgcttaccctagtcccctcaacctcctgacactggaggaatacttttctcctaagtctaccctggacactttttagggcacctggagagaactttcctctccactgtggcccctgcgtggtgaagatcaaaagaagttgtttgggaaaaaaaatttattaaaaaattctattatttt

SEQ ID NO: 147100 - DNA, 649 bp, Homo sapiens
ctctctctctctctctctctctctctctctctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147101 - DNA, 2244 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggccttcttggggctggagtggccgagccacaggtgcacgggcctttcaggctgggagctcgctgtctcgtatttccccaacgcctgcgccctccggaaaggtggaaagcccggcctttgccttcatggccatttcgtgtcccagtagggtggttgggcggtgaaccagcctgacagccttcagggcggccgcccgattccattgtgaacaccgtggggtccagtgtcagagaagggcagttacacagaaacggggttcagtgtggcctgggcgagccagccccacagagctgactttccactgggcaggtgggagaatgcccgagctccgttgagcccagtgccagagggagctgggacagccggagggggccggcggggagccctcctagtcacccaaggcaggggcgtgtggtcaccccaaggtcctgctgggactcctgccgtgccccgcaggtcacactccgagccccgccagcaggacagccctgcgtgcctgagtactgcgcacgttcatcaggtggtacctgagggtgccacgggcctgggccaggaatgagaggcctgagcggggcctggaagagcagggtctgcagaggagctgtgtgtggctgccccgccacttcgagtgagggccgagcgtgccctttgcttcccgcgtttgggtgggaagggcttctgtggggtctcctggctcccacgtcccctgctaggatgcgtggtcggcgttgttggcccttcatgtccgtcagcacacacgtgagcggggccacgggcagcccggaggcgggtatccagacgcctgccctggagctgcttctccctgcctgcgtctggccctgggagtgttggggctccagcctttctcagacagcagccccacggagcagctgttgcccgtgcacctcccccgctcagggagggcgcaccctgtgcgagagtttgggttcgtgggaacaggctgtgccctcggaagaccacctgtggtgctggccctggtgtccgtgctgacgccaccctctccttccaggtcacggaggtagtcatgatctatgacgccgagaagcagaggccccgaggtaagggcagatctagtttgacctcggccgtctccctgctcctccctcagatggcaaactatctcacccgccaggcacacacaggtggcggctgtagcaaacagcctcaggaagggacgatttggagacaaatgactaaaacgtgggctcctcatgtgcaccccattcagcctgtctgtgcttcccgaggtcagacgtcacacattgttttttggcttgttcttttgaagtttttacgacttgtcatgagtctcggcctggcttctgtttttcactgtccggaagagtgtggtccttctgcatttgaccttccttcaccctcatccagtcctcccagtgtggccggtctcatttcgtgtcgtcagctgggtcagctggctcggcctggcttctgtttttcactgtccggaagagtgtggtccttctgcatttgaccttccttcaccctcatccagtcctcccattgcg

SEQ ID NO: 147102 - DNA, 398 bp, Homo sapiens
gcggccgcctactactactaaattcgcggccgcgtcgattattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147103 - DNA, 399 bp, Homo sapiens
ctccgcagctcgcgggagggtttggagggttcccgtgtgaactaactatccttcccttcttcaacagcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggccttcttggggctggagtggccgagccacaggtgcacgggcctttcaggctgggagctcgctgtctcgtatttccccaacgcctgcgccctccggaaaggtggaaagcccggcctttgccttcatggccatttcgtgtcccagtagggtggttgggcggt

SEQ ID NO: 147104 - DNA, 1860 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggc

SEQ ID NO: 147105 - DNA, 2220 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147106 - DNA, 2111 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147107 - DNA, 3309 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggccttcttggggctggagtggccgagccacaggtgcacgggcctttcaggctgggagctcgctgtctcgtatttccccaacgcctgcgccctccggaaaggtggaaagcccggcctttgccttcatggccatttcgtgtcccagtagggtggttgggcggtgaaccagcctgacagccttcagggcggccgcccgattccattgtgaacaccgtggggtccagtgtcagagaagggcagttacacagaaacggggttcagtgtggcctgggcgagccagccccacagagctgactttccactgggcaggtgggagaatgcccgagctccgttgagcccagtgccagagggagctgggacagccggagggggccggcggggagccctcctagtcacccaaggcaggggcgtgtggtcaccccaaggtcctgctgggactcctgccgtgccccgcaggtcacactccgagccccgccagcaggacagccctgcgtgcctgagtactgcgcacgttcatcaggtggtacctgagggtgccacgggcctgggccaggaatgagaggcctgagcggggcctggaagagcagggtctgcagaggagctgtgtgtggctgccccgccacttcgagtgagggccgagcgtgccctttgcttcccgcgtttgggtgggaagggcttctgtggggtctcctggctcccacgtcccctgctaggatgcgtggtcggcgttgttggcccttcatgtccgtcagcacacacgtgagcggggccacgggcagcccggaggcgggtatccagacgcctgccctggagctgcttctccctgcctgcgtctggccctgggagtgttggggctccagcctttctcagacagcagccccacggagcagctgttgcccgtgcacctcccccgctcagggagggcgcaccctgtgcgagagtttgggttcgtgggaacaggctgtgccctcggaagaccacctgtggtgctggccctggtgtccgtgctgacgccaccctctccttccaggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147108 - DNA, 2306 bp, Homo sapiens
gcaggtgcagccagtgggggagccgggttgtgcccaacgctgccaatgctgggcaggccagccccgcccacgtggcagcaaggatatggcccgcaagagatgtgggtgccggcagacaggcgattggtggctatggacgggcccctgcaggaagaggtgggggcgtgggcagcacgttctactctacatcgtgtccacccctcctggaggatgtcacgggccccaggggcttgctcagggctacggtgcccgccacagttcagttttggctacgggatcgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147109 - DNA, 3433 bp, Homo sapiens
cttgtgaccctgcgaagcgccctcctggcaagtcccctgcaggtgcggtgggtgccatgcaggagggtgctgagcttggatggaagcaggccctctctgcggcagatggcggctctcaggacgccatgggtctgcggtgtcccttacccactgggggggctcggcagcctgaggagctccctcttcctgatgcagagccctcactgctcactgccatggaggaggcaggagatcccgccggaccccgcttggagggctgggcctggagcatgcatgggtgcggggtcaacgcctcaggagacttggagcttgggagccccctgttctgggacacttgtggccgtccagctgctgccctgggaatccacacctggaaggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggccttcttggggctggagtggccgagccacaggtgcacgggcctttcaggctgggagctcgctgtctcgtatttccccaacgcctgcgccctccggaaaggtggaaagcccggcctttgccttcatggccatttcgtgtcccagtagggtggttgggcggtgaaccagcctgacagccttcagggcggccgcccgattccattgtgaacaccgtggggtccagtgtcagagaagggcagttacacagaaacggggttcagtgtggcctgggcgagccagccccacagagctgactttccactgggcaggtgggagaatgcccgagctccgttgagcccagtgccagagggagctgggacagccggagggggccggcggggagccctcctagtcacccaaggcaggggcgtgtggtcaccccaaggtcctgctgggactcctgccgtgccccgcaggtcacactccgagccccgccagcaggacagccctgcgtgcctgagtactgcgcacgttcatcaggtggtacctgagggtgccacgggcctgggccaggaatgagaggcctgagcggggcctggaagagcagggtctgcagaggagctgtgtgtggctgccccgccacttcgagtgagggccgagcgtgccctttgcttcccgcgtttgggtgggaagggcttctgtggggtctcctggctcccacgtcccctgctaggatgcgtggtcggcgttgttggcccttcatgtccgtcagcacacacgtgagcggggccacgggcagcccggaggcgggtatccagacgcctgccctggagctgcttctccctgcctgcgtctggccctgggagtgttggggctccagcctttctcagacagcagccccacggagcagctgttgcccgtgcacctcccccgctcagggagggcgcaccctgtgcgagagtttgggttcgtgggaacaggctgtgccctcggaagaccacctgtggtgctggccctggtgtccgtgctgacgccaccctctccttccaggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147110 - DNA, 1350 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147111 - DNA, 1263 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147112 - DNA, 843 bp, Homo sapiens
gtgcgcaggggcggcggcgcggcggcgcggggacgcgcggtgaccgttggcgccgaggggaggaggcagccgccgcgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 147113 - DNA, 518 bp, Homo sapiens
tcttaaacagttgggctcaaacaatcctcctacctcaacctcccaaagtgctggtattataggcatgagccattgtgcctggccagagtttttaaaaacatattcagaatattaatatcttgtttctcatttgttgcaaataattttacccccagccttgtttgtggtgattttttttttttgagacagagtcttgctctgtggtccaggctggagtgcagtggtgtggtcttactgcaacctctgcctcctaggttcaaacagttctccctgccaaagcctcccaagtagctgggattataggcaccttttgtggcgatttttgatgcccagaggtattttgtgtgtgtatgtgtgatgtctgtttttaaaatgctttggaagctcttcctggtgctgagaacaactctttttccccaagcagttaattttgccaacactatttgggcagttatgtttctctctgctgatttgtgatgttacctttattatatattaaatttctatgagtattagag

SEQ ID NO: 147114 - DNA, 598 bp, Homo sapiens
cttcagattaaatggaaccctatggcaatgttttattctgagcataaatatgtgtgcaacctgttgaaaggaggagttaattctctgaagatatacagactgctgagaagtgaacaaaatgtatcaaggctgcagataaaaatataattgtgaataagaaaacaagcagcttatatcctggatattttaaatgaagccaatgagaatataaatttaaaattacacatctctagactgcctaaagatttcacaaaatggtgcctccaactttgttacttatcctcttttttatatcaaagtatttctatgatattttaacttttcttaaagtgtattggtgggtttctaacataggtaagattacctgtgttcgatcgatagaaaatcattttttatctcttttttattttgttttactctagtctgtgtatttttaatttacaatatatatacatttataaatttataatttcacccatgagggggaaaatactgtaactagctatgtcctttaagtggtgttgatttttcaagtggacacatcatctcgtttccaaaaatagtgatttccatctaataaaaattctaattctctcct

SEQ ID NO: 147115 - DNA, 884 bp, Homo sapiens
cttcagattaaatggaaccctatggcaatgttttattctgagcataaatatgtgtgcaacctgttgaaaggaggagttaattctctgaagatatacagactgctgagaagtgaacaaaatgtatcaaggctgcagataaaaatataattgtgaataagaaaacaagcagcttatatcctggatattttaaatgaagccaatgagaatataaatttaaaattacacatctctagactgcctaaagatttcacaaaatggtgcctccaactttgttacttatcctcttttttatatcaaagtatttctatgatattttaacttttcttaaagtgtattggtgggtttctaacataggtaagattacctgtgttcgatcgatagaaaatcattttttatctcttttttattttgttttactctagtctgtgtatttttaatttacaatatatatacatttataaatttataatttcacccatgagggggaaaatactgtaactagctatgtcctttaagtggtgttgatttttcaagtggacacatcatctcgtttccaaaaatagtgatttccatctaataaaaattctaattctctcctattcttggatgaagtagagattattctaatttatttataaatagccttttatcccttcctgctgtacaaaggagctgatagctaagcaacatttttccttcttcacatgtactcagtctcagcaaagaaatcagcctcaaattttaacatcactttctacttatttttttaagtaacaaggcctccatttcatttttaatgtaatttagtgatcttttggttatattcatataatcaaagtattattttaaagttgaatatatgtgaaatgcatagtaacttaatt

SEQ ID NO: 147116 - DNA, 356 bp, Homo sapiens
cgagaccctgtctcaaaataaaattaaatttaaaaagagcattggagatgaggtgtctgtatactttgtcatctttcaaactggaatacagtgaaagaactctaacacttacttcaagacaactgatgtaaagcaagactgtctagcccaggcaaacttcctgtcttcccccattttacctaggctgtccaatctgtttaatcaaagaagaaatagacctaactcttttcagagaagtaatcagctcagtaattaaaattaaaacttttagcctgacatttaaaccttatatatctgagagttaaaaatttctctctaagttgaacacatggacacagagaggggaacctcacaca

SEQ ID NO: 147117 - DNA, 272 bp, Homo sapiens
gatacaaacataaatgtcctccataattagttaagattaaaaaaaggacacagttattcaatgaaacatagccattataatgaacatgatatctatatgtcctaacatgaaaaaaagtccataatgtagtaagtgaaaaacatgtatgaaacatattgaatatgggtgaacaaatatataggtatatgtacattaaaatatatatgcacttatttattttaaaatgcataaaggaaactctacatagccaattgttaatagtggttgcttat

SEQ ID NO: 147118 - DNA, 189 bp, Homo sapiens
aaaatatagaatatctctgtgtctttgggttaggcaaagtattcttagatacagcactaagcatactccattaaggaaaacagtcataaaatacacttcttacaaattaaaaactcttcacaaaagacagttaacaaaaagggaagccacaaactgggacaaaatatttggacaatacatatctgacaa

SEQ ID NO: 147119 - DNA, 236 bp, Homo sapiens
  misc_feature (20)..(20): n is a, c, g, or t
atcttaccccttactgcagncttaccccttctgtcacttaccccattctgtcttagttagacatgaattaattgtagttagcacattttgagtgatgaccatgggcaggcagtgttctcagggaatgcactgattaatctccatgaccaccctgacatagggcctgctactatcctcgtcttacttctgagaggttttgtaaagtcacctgagatcacacagcttgggagtggtag

SEQ ID NO: 147120 - DNA, 415 bp, Homo sapiens
gtccaataactatggaacatgaaacagccactaaaaaagtgactgttagtgacatgaaaaaacatttatattaaggcagattacaaagtaataatatacttcaatcctgtttttataaaaactcatatatatacagacacatatactgaatttttaagactgagaggaagtacatagaaataaacagagaagacattgaaatgaaatacatagaaatacacagaaaaaaaggaacgtaaatataccaaactgtttaaatggttatttctaagtagtgagatttgaagtaaattttgtttttcttttatgattattatctatcatttttgtaataaaagggaaggtaacaataaaaactgtaatgattaaaaaaaaaatcactgtcctgttctaagccagttgagagaccaacatc

SEQ ID NO: 147121 - DNA, 210 bp, Homo sapiens
ccaccttaggcttcctgctagctgggactgtaggcatgcaccactgtgcctggcttaaaatgaatgttatattaagacaggtaccacttcccacccccatttgtggaggaatatggtggataatttttgttgatgccattcttagtcctataataccagatgtctagttctggggacccaagctcctgaatcatcacctttttttaaaaa

SEQ ID NO: 147122 - DNA, 204 bp, Homo sapiens
ccccaccccctgagttgtaatacaaaaattacttcagacactgctaaatgccctctgagaagcaaagttgccctgtgttgagaggtactgccttgtagatgctgtatctcaggtcaccttcatttagcaccttgcacttaacttgctgtagaccactcaggcttaatcatcccaccatcacaggtttaggggagaaaatcagtt

SEQ ID NO: 147123 - DNA, 386 bp, Homo sapiens
ctttcagtacattcttgtggttgtgcaactatcactgcaatcaattctagaacattttcatcactcaaacaaaaacccctgtaccctttttttgtcaccccaaatacctctatccaccttaggcaacaactaatctattttctgtcttctggatttgcctattctggacatttccttattaaatgttattcattattattaggatttttttttttttttttttgagacagagtcttgctctgccactcaggctgaagtgcaatggtgccatctcgtctcactgcaacctccacctcccaggttccaacgattctcctgcttcactctcccaagtagctgggattagaggcacctgccaccatgcccagctaatttttgtattttta

SEQ ID NO: 147124 - DNA, 171 bp, Homo sapiens
tgccctggatctgacattccccgaagaggacgtggtaggtggcagacagcaaaccctccacaagggaatctaggaaacgttagaagttatgaaccaaaacgtacccgagacaggtctcaatcaatttagaagtttattttgccaaggttaaggacgtgcccctgacacaac

SEQ ID NO: 147125 - DNA, 392 bp, Homo sapiens
acatggcatgtataggggacaggaagagaatagtccagagactgtattagggagtcataaggaatggcactgaaaaggtaaaaggacatattacagaaggacttgtgagcaaggcgcaaagtcaattagtccaacagagagccgttttaaatgctaaactcagcaaggagacaatgaaagcaagactgggaagagtcactaagcagatgaagtgaggggaagaaaagagaaaaaagagaactttcttgcacaagttagcaggggtagaactgagtcaacaggaatggaatgaaaggaaaggttatctcaaaaaggcatactttggcttttgtttttcaaaataaaagcctactggctgacccccttccatcatcctgttcggtgtatagcct

SEQ ID NO: 147126 - DNA, 448 bp, Homo sapiens
atcctgatgtttcaagggctgcatcgtgtgcccagagcaacagagccagggcatggggcaggggcctggggagtctgacaacccaaccaatgtgcatgctggcagctgaggcccagcaggccaagaggagccaaaaaggagcacctgtccacccatccatcaaccgagtacaagagggtgcctgagggaccagtgcagaactggcagtcctaggagagtggctcaaggcctgcagggcaggtgcatggacctagacctgcagggtcgggcccaggaacagcaagagtcagaagacccaggtcaagggaggcagagacaaatgtttccagatgaagcaggagagcactggggccgatctccagggccctgaggcaatgaggagtgcacagagggtcaagctggacggatatggggtgatagcagctctgcggaaagcctgatttggcca

SEQ ID NO: 147127 - DNA, 491 bp, Homo sapiens
  misc_feature (353)..(353): n is a, c, g, or t
ggcgatcgcgttgtctacttaagctagagattctgaatcctgtcatgatgagtggaaaattgaatattacttttaaaatttgtcctgcatgtttctttacctcttttcatattttttatttcttaatcttctctgcatcattctaattccagtacatgtgctgctgaagcaagcacacgtgcttaggttctgatggcctgtagaggcaggagacagagccttgggcctaagtaaggcaggaggttggaactgaaacacctgtaggaagttgggagtttcaaaggacaacaccttcaataaggttgaactagacaaagggaaacaccggtgtttccctttgtctccagacgtanctacagttattagcaataatagtagtggtagtgattgttactttttttttttttttttttgggaaaaaaatttccgcctcttgtggccccgggggggggggcggggggggcaactcaggtacgggaaaccccggctcc

SEQ ID NO: 147128 - DNA, 858 bp, Homo sapiens
tgcagcacagggcactatggagaatacaagggaagtggaggcctggtcttggcctctaagaggtaacaagggttggggtggggaggatgcatccacactcaatgccttggtaatctctgcaaagctacacaccccaagcccaaaggaaccgctggctcagctgccacatggggaaggggagtcggcaggacttccaggaggaggcaaggtctcttcgtgggtctgggggagaaaaaaaaatgtctaggtaggaattatggcttgtgccaaagatggggcacttggaggggtgggccttgcaggaagggcatttgtaaatcccaagagttggcattgcagcaatggtgagaggtgggaggtccctgaggcccgggagtcagaggacagcaggcaaagagagaaacagagacagcccccaagagggctctgcagagggtcctgcgccgtgtgctgacaaggtaaagagaatgatgccgctgtgtggttgaggggaggaggcaggtgagactgagtctgtgagaccccggtgggccaaaccaggatcaatgaagaaaactaaagggaagaaaccacagctgaaacgaagggagaaacggagaaacttcgcagtacgcctccctccggaagtagtgggttcccatggccggaagtgttctcagtgaagtccacactgtacttaccgagagcttacttcatgcagggaccattcctggacattctaaatttttcacatggccttaggaggtgggtgttattattatcatccctttttacagtgaggaggctgaggtttagagaggctaaacctctcgcccagtactatggagcacttgctgggatttctgttcaagcagggtc

SEQ ID NO: 147129 - DNA, 308 bp, Homo sapiens
ccagtcttccaacaatgttttgccaatgtataccgcatcaacttactgtaggaaagtgttccaattgcccagaagtctcaccaacacctggtatcattcatttatctgctgagtatatagtggtatctcattgtgattttaattcgcacttccctaattactcatgggtgttaagaaacctttgctttgcttatttgctatttggatatcctctttgtgaaacagtctgttcgagtcttttacacatattaaaaatggaactgtccttcttcaattttaggagtttttaatacatcatagatatgagt

SEQ ID NO: 147130 - DNA, 341 bp, Homo sapiens
cacctattcatccatttattcaacaaagacttattaagaacctcctctgtgtcagaagtatgtacaggttacgacaataaacacaagggtcctggtctctggctccacagatcttgattgtaatggagagacaggtaagcaaagagacacctatactgtagcgtaatatgtaaaatgatagaggaattatggggtcccataaaagtaggcaaggggccattataatcgaatgtgagggaagtgcctgctttcaggtggaagtagtatctaagctgaggcttaaaggaggaacccgctagacagcatttgttgctgtttttgggtcaggggcacagtggaaa

SEQ ID NO: 147131 - DNA, 735 bp, Homo sapiens
aggccgagtgggtggagccagctcagcagtcaaaagtgaaactcaggcagaggcaccactggccacagaggttaccgaaagaatcgtgtgtcactactgttagcggtgcctaatttatacaggtctgcagcaacttcagttcttgccttctaagaagagagaattcaactgaggtgggtcataaggcagagtcagagactgaggcaagttttaagcaggaatgaaagtttattaaaaagttttaagtaggaatgagaggaagtaaagtacacttggaagagggccaagcaggtgatgtgagagagtcaagtgcccagtttgacctttgacttacagtttggtatgttccagcatcttctgtcccttctcacctgattcttcctttgaagtgggctgtctgcatgcacagtggcctgctagcacatgggagggaccacaggcacagtgagtttactggagtagtatgcatgctcaggtgaggcattcttcccttaccagtagagtgttcctagaggaaggtcatataccagttaaactctgccattttggctcttaacgcacatgcttgagaacactcaccaattactgagatcttatcggaaagctgtgatcagcagtttcagttttccatctattgggagactgactttctctggtgacgggtgggacccataagtatttggagagacagttactactgatataactggtggttggctaatgttgaaaaggggg

SEQ ID NO: 147132 - DNA, 154 bp, Homo sapiens
tgtatgactaccttctataacttatttttaaaactgcagtattttaaagaagtctgtatgtttaagagatgagctactaaatgaatcttatctagttagcattattaattatgacagccctactccaggggtgaaaaggtgtttctggacccca

SEQ ID NO: 147133 - DNA, 343 bp, Homo sapiens
  misc_feature (60)..(60): n is a, c, g, or t
  misc_feature (81)..(81): n is a, c, g, or t
  misc_feature (87)..(87): n is a, c, g, or t
gagatgttttcctgtctctcctgtggccaaggagtctttcatttaaatgtcaggcttctnctcaccagttgcacaggcatncttgancctctcccctctcatacacaacataatttttatttctctttgaactacagtatgttaagtgcttgcccatgataaaatgaaatgtactcacacgtgagcaggtttaggttcagccaacttcatctggtttggatggtgggaaaagttccacactgcggcccctgctggacacttagtgtaatagagtcccatgttaccaaggagcaattcagaatgcagtcagtgccactgtatcttatttcttagaaattatccc

SEQ ID NO: 147134 - DNA, 274 bp, Homo sapiens
gtgagccgagatcgcaccgctgtactccagaagtagacaattcatacattttaagttgtgtgctgttgtgagtagcctgatgaaatctcatgctgtatggggcgtgtccatgctgtatttgctccctgtctgttagtcactagtggtcatctcagttatccatcaactgtcacggtttcacagtgcttatgttcaagtagcccttagtttatgtaacaatattttactactaaaaattattattgttgttgttagtctctcactgtgcctaacg

SEQ ID NO: 147135 - DNA, 714 bp, Homo sapiens
gccttccgtagaagatgtggcttgctcatgcttgacttctgccatggttgtgaggcctccccagccatgtggaactgttttcaggtgctggttccatggctcttcctgagccgaaaataaggaaactccatagaccttgtccactggaactcgttcccatctaccctccactctatccagggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgtgaagatggaggcagagattggagggatgcagccaccggcccaggaatgccagcagccacccagaagctggaaggaaatgagggattctctcctagaacctttagagagaacatggtcctgtgaacagcttgattttggacttgcccatagcttgtatactcttactttggatacaattttatccaaacttggctaaacagtttctcagcctatggaaaatttaaaatggagaagattcactcgattcttacagattcaaagcaagaaaatgatgggaacataggaggagaccaagaagcctataaaa

SEQ ID NO: 147136 - DNA, 390 bp, Homo sapiens
agtagatatctatcaggcatcattggactcattaatagagataaagaaaggtaatctgcagaagacaggcagaagccttgttcaagttccagagtgaagcaggaattgaatctggttagaagtcagtttctagctctactctcaggcctggcccagggctgagtctgagctgtctttcttaacacagacccagtggatcagttttattttatggttctgccaagaaaaaggtcatgacataaaatttaaatagtgcaaaagaaatatttgaagagccctttgcagattacaaagtacttcctctttcatgatcccactggatccaatggtatagttaagatgagccacccccacagatgacccactggagggtcatcaatgtgaatgaaa

SEQ ID NO: 147137 - DNA, 462 bp, Homo sapiens
tcagtgccctttaccaccacacatactgcctcactcgtaactgattatatttttgtaacacaaactcgttctttagaaataaccagtacctagcccagcagacgcctgttcaatggatagcagaggttacagaatattaaatgtaaaaagatacatgtcgaatgatggaataccttagagaccaaggggaaagacttgtagttatagacattgggggacccctaataaacatcacagtgtaccacacgcatttacaagccctgcatgacatagaacttctagtcagatgtctagaacctcatcttaaatgagacagaatcaaggatgaacagacatttgagtcaagacttgaacagggtgatggggagtgcaaaaagtaaaagaaaaaaattatatacttagagaagagttcattttctgttgctatgaaataacaatcagaagacaagaaagaatgtttta

SEQ ID NO: 147138 - DNA, 460 bp, Homo sapiens
aaaatgagttaggatttttggaaatagatttctcactatatttttttcagataaagttcctagttcatgtatttgaaatttgaagaactttaatttaggatattcctgtgtataggactctgtctctcaaatctatatctataatggctttctaataaaaatttagttgctaactatacaataatgttttccattttatttctaaacaacaatttctaagaacaaaaaatatgcttgagaattcttacaacaatggagtttttcatttgataaaattttatttataccccttttactgaagcacacagactttttatgtttctaaagacacataagtaacactatttgttgagcaaagaatattgtatggttttgttctgatgttttccatgtgctaatatgttagctgctaaaatccggtttttttaaccagtaaaacttgattaacctggtatgtaaa

SEQ ID NO: 147139 - DNA, 425 bp, Homo sapiens
tcgctgtccacttcatacaatatgagtactgaaaaatatcctttgtgcgtggcaattcagaggtaaccttaatgagcagtttcagtggagtgttgagggtataatctagaagggttcaaaggaggatttctttaaagataggatattgttaggtttataaaagacaaacttgttttccctaatccttttatgccttactactaggactttttcctttaatccaagcatttccaaaccatggtgcttcattgtttagaaatcacatgtgctttaataattcaggttggtttttcttttcttaaccaaaaatagcaatgcaaactatggcgtatgtattatacactttattagggatttcaaattatgtaaatctctaaattaacacacaaaaaggatttatatcagattctatttatgaagtcaga

SEQ ID NO: 147140 - DNA, 497 bp, Homo sapiens
atatgccaccctgtcttcaagaattgggacttatctcccaatagctgggaggactggcttttggtaaatagccctcaactgtctgccctcttatggaactgtctactgtagaaagcatcttgcccaagggcacacccccttcctagggtcaacagaacctagtgacagatcatcactaatgtataatgacccagcccctcatctccactaggaaagactctgaaaggccactctatcttcagagcacccaaaggagacagctgaaatatttgttgaggctgtaccatagcccagcttagccctctgcccaaccttgcttactctctttcctcttccatgagtactggtcccaaagtactccctaaaaaactttctgaacactaaactttctaagtgtaaatctctagctaagtctgcttcccagagaatgtgaatattggaaatttccaagtaccggacattgactgacttgcagacaacaatttggcaacatatgt

SEQ ID NO: 147141 - DNA, 446 bp, Homo sapiens
aggctggtctcgaactcctcacctcaagtgatcctcccgccttggcatcccaaagtgctgggattactttctgtataaacctcgtttctttataaatcactcagcttcaggtattcctgtatagcaatgcaaaatggactaacacagtcctttctagtaggatatgctaaaaaggggatttagaaaaaacatagagtttttacttttaaacatggagtttttacttttacaactttttaaaaagttgtaaaacatacctaaggaaggaaacgtagtttgtaagaacttgctggctggtggtctggcttagtctctgaggcctggaatttaccatcagtaaagtcatgtcatgcctctcttcatatttgtgaagtgggcacaaaaggctgtatgtcccttaaatgattcacaggaattttacatgaaattattagtctacctcctaa

SEQ ID NO: 147142 - DNA, 188 bp, Homo sapiens
tagctcactgtgatggtaaattttaaatatcaacttgactgggttgagggatgccttgatggctggtaaagcattatttctgggtgtgtttgtatggtgtttctggaggagactgtcatgtgagtcagcagactgagagaggaagatccaccctcagtgtggatgagtgccatctaatcagctgggag

SEQ ID NO: 147143 - DNA, 402 bp, Homo sapiens
taagcatgccttttctttctctttgattgtggtcagtgcatggaatgtgccagggccgctgcggagcaagcacgtggccccgaataacccctccctgccaacggaattctgcagagaacatgtaagggctgtgctgtttcactcctgctttgggctctcagggtttgtttccgcgatcatccaaacctcatcctccttctcttgccccagataatttattggaagtctggagagggacttgagttctctcaactctccaaccagactgttgctgtgggcgaggccatgtcgggtgagctccaaggagagcagttggaatgacagagaggaacggtttcagcctgagaaatgtgaaatataaattcaaaccaaacttggcacctgtttggagagcttcagctg

SEQ ID NO: 147144 - DNA, 417 bp, Homo sapiens
tggattcaaagaaattgtaaatcttttaccaagtggttgagtttgccatcaccaattgtgagacagtctgacactctgacctcctgacaggaggcggtcgagggtgcacctcctcatcaatgtggtggtgttgccacaattgtcagacctgggtctaatcattaggatgagtccgacacatgcagaacactctccacacagccgacccggactcttcaataaatcggggcaactgttctaggttggtcaaaagacataacagccaaattcagtgtgtgaactctaattgcatccaaatagaaacaggaaaaaaaaacaccaataaaggattttttttgacaaatttgggttaatctgagtatggacctcatgctggataaaggtgtggaattagagttgaatttcttagggtggtaa

SEQ ID NO: 147145 - DNA, 463 bp, Homo sapiens
tgtggggaaaaaaaatcagttaagaggcaagctacgaatgaaataacccacaatatgtgctatcctgcaagcaaagaaatctcaaatatcaaattcattaaatggttttagatttttggccaggtgcagtagcttacgcctgtaatctgagcactttgggaggccaaggcagatggatcgcttgaatccaggagttcgagaccagcctgggcaacacagcgaaaccccatctctgtttaaaagaatttacattctcttcacaagagaacggaaatcatactttaatataacattaaggtaaaaaaaagaaacgatttaatttcttaaaggcagcaaaaatcttaaaaagcacagttaatctaataaataatcaagccacttttgcccagagctttttaaaaaaaagttctttagaataagcttcttctccaaattccccattattcaagcttacagtattctg

SEQ ID NO: 147146 - DNA, 485 bp, Homo sapiens
tggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaa

SEQ ID NO: 147147 - DNA, 342 bp, Homo sapiens
ccttgtctgtgtcgcttctgagttatggcatgattggttttatgtggtctataggaaggttggcatatccagacatgagcgtactgaacctgtgggggatagtggcgggaatgatagccctgtctctaggacaggatgacggttcttcaagtccaaagagattccggaggcttgagcctagaaaaactgttcttggctctttggtatttcgagactgaacaccagtacctctaacccccaagtgtgtgtttttttcacaggatgagtgtaaagatattgtcttcactattttccgtaactggactccacctagtttttcagcccaaccctgccacccccccg

SEQ ID NO: 147148 - DNA, 316 bp, Homo sapiens
ctaggactcacggtgcctcgacaactgtaagaaatttactgtagctttaataaggagcaaaggataaagtttagtgacctaaggataagaggtagaacaaactcagattttgaagaaacatttatatccaacagataatttggattttaacctgtaggagcttacaaaaattctcaagcaaaagagcaatgtatttatatttattttgtgaaaaattggctgggcacagtggctcaggctgtaatcccagcattttgggaggcgggggctggtggattgcttgagctcaggagttcgagaccagcctaggcgacat

SEQ ID NO: 147149 - DNA, 724 bp, Homo sapiens
ttgagtctgggaggccgaggttatggtgagctgtgattgtgccactgcattccagcctgggtgacaaagcaagacctgtctcaaaaataaaaaacaacaacacacacacacagtgaaacgaatggcaccaaggaagaaatccaagtgcaagaaaagagggaatcatacaataagaacaatagggtggaaagccagggtgaaatacacatctctgatgaaggaagggctgtgtatctgggtccttacttttccccttttacttgggtgcttctgtcattattatttgtaagtcacttctctcatgaagtgctttgagcttttggggcaagtaagagtagagaaactagaaatagttggcaattcattatcaaccttgttacgtgggattagaactattgtctaagatgggattgtgagtttttgaattgtaggtgagattttaatgcgtgtgtccatgcccccattattgaagtgggtttggagttcatgatattagaagcaattccttagttagcagttcttgtagatgagtgatgagccacaagatttctgttgagatcaacattcagttgtatgaaattcttgaggtgcagaggggagtagaataggaatttcctaatttggttggattgactccattttggaactagattttctgcacgcatgtgctaagaagagagatggtggtcacagtgaatggatcactgcgcaaagatctttggtg

SEQ ID NO: 147150 - DNA, 374 bp, Homo sapiens
aaggaaggaggtgatgcaggcccttcaggaggaggcccagctcctctgggttgcaggattgaatgagccagtatctacaaggccctggctctactcccttgtaatgtttccaggctttctctgtaatgccactgtagtgagacacatgtcattcagaactccatgtagtcccctagatttatgcacagtgcagcctgtggctagaactgaatcttaaaccaataatctgccttccccaggactagcaccaaaatatttttatgtgtcaacgagtctagaactggagagctccagaaaaatatggtgccgtgtggggtagggggtaatactgatttcacacgtcatactttccagaacagttagcaggccctgta

SEQ ID NO: 147151 - DNA, 164 bp, Homo sapiens
gcagatgcagaagtgtaagaaaggaataagctactggtatccaggattatctagctcatctttccagtggagctgagcctctgtcccttaaagcagtgctgaacgaatctttgttggagtctgagtatatttttctctgctattgttgttaagtggttggtggt

SEQ ID NO: 147152 - DNA, 243 bp, Homo sapiens
ggtttatcacttgagattcaaaagtcgtcagtcgctctttaagtgagagtaaaaaagagtcagaaaaaaatgactgcgtgggttaattccattaccagagtcatgggaaaagccaagttcagtggtgttcagatttttctgacgacaccccccacggggatgcacgttacattgagacccagacacagctgcaagttccaagaaataacgttttattctcatcatgccacagtacactctgga

SEQ ID NO: 147153 - DNA, 125 bp, Homo sapiens
cttacaggattaaccaccacaaatccactgctgcttccaacatttgtaagtctgatcttgacttcagaaaacctgataccaatatatctattggtatatatccactagacagctatgccagatgt

SEQ ID NO: 147154 - DNA, 169 bp, Homo sapiens
tagctcaaggtaaacaaatttcagaaaatatttcaattatctaggaagtcatctgatgcaagaatagcaccgaatctgacagcttcattactatgcttgtttaactgtgactcacagactgttttacagaagagtaaatttcctggtttctaatttcttgaggaacttg

SEQ ID NO: 147155 - DNA, 564 bp, Homo sapiens
ggtacctgaagcgagagatcattgaactaggaggtcggggctgcaggagctataatcatgctactgtattccagcctggctgtggcatagcaaaacccccatctcttggaagaaataatacattactattgttagtaaataagaaatatgaagtaattagaaactaaagaaagacttttagataaaaagaatgaaccaaaagaaaaagaaataattcctagaacaagacaataataaatattaaattactatacagaaaacattggaaatctctaaggggcaaataatctttttgtagaaactccagaagacaaagggaaacaccggtgtttccctttgtctttcagaaatttcaaagcacctaatcttagtctgtgttccaggattcattctaagtcttttgttaaactgtaagctctttaactaaaatttgagtttgatgttttaaaaccctattttctttagaagatatgtacttgtacatttttcttctattctaaacccactcactttttacatttttatatattaaaagacacagttaattgaggtaccttacagatc

SEQ ID NO: 147156 - DNA, 519 bp, Homo sapiens
ggaggaagctcagcagagcgggaacatttcagagatgaggctctccaagcatatggcagacaaaagcatggttacgactggctacagggaaaaccactcaggcccccttccctctttgagtgttaggataactgccagagaacaagctgacagtctaaagaataaggaatgcgagggggctgaatggagaaagagaagcagagctgaggggcgggctgcttgattcagggagactgccccaaacatttaccgctcagcacaagtcatgattttagaacagaaacaacattttctctctagtaaagatgttagagagagctaccagaactccgtgaaataaatttgtaaaagagaaaatacagttaaaagttctgtggacttggcctgatttcaaggtaaacaactctattcatagtcacaaagcatgaggtgaaagggaggatgtattgatgggtataaagaagggacggttacaagaggggtcagtgaatgaattcctctgtgttggcagtgactcag

SEQ ID NO: 147157 - DNA, 397 bp, Homo sapiens
tagaaatgtgattggacaaaaagagtatgatctcatactaatagactgagtgagaaacccagtaaggcctgtttgtctagattcttcttggcctctctgtgcagcattctttccttcagagtatggggcaggaccctttctggaatgaggatcttttgattcacaatcagattagagacctgccttgggcaggtaaaaggaagacaggaggttagagagaaagattctgtttcctgaggcttgctcctgtgacctgctcctgagacctaaagcactcctgtgacctgctcctgagacctaaagcaccccaacattataacaaaagactacaccaagggctgtggtagttaataagtcaggaaccatggacgaaaacctacacacacacacacacaca

SEQ ID NO: 147158 - DNA, 288 bp, Homo sapiens
tcaaccgtggctgacaactaggacgtgggaaagtagagaagaagctgataaagatgaaaagctcatctatagaaagatattgaaaatttatttcttctagattacaaaatgacattagatattataccctatgagaaaaaatacgcttaatcaacccattttcctcttatggccataattagtacatagtcgcatcaataaagattgacaatatagccttctcatattgccacttctagatccacttgtaggcttaattttggatcatatgccggatttgaattgtat

SEQ ID NO: 147159 - DNA, 123 bp, Homo sapiens
gacttctgacctcaggtgatccacccgcctcggcctcccaaagtgctgggattacaggcgtgagccactgcgcccagccttacatcctttttttcatcctgtctttgaaattgagtatgtatt

SEQ ID NO: 147160 - DNA, 137 bp, Homo sapiens
ttggttgcaggtctgatttgcggaggtagcgcagtccacctaccttgggcaaggggatggctgcactgtcctctgtgtgtcctgctctgttccagaggttgtggtctattgctgaggcccctggagccatagcagat

SEQ ID NO: 147161 - DNA, 256 bp, Homo sapiens
ataaactgcctaaaactaaataatagaaatctatatcacattcccctttagagttcatcatatcagaactttccaattttctatgtaattaaatagttctaccttgtctctcaagtctacaaatcaaataaatgcagcaggaaacctacctgtaaataataacagcaataataataaaggagttaacatttattgtcttttgtattgattgatttccatacactgatctgagttatcgctattaatttaatgagga

SEQ ID NO: 147162 - DNA, 482 bp, Homo sapiens
caatatgtctgagaaatgtcttacaaatagactcagtgtcacaaatagatgatttacaaatagactcagacccactgtagcgttaaggatggaacctggattatgcattcagtgcgggcatcaattttgacactcagagaccaggtgaaggtgtccaagagacgaaagctcagctctctcatcactcaggtgaaggagaaaggggaccagtggttccagcacgtgttccgcaggccggcagcatcagcatcacctggaactttttaggaacggagatcggaagtcccaccttgacctgccgagatagctctggggtgggcccagcaacccaggtctaacaaattttccagtgactctcctgctggttcaaacttcagaaacagtgaaagagacaatctcttagggtctttgcagcgtcgactcttaggaattttacaggagagcaatacaaagagaaaaggcaacaagtttaagaaacaaac

SEQ ID NO: 147163 - DNA, 523 bp, Homo sapiens
gcgtttaatataaaggtctaaagttttatatatgtgcacataaatgataaggctgactggactatttctctttgatcaactaaattcaacaaacacctgttagccattagtgttgtattaacaaaatgtattaatcctacctgtcagacaatctagtccgtctgacatctctttcctgtatctctaaatgcctagtcattttgcaattcatgatggcccatattattacttttcttttgaatctgtagatatggagtcttgctcgaccttgcttggttgcccaggctggagtatagtggcatgatctcggctcactgcaacctcagcctcccaagtagctgggattacaggtgcccgccaccatgcccagcaaatttttgtatttttagtagagacgggatttcaccatgttggccaggctcatctcgaactcctgatctcaggtgatccaaccaccttggcctcccaaagtgttgggattacaggcgtgacccacagtgccaggccattactttttctgtag

SEQ ID NO: 147164 - DNA, 292 bp, Homo sapiens
gtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttga

SEQ ID NO: 147165 - DNA, 682 bp, Homo sapiens
gttcccaaatatagctttctccccattggaacacaccagaataatgttttggaatctgtaccatcgggatgatttcaaagctgaaatgtgcagtggactttggtgctcatatctgaagttctcaggctggtcattttcacccaagaagctggatgctctttgtggactttatgggaaagaaataaaattgcttatttgaatatgtgatttgccaagtaagcatttttatgcctcagcaactggaggggacagagaggaagaagaagggctgaaattcaatgcacagtgctctttatgatgacactgtgatgggaatacccttgaaaactttttaattgttagaagcttgcttcatatggtacttctccacccttcttacatttatttatgcctagcactgttactttccagaaatgaattaatacagctatcatcactgagtctcaattacttgatagatgacaggaacatcctctgatctctatgggatgagaatgttaactttattacccttaattcctgctgttttgcaaccagagagtaagcaaaggctaaagctgagggtgagatgtagaaaccttgcctactatgtgtgtggaaaagtttagtggcataaacttgcagaatttacttatttgtatgaatgagaaatatgtgatcagtaatttggctcagaatggat

SEQ ID NO: 147166 - DNA, 368 bp, Homo sapiens
cggagccattatttgaacccggatatctgtgtctcccaaacccatgatttttctttttagcttgtggtgcactaaaaatgtaagacacagttcttgcccacaaaaaattttgggtccccctggaggatgagaaaactgtgcaaatactgtaattcagatcaaaatgtaaatacttctttgagatttacaaggttgaaaggcaggttaatgtctaaatgaagatcaaggaaagtttcctttctgtgtgggtcttttagaaagctgaaacttcaaggcagcagtatcttctctgaataattataacctcatggaagttcttttctaggtgaagaattttgtaattaaaggaggcacattcaggcgaatgt

SEQ ID NO: 147167 - DNA, 374 bp, Homo sapiens
gtcactcacacacatgccacatcacacagcatgcacacagtgcatacacagcacacacatgcacacagtacacattattcccttagttagggcaggaaacaaactttaaatacaaaactatagataagttgacagtaaaaaaaaaaaagatatagcttacaaatgccaaccaaaagaaagctagtgtagctgtactaatttcaacaatgtagatataaaggaatattattagagacaagtctgtggctgggagagtctgtgtggccagcagcctctgatctgtgcagggtataaacgtgtcagggctgagtgctcggggatttctctagaggctgacaaaaaccagttgttaggtctgtacgggctagtcgggg

SEQ ID NO: 147168 - DNA, 333 bp, Homo sapiens
cggctagctttccaagtattaaaggtcagtggtaataatgtaacaatctcataaagcactatcacttcaaagaagcaaactatgttccttttcttcccactccagacatgaacgacagatatccagttaggcctcatcttcaaaggaggtctgagttctcttttttcccagtaactaagaatagattattctacaaaactggaggttcctaataatttagtaatttaacatttttcagatcaaatagttgaatattatgttttgataaaaatacttccacatagactaaatacactgtttggttataatgaggtttcttttttgtgtgtgtga

SEQ ID NO: 147169 - DNA, 443 bp, Homo sapiens
taaacagacataccagtgtcattaaaaaactgtgataaggagattcccagctcgctagtggtctctctttaaaatcagatttattgaagtctaatttacatacatttcagcctttcctgtgtacagttctgtgagttctggcaaacaaataaagccatataaccaccaccatacggaagagatagaatattccatcactcccaaaattcctttgtgtcctattgtactcaatcctcttccccgactcccagcccctgacaaccacacatccattttttgtcctgataattttgccttctccaagctgtcatatacatggaatcatgcagtctgtagagcatttagaatctagcttcttccacgtagtagaagggttttgagattcgtctgtgctgtgtgcattagcagttcttcccttcttcctcctgagcagtattccactg

SEQ ID NO: 147170 - DNA, 198 bp, Homo sapiens
atttaaggaaaagtgcatggtaaatctaatatcttaactatcacagtgcttggcacacggtggacaggaagcattttgaatggtcaggtaataaaggagtatcttgtattagccaaggatcttgtatgcatcacttacgatgttcatatattgtacagtaagaaagttttactttagcaaataatatatatggttttt

SEQ ID NO: 147171 - DNA, 232 bp, Homo sapiens
ggatataactaaacaaaagttcagtgagaagctcttctagctagtggcaaggaagtccaaatatctcagggctcttgcaggccacttaacttctgggcctcagtttttccatctgaaagagatcacttttgtcacttcctctagggaaggaactatctattcagcatactatgccagacatgggtatttatttgttgagtggataagggaatactacgtggagacagaaaag

SEQ ID NO: 147172 - DNA, 540 bp, Homo sapiens
ctcccccatcacttcaccctggggtctccaggatgcctgcaagaggtttggcctcttccatggtggaagcaaatgattccatcacgagaatatcttgagtgaggacacagatgatgtgtgttcacatggccctgctccccatggcctccctaatgcttaatgccgtccttgcattgggtcagtgagtggaagaggaatcactccacctcctcattagtaggaaaacccaggtgacactggaccaggttacgttctagtttctccaaaggtaattcaatggacctcgtttggaatactctggtggaggtcagatctgaaatggaagcttctcccatgctttgtgatctgagccatgatctgtccgctcacctgtttctcacttttcccactccaccctgtgtctcatgatgacgtttgcttttcctcccgactcaaaatttaccttttggggtcttaccctggttgtaggagctggcttttcctggggattaaggcctcagtcttcctcccattcgcactgccttgcactgccccccatat

SEQ ID NO: 147173 - DNA, 384 bp, Homo sapiens
gagaaatgggagaaagatggagggattgcaacatagggctaatggaagttttagaaaaacagcagaaaatcacagagaagcaacatatgatggacaatcaatgagaattttcaaaaactagtctgggcatgttgactcatgcctatagccccagcactttgggaggccgaagcaagtggatcaactgaggtcaggagttccagaccagcctggccaatatggtgaaacctcgtctctactaaaaatacaaaaactagcctggcgtggtggcatgcacctgtagtcccacctacgcaggaggctaaggcaggagaatcccttgaacccgggaggcagaggttgcagtgagccaatatcgtgccactgcactccagcctgggtgac

SEQ ID NO: 147174 - DNA, 623 bp, Homo sapiens
ctcactctttctaaaattcacgcattcattcagtaaatactttttcaatacgtcttatattcagggaactatttagtatgcagaatgaaaccttggttataaaaaaaaggagagagagagagtagtaacatcttcagggctttctgtgtgatcgatatgatgcttagggtctgtatacatcatcataagtatcttcacgccagctcagtgagatgtgatcacccccagattccagtggagctatccaagcctgagagtggttcagtcagttggccaagagcagaggtagccgtgggagggctggggtttggttccagctcagtccaatgccaatgcctgtgctcttaattatgttgcctctgctatactcataactctgttaacagccataaatccagctctgtctgttagacccagtaaatttcaaagtagaaaatcatttttctaataaaactacgcatagaaaaaaagatattaatgctcatacattctaccctcattatgacatcaacctctgagccaaactattttgcacattataaagagctgtttttatgatgaatgggaattatattggcactttaattgagttagaaaccaaggtacatgaatgttagtgcaca

SEQ ID NO: 147175 - DNA, 423 bp, Homo sapiens
ttgatacgataacatttttgtaattactaaggtgacaaagctcccctgtaaatcatccactgacctttccacaatgcatatgtattatcaaaaatcacactgtatacctcaaatacatgtaacttttacttgttaatcatacctgaatacattagctggggagaaaataaaccaacttcaaatgttaggctttatttccatttcattaagttaccataggtctttttcttttttttcttctttgagacagagtcttgctctgtcacccagtagctgggattatagacgtgcactaccacacctggctaatgtttgtattttacgtagagatggggttttaccatgtggaccaggctggtcttgaactcctggcctcatatgatccgaaggcctctgcctcccaaagtgctgggattataggca

SEQ ID NO: 147176 - DNA, 421 bp, Homo sapiens
gggccttagctactgtgaagaacagcacattattactgcaagtaaggcaaatgtttcacttaaaattctctgtcctgtagtcagatcatatgtgctagttttacactggaaaatagtaatcaagaattgagaattaaatgccagagatctttcaagcaagggggagcccagtctatcctcacacactccccagttattgttctgtactgtctagacctattacctctccagcgcttcaactccgtctctgatattcctgcagaggagatctcaaagaggagctttttaatattgtaactagccatttcttctgttatcacttcttttcttctctcttggcaccagttcctattagaatgcccttctctttgaaaatgaaagatggggctgggtgcggtggctcacgcctgtaataccagca

SEQ ID NO: 147177 - DNA, 218 bp, Homo sapiens
cgagctcggtaccctgcctgtaggagacgtgagcgaggatgctggaaaggaggaagcagccggaatgtgtagggcctttgtggccatgccaaggcgcctcagggaatatctgagcgtcttaaataggtcagagggcaattctgaaaacaaactccttctacctgctgtgtaggcaatgagttgtcattgttagatagaggataaaatgaacccaatta

SEQ ID NO: 147178 - DNA, 616 bp, Homo sapiens
acagagcaaccacttggcagatatttggggagttgggagtgaagttctctttcttgcctttccctgcttaggtggtaaatttcaagtgggaaatttacactgataatagactaatgggaaatggcacttccagatgttttctcccagtgtgaagggtgacttatacttgtgagagtatttgttggtaatgggaataagtcccaaaggcaagccacatagcagaagatacgttctcattgaggcagctacacattacgacggggacactgaattgatcatcagttcatttacaagcacatttctaagtgaggtgctctctgctagcagaaatcagatttgaaaggcagtaagatctcactccactctttcagaattcatccaatgaaagcagaaatcacctgttgtcatatgtaaaatttgtgtgtatgtgtacattctgccatcttaaccctgaaatgattatagatccagctaatcattcccaggtaatgctgattagaatacttttttttttgtataggaatgtaataagaacaactgttttagacacctcttctggaaatttagcatggaagctctcaactttatttttaaggcctggaagatgctgtgtctc

SEQ ID NO: 147179 - DNA, 352 bp, Homo sapiens
ttagtcgatctgattattcctcggttcttcacagcagtaacacagcatgtattttctctctcaggcccaggaatagcgccaccatctaccatacacaggtccaaggcttcgatacatgtggaatttaaacagtacagaatattctacttcctctccaggcaatcatcatacttacaagtctgtttctgcctttttcccaaaacttaagcccagagcatcttcccaaattctacgtttgaaagaaccagcttccccctgctcacagatcgcttcaacatccatctgatactactactactcttccttaagagacatttcccttggccttgggaggaaagggtctttcacttaa

SEQ ID NO: 147180 - DNA, 399 bp, Homo sapiens
agtccaagcaaaaactcccagacggaaatccacagtgagcacttactttacaaaaggattccttgcttgactaagggattccttcaagcagcaaaatcccacctggagtgcactgtctgttttatttcattattcacttctctgagcaggaggaggagggggtcaagggagtaacttccaggggaaagtttgtgagaagagatgaggggatggaggggtggggactggactctgttcataaaacatctcctaggagaggcccacaagaaaatggagacgtggtgactttagaagagaaaggtgagcaggctaagcgcctgaggcccatccaatagggaggacatgggaacctgaacagtggagaagaatgggcggcaacaggtgtcccactaggtccct

SEQ ID NO: 147181 - DNA, 515 bp, Homo sapiens
ttccttgttaccattacatatgtatatatgcaagacaactggggcatgtctggctgacagctggagggaaggacataaggtctgtgtgctccagaggagacgctgcctctcccgagtgcgactcccctgagttctgcgctgagtctctcctgcttctcagagaagtcatgtggacatgaactgcaagagtctctgcaaagggacctccagttttgtttggtgggagataaccagctcactggggcttctccacccacacccacccatgggagtctggaaatacagccctgtggaattcttcgttgcccacatcccttacactcctgtccctaggtcagtcagccctgggctctgaagtcctgaggccctgaggccccacatctgctcaggcagagcactagcatcccggggatcaactgctcctccaaagagccactcctgcctccctgaggcagcaaagccgctgagcttctctgggcaaaagagcagaatggcacccggtgaaacctgtgcac

SEQ ID NO: 147182 - DNA, 921 bp, Homo sapiens
tcttagtgtggctaaacatgttttcctcgtcattcttactataaagggaaatgtcttggtttttgttttgttatttgtttttctctctctcttttgaatgctcactctctccccctctctcccttcattaaatatttcccaggctttaggcccgaccatacggatagaactgatatccttagtccaacagaacaacactaaactaagccgatgctattgctctaatttaccagaagcttctttaagaaataaatgtaaagcagggactgaagtataatcctaccatctcatcagcaattggcactgcaatacattatcctggaaacaactggtaaacacagtaagcccatttctgggcttttagaaaaacattgctctcttttctttccccacccagtgtattcccaaggacttaatgctgcactctgacctagccctcaatgatggttaaaactgattctgaaccaaaggtaaacagggttcctccccatgccttggagagctccagtctgcagaaagctaatgaagcccttgaagcagtatcttgtcttccatccacactttattgaaatgcttttgagtcttattgtgttgtaattacatactatagaaaactccaccaacctctatttcaaggtttgggcccatgactctcgctaaaacatttcagttccattttccagaacataccatttctaaatgcatctgtgagggccctccacaagtattttcagtccacatttcagaaaacttgaaagtgacgcaggttcctgacttagttgatggtgggtaaagggaatgccattatgagtggtggaggttgttttcttttttcttgccatattctcagcataatatttgaaacttacaaaagaagtttgataatataactgtatattttatgcctgcactagtggaaaa

SEQ ID NO: 147183 - DNA, 336 bp, Homo sapiens
cgcggggtccaatccaaggtgtttgtaaagaacttcggtgagcagagactcacatggaagcgagcctctctctcccttaggacgggcagagctcaagcccagctcctgactcagtccaccaagcagtctccagtgtgatgtcaattgaagaggacattcttttttcttctcctgaaagatattgtttggtgtggtttactcagaagagatctccactgcctccttcaaatgttctgcttttcaggaatggagggaaaatccttacagcctggaacacttttgaggtttgtcacgaatgtccttgaaagtaatattactatcccctgcttgccacca

SEQ ID NO: 147184 - DNA, 279 bp, Homo sapiens
tttaccaatcaaaaggcagcttccagagcttttaagttctatgacttaaaaagaaatctaggttagatctttccttctagtagatttagtctcaaaggaataaacatctggtgatttgtattataatgagcattactgttagaacattcttctaataaatctattttttagaaaagatgtactgcattgtcattgccatttttattgctgaggtcaatattttccagtgaacataaaatctagttttctaataaactcatctcagatggataaaattgg

SEQ ID NO: 147185 - DNA, 268 bp, Homo sapiens
agtagagacggggtttcactgtgttagccaggatggtctcaatctcctgacctcatgatccacccacctcagcctcccaaagtgctgggattacaggtgtgagccactgtgcccggccctgaattctacttcaaaaaggctcagatctatcctctctgctccacttccaatgcattagttcaggcccttattcattttccacttggacttcttacctggaatttccatccttacattcagctctccccttgtttttgcagtggcctga

SEQ ID NO: 147186 - DNA, 493 bp, Homo sapiens
  misc_feature (470)..(470): n is a, c, g, or t
tccaccagtatgtaggcatacaaacagatatttgcaagaaggaagaaatggacataagaaaaatttccatcaataaaggattgggctgggcatagtggctcatgcctgtaatcccaacactttgggaggccagggcaggaggatcacttaagcctaggagttcaagaccagcatgggcaatataatgaggccctgcctctacaaaaacatttaaaaattaggcctcagtttccatatatgtgaagtgaggaatggggactgtgttttctcttggcctccttccagctgtgatggtctgtgaatctcctggaagccagctctgggtccagtcctgtcttggggaaattagaccagaaaagcacagaacatacacaagaacccaacagcatcatctgatacaagcccatactcccactggcacacagtatctttgcttacctaattacatgcacgcacacgtacagagcctncactagtggaggaaaccgagctg

SEQ ID NO: 147187 - DNA, 444 bp, Homo sapiens
gtgaatatgctgtctcacaaaaacatgagcaaacaaaacatgaatgaagtgaaatggctcaccttccctattatgaactagaagaaaggatgaaggcaaggttggcaggaccccagccttactctgtagtgacaacccagaggtacttttcccggaatgcagggtccagaactgggaacttgtttgatattttgaaaacatacgaagaccaccaatataggtggagagagtaaagtgagaagaggaagatgcgatcaaagagaaaacaagggccagatcatgtgggaccttgtagtgactttgacttttactctgagattggaagccactggaatgccttgagccaaggatcactctggcagccatgtgggaattaaataatagaagcacaagggcagaaacaggaacccaattaagagatgttaactatttaggtgagagaga

SEQ ID NO: 147188 - DNA, 174 bp, Homo sapiens
aatgcgaataataataattttgttagttacttgatgtccattcaacaatggtataggctattgaaagttgaagatgcacatgtcttcaatggccaagcaggtatacaaatgagtgaagcgggctggttttaagaaaataaaggatagtttaggtcccgctaaaaggcattctaa

SEQ ID NO: 147189 - DNA, 352 bp, Homo sapiens
gctcatttttagttgtgcccatcccatacaacactgctttttttctaaaaataaatacttcttgactaacctgcagcagaagtacactggagcttgcttttcctccagtgctgtcaccctcgtattcattcattcctacttcttggctatgtgtccttccttcaactctctggtctctgtgcactgtgtatgctgctttcctataatgctacaccaaccccttttccccagcagccccatcaccatgattgtccactagttctttggcagttggtccaaatatttcatttttctgggaagcctttcttagtttccctgttactccccgctgtctgtactacttaagtctgta

SEQ ID NO: 147190 - DNA, 284 bp, Homo sapiens
tcagatagtgtacaggttttaggactggtacgattctctattcgtaaaccttttgtaatacttgtggatatggtgtgtgtcctagatttaaccatagaacttaattctggttgtgaattcattagactctgaaatctatacttacagctgaagggggtcttcccaactcttcatttgatcttcctaatctcattgggatatagcattcaatctatgtaacaatttgagaactgataaccatattgagcattatgatctacaaacaatttatatgtctccactaa

SEQ ID NO: 147191 - DNA, 432 bp, Homo sapiens
aattagcttgacacaggctgacaacgcttcatcctgtagatattccacttgtgctaattcacttcctctcccaaacgattgaaacggatgcctgaggctgtatgtaatggaatgtacgatggagcctggggcacacccttatcgattctaaatgggcgaactgtaaatatattctgtttagtccatctatagtgacttagtcagaaaaagggcaaaagcggcctggccgtgagctcactggtgccactgcctccatgaatggcaaaggaacggagcaagtgagaaagaggcctcctccatgtgctgtggtgcagaaggaaaagaaaccgtgatcatctgacgccagaagagctcccaggaatgaaatctgtgaaagattctggcatcactcccagcagttcacacactgactgtagagactttgaatggcaa

SEQ ID NO: 147192 - DNA, 712 bp, Homo sapiens
tgagcaccagcagggcctcaccctgacagggaggcctgtctcatcctggcttgagtcagaaagtgccccagtagaggccatgtatgagtaacataatattcaccatgttaaccgagttgaagtgttcagttcagtagtgttggacacactgtacttggtggtgaaagatggaatgctccccgagatcaggacggcggtgagggcgcactttggtgctgtgaattttctgtggaacttttctcatgtgttgcaaaaatatatataaaaaatccaaaggagattaatcttcagaaaaatcctgctaaataggggtaatctcttttaatattttgctatccttccactctacataattcagataatgtttatttatttatttatttatttatttcttagacaaagtcccgctctgtcgccaggctggaatgcagtggcgccatcttggctcactgcaacctccgcctcccaggttcaagcaattctcctgtctccgcctcccaagtagctggaattagaggcacgcgccaccacgcccggctaatttttgtatttttagtgcagacggggtttcacaatatttgccaggctggtcttgaactcctgacctccggtgatccacccgcctcaggctcccaaagtactgggattacaagtgtgagccaccatgcccggccgataatgtatattttttagctattttttttattttttg

SEQ ID NO: 147193 - DNA, 199 bp, Homo sapiens
atcagttaatagactcatcctgggttctaggtctcccagagaagcagttaagggaaatggggagaaaatctcaaggaataaggagggatacagctaaaagggtggaaggttggcatcaaaaaagagaatattagacctttagattaaaaacaaaaataaagggagcaatctacctgtagaaagtaattggtatacttgt

SEQ ID NO: 147194 - DNA, 435 bp, Homo sapiens
caaaatgtttcaaattcttcaatttcaataaagatgtaaaggacctaagggacttgtaagctaataactcatttacgatacttttttgatgatagataaccgatgttatttttggcatgcaactcaggaggaactccaagaattgagtgacatcaatttaacacaacttattcaagtcccatgtacatatttatatgaagaaggttttcagcactaaaatccataaaagtgaaaaaaggaaataaaattgatgttgtatgctctcttaacctaacaatgaataataaaaatccatggatacatgaactaattaacaatgcatcttattaagaagtgaattttcaatagtatttttatgtgtgagaaagtatcaaaatgtataacatgcatgacaaattatatacaaacagcaattgtgataataactcagtctag

SEQ ID NO: 147195 - DNA, 453 bp, Homo sapiens
acttttaccacctgccttcactacctctcccttcatgagcctgttcttcctcttcactgtcctccatcttgcctgcacactgtgacccccgtccctttgctctcagtgcgtattcctacccaggggccccctcccctccagactctccttcctctttccatcttagctcactttccatttcccctgcaaaagcttgctttttctttcctggtttttttctttctttctttcttttttttttttgagacagagtcttgctctgtcacccaggctggagtacagtggcaccacacccagctaatttggtattttttttttggtagagacagagttttcccgtgtggggcgggtctggaactcccgacctcaggtgatagctggcctcggcctcccaaagtgcggggattacgggcgtgagccaccacgcccggccaccgagtttatttcataggg

SEQ ID NO: 147196 - DNA, 261 bp, Homo sapiens
ctctggtgatacaagctttcatcacttggttataggttcctctactgtaaagttactgtttttctctccgtgttctattctatagaagcaaataactaagcctatcccataaaggcaaggtgtgattacagtggggggattccatcccctgtaggagggaatatctacataaatagaatttttctgtgagaaagatttgtctcttctccatttatttatccagtcacttattgtatggacttgtacattgatttcatactt

SEQ ID NO: 147197 - DNA, 243 bp, Homo sapiens
cgccgtgctactcccagctactccagaggctgaggtgggatgatcgcttgagtccgggagggccaggctgcagtgagtcgagaccacaccactgcactccagcccgggtgacagaatgagaccctgcctgaaaaaattaaaataaatattaaaaaagattgatgcctccagaaagagcgttttctgcaggtctttagaggacatggagacactcctggacttgggcaaacctagaagggtgtc

SEQ ID NO: 147198 - DNA, 207 bp, Homo sapiens
ctcggcctcccaaagtacagagattataggtgtgagctaccagtaccagcctccaggaatggcttctaaggcttcaggctgtttatagagaggaaagcacctgggagctgatggcactctcaggtttcccaaaatgacagttctgcatatgcatcttaatcacctactttttttccctccacccccaaatgctattcacagtccttg

SEQ ID NO: 147199 - DNA, 576 bp, Homo sapiens
gtgttagtctcaaattgttttcagaggccagtgtccacaagagtactttctaggtgtcatataggattttcatagcttgaaacttcatgttcagtttttaatctatcttgagttacattttttatatgctgagaggtaagagttgtttttttcttctgcatgtgactaaccatatagtccattatttatcagtaccatttatcagatggaaagttatttcccctttatttctgttgactttgtcaaaaataagttggttgtaggagtgtagctttatttcaagtctctctcttctgttccattggtctacatgtttatttttgtccgagaaccatgctatattggttactgccacttgtagtacagtttgaagtcaggtaaagtgaggcttccaggtttattcattttgtttaaagatgccttggctatttgggctcttttattcaatatgaatttaaaaccattgtttttaattctacaaaaaattgcattgatagtttgatagaaagagcatttaatttacaagttgctttaggcatcatggacattttaattatattgattcttcaaatctat

SEQ ID NO: 147200 - DNA, 626 bp, Homo sapiens
gttgctagaggaacccggttcgcgctgtacccctaagtgctattacctctccgtgtatagcatactagaacctacaatagtatacttccatttctcctgatctttattcatttttgtaattttccactttaaataactattcaaatagtattaaaaactctaccttaaagaggaaaaatgttaagttttccaaattcatccaatattgcttttactgcataatcaatgctgtctatgtagctttcctattataaatctgtaccacccaagccatatttaatttgtgataaaacttcctgcacaataaatagaggcatgttgtaactgggctatttctagatatggattcctaagttactaacttctagagaacactcataaatttaactatttaacaaggatcacagagctgcagcaaatcatgtctatggagttttcagttaagctttatgtgtgttcagaaacagaaaaccaaacaccacatgttctcactcataagtgggagttgaacaatgaaaacatatggacacagggaggggaacatcacacactagggcctgtcgggggttggggggcaaggggagggagagcattaggacaaatacctaatgcatgtggggcttaaa

SEQ ID NO: 147201 - DNA, 729 bp, Homo sapiens
cgtgttgattaaccagtatgtgattatagctagagaacttggggaatgatggttggaataatggaaattattattctttaatttctgcactttttggataaaaatttcagtgaaattttggtgcagaaagtacttgctgctaatggggataaataagtatacaaagttataacgtgtgataaaacttggtaagatcaaggtttctccaaaaataagaagttaagggaaaacaagtaagatggcattaaatattacaaataaaagctctgcttcccaaacaatctcagttagtgtttgctaaaaacaaaaaaattcaactcgcctctgtcttttgttcactttttcttctgaatcatctcctgatactttgcttctgtgttattctctgttgaagtatattcttgcactaatttcatattatgttgactatcccttgctacattttttgaaccattttaatgccttttacactgatatcctttttttttttttttttaaattttaagttctaaaacactatttgactttaaactagttaccttttgtttaaggacacattttttggcccttgatattatatcaatatatacaagagggtaaaatataaaatgttttataaaaatctccgtattaattcagctctagagaagtttctgaaattggtgtgcaaacagtgaaagccataatacagatgaaaaattagagataattttatcatttggaaaggcg

SEQ ID NO: 147202 - DNA, 454 bp, Homo sapiens
cgagattgtgccactgcactccagcctgggcgacagagcgagactctgtctcaagaaaaaaaaaaaagaaaataaaaaaaagattttgataaattgataccaacaggaggcattgtagtaaggtggaaagaacattggattgggagttaggagagtcaggttctgatgctggttctgccaccactcatttgttgttggttgattaattttaatttatgttttgagacagcgtctcactcccgtcgcccaggctggagtgcggtagcgtgttcacagctcactgcagattcaacttgggttcaggtgattcttccacttcagcctcccaagtagctgggactacaggagtgcaccaccacgcccagctaattttttgtattttagcagagacaaggtttcaccatgttgcccaggctgatctcgaactcctgagctcaggtgatctgcctgcctt

SEQ ID NO: 147203 - DNA, 445 bp, Homo sapiens
ggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcgtagaggtagaaagcaaacaatctggggctcagcacacctgggggtgctcccactcattcagtgtgtggggcccctgagcagaggctgggcattgccactaggacctgagctcctagagaacaaggacctgggtggcctcgcttactgttccagcccaggccaagcacagggtctggctcgtggcaaaccttgaataaatatttgttggctgaaagagtg

SEQ ID NO: 147204 - DNA, 468 bp, Homo sapiens
gagttagtaaacaaagtggttctcaaaatgtaaaattcttccttgactcactaagcaaccttctgattgcaacttgctttccctttttgggctccaagacaggaattctctggccctgctgacaggagccccatgttgcacagggcaactatgtcactcattggaaattaacatgtctgccctctgacttcagtatttctcccaggagcagaggatggaagttcttcacagctggatctgctgtatcattcagaagctggcttcagagcctgtgtagctggaagcctcgggctcacatcaaggaagggaatgccactcagcctctgggcacacagctgcaacttcccctggtgctgtctctcttggtgctaccctatactagccttgtcctgaaacatctaccccattcatttcaccctctctgctactatgtcactgcctctcccatcacagtattccacccaaatg

SEQ ID NO: 147205 - DNA, 734 bp, Homo sapiens
atgaaatttagtattaaaggacatacaaggtatgtcatgaataattctctctttttcaaaattctaatggagctattttttttttttcagctgaggttttaaggactttctggtggcaaggctgatcaaacacatggtaacccgctgtggcctaatatccatgtgactattattttgcttttggctttaaacaggtttcctttgaaaaataagatacagcatcagcatacatattttaaatgaatgaatattacaagaaaggccattagcagtggtggggaattcaatcaacagtataagagactgtgattaaaaattaataaaactgtggagaaaccgttatggctcacattaagaaaaagaaaattataatacaaaagctctaggaatcctgcattttagttagggatattatttatggttttactagcctatacaatgagaatctacaggcaaatttcaccataatgctatttgttctgggtctggcctgaatttcaaagatgttataaaaattcaatttatattcagactacagaatgaatatgtacttcatttataaccaggtaaaataaacttttaaataaaatataatctatgctgaaaatatttggaaataaggaatttagcatattttaaaaagacccaaatatggccctgatttctgatttccatgaagtacacaaatatatactcacaatggtaaaacatatttgtgtctagaattggtgaat

SEQ ID NO: 147206 - DNA, 1024 bp, Homo sapiens
tgaggacagaagggataactgcagggtcctgattagagcccagccatattaattgtgtagctgttcttgctcactctgattcagcctagtgatgagggtcagagctgatgtttttctctttaatcatagtaatgaggataaggtatacagcactgggggtacaatcttgaattattctttattgttgattattcataaagtatatctcaatcaaaagtttctaaatcaaaactgggaaggggatggcttaacggcaaagtgaggcaaagtttttaaaatgtttataatgtaatgtgacatttaaagattaaaatgtgttttatggatttctcatttttcatttgttacatgaaatcttagttttttaccttcaggttcttgggcttaaaaatgtctacctgcccaaaagacaggaaagtcacaaaataatacagatagcaaataaatatatatatatttttttgagacaaggtcttgcctgtcgcctagactagagtacaggtggtataatcatggctgactgtaacttcgaactcctgggctcaagtgatattcctgcctcagtttgacaagtagccgggaccacaggcatgcaccaccacacctagctgcaaataaacattttaaaattattttgtagggacggagtcttgctgtgttgcccaggctggtctcaaattcctggcctcaagcagtcctcccacctcagcttcccaagtagccaagactacaagcacatgccactgtgcccagccacaaataaacatttaaaaaaaatttttttaattgttttttgggagacagacaaaatctcgctttgtcatccaggctggagtacagtggcatgatcttggctcactgcaacctccgcctcataagttcaagcaattcttcgtgcctcagctactcgggaggctgaggcaggaaaatctcttgaacctgggaggcagaggttgcagtgagtgagatcgcaccactacactccagcctggcaacagagtgagactccatctcaaaaaaattt

SEQ ID NO: 147207 - DNA, 551 bp, Homo sapiens
ggcctgtgagcaacaaaggccaattaaaacacagaaatcaaagatgtggcctcaatacctactgccaacgcaccagaaagaattaggctgacaccccaaaatccttacagttgggcaacatagctctggcaaaaagagagtaaaaaagggtaaaagtttgtggctctcccctatgctcctgataaactcaaggtacctgcagtgaagtctagacaaaggatacatctctccaaattaactgtgggtgtgtctgttggtgcatagatagagctgactaaagtcaaataggtaagaagctgttcacatttgtaagagttgtactgcccaaagaaccacccatctgggctcaaagggactgattacctgaaacttaaagcaacccttgggctccaggtcttctataggcaggaaacagcctgggaaatacgctcattccccaaggaaagcaaattcttcactgctctcttacatgtaaccaagaaaggtaatggaaaaggaagtcccagaaagtggagcaaaaggccatggagaacattggactaggaagatac

SEQ ID NO: 147208 - DNA, 493 bp, Homo sapiens
ccgcccgtcttctgcttttgagatccctgtgattacattggcctccctagataatctattttaagatcagctgattagcaatcttaattccacctgcaaagttaattctcctttgccacggaaggtaacatattcacaaattctagagattaggatgtggatgtctttgtagggggagggggcattattctttctaccatatatggagaagtcataaaatactagcagaatagcgatgattgacctgaagccacctaagggatggattttagatccatccttaaggtaaggccataagagttaagtgcagtaaggttggaaacatagagttcagtgctcccttccaaatatatgtataggaaaggagtttttctatttcttacctaatatttctcactcacgcttcgctcccattcataccacattctaagccccttcggaaaccccccaaaataattctcaattgctgagttaactgtggtaagagtgaaaa

SEQ ID NO: 147209 - DNA, 328 bp, Homo sapiens
caaagtactaatgcagtgtgtcagcgtcccaacacaaagccctgagaggttcctcgattcccctgctcacagtctacaaagtactaatgcagtgtgtcagcgtcccaacacaaagccctgagaggttcctcgattcccctgctcacagtctagaaagtaccaatgcagtgtgtcagcgtcccaacacaaagccctgagaggttcctcgattcccctgctcatagtctagaaggtactaatgcagtgagtcagtgtcccaacacaaagccctgagaggttcctcgattcccctgctcatagtctagaaggtactaatgcagtgtgtcag

SEQ ID NO: 147210 - DNA, 550 bp, Homo sapiens
tgtatcaagagacaattatcttaggactgtcttttaaaaaactaaaacagcattctcacttatacacagtctaagatatatagagagtcagcaaatgcaagaaatccattcttaatccacaggaacccaaggcaagcctacaggatgaattgtactggagacctgtgtttattccaagtgactcaaagcactaggcaatatctaagaacctctacagaataaagacctactcagttacacagtaagcaaactttctcacaaagctcaagagataacctccttgagctaaatgagaagacctttctgcatgtatctcattaaaagtagattaacaaaacctgaatagtgaagacaagatgccagtgggcattaggttgcagtaaacctgccagggagacaggattaaactaactacattttggcagtgtaaaagctgttttgaatcacaaggatttcttttaaaaaatcttattaccagtgttaagtatggtaccctggcagctaaaacaggtgaacttgctcactaaaagcaaacagttcattgtttttg

SEQ ID NO: 147211 - DNA, 261 bp, Homo sapiens
ttctgctcttgagcctaaaagtgtttggttacatcccacataaagaaagagagggaagaaatgaaaaaaggaaaggaaggaaggataatatggcatcaaagaaggtataatttttttccctctaagtgaggtcagaaagggcagtgaacagggattacttcgagatccagaatttggccctcagcctcctgagtgtttttaataccccaaagaagataatacagatcacagccattttggtaacagccatttaggtaacag

SEQ ID NO: 147212 - DNA, 725 bp, Homo sapiens
  misc_feature (490)..(490): n is a, c, g, or t
aaatgtatagcaaaattttcaaaaccagctcctcctaccagacaagaaaattaacattttttagggcacagaactgaaagcatttttactgaaatctaatccaggatgaaacctaacagttaaacattcttttccttctctgcttctttggctctctatcccagcacaccttgtcccaggctaacttgagtaaacatacacatgtgaccacatgagggcgggaagaacaccaagtgggggtggtgaaattctgaatggaatgcagccccagctagttagggggccccgggctgagacctctggcactggcagtagacttatacaggcaaagaagccaaaacaatgagctcatgggcaagaatgcagcctgtggggaagtctgggcagctagagcaaactggttttttgaatcaggatgggaatagcaatagttgagtctcccacgggaacaggatcagggagagtggaagccaccattcagtgcaaattnagggtccagttaaataacttttggaagctcttattaaaattctgttctgcagacagcatagtgctcttaggcaaaaccttggttcctttccctgactatgtaaaacctagagggtgaaggaccagtgaggctccagtgacctaccttaggtgatgctcttaaaagagcaactttattcaaaccaggcctgccaatgccaactccttcagtctagatccaaagatggctatgatcc

SEQ ID NO: 147213 - DNA, 741 bp, Homo sapiens
tttcttctggcatgtgttaaatttagtacagctctccataaaagatgatgtctgtccatctgtctgccctcagtcagacccctcactaggggatggcagggagctcaaatgcactgacagatgtgccaccccagaggtctgtctgccgtgagtcagctggcatgctccagcaggctccttcctgaggctgaggggcccggggctgttggggggtgttagtttcccagggctaccgtacggacgatctcagttctggaggctggagtccatcatcagggtcgtgccccctctgaaggctctgggcaggtcacaccttgcctcctcagcttctggtggtgttgccagcagtcctgggctcaccttggcctgcagatgctccactcccatctccgcctccctcttcacatgatgatctcccttgaaggacatcagtcattggattagggactgtcctaatccactgtgaccttgtcttaacctaattacatctgcaaagaccctgtttccaaataaggacacattctaaggtttggggtgaacatgaattttagggagacactcttcaacccagtacagacggtgtggccagctgtggagagggggctgccaccccttgcagggacctgcctcccatggccatgtctgcacactggccccgagccctcccaggaccccagtgtacagacacattcctcctgccccccagctcacagcacccaacactgactcaggcacacctgg

SEQ ID NO: 147214 - DNA, 506 bp, Homo sapiens
tctgagactggcaggggggtgtgaggcgcccggttggggcgtggcgtgtgtcagccgctgctcttggtggcggctgcttgggttggtcaccctggtctcgtctcttgccaggcctgggttcctattctccagccccgccgggctgcggcccacactttgtttacagtcttatggtcaggctgagcagtgatgtggcctaggtaggtgccgcctccttctccagggtcctcccacccgcctgcaccgggaggtggacgtggcttcctctgccgtcccgggcgggggtggacgctggcggtgccctctgggaaggggcccttgccggtgccaagacattggccacaagccttcagcgggcccaggatcccccagagagagcccacgcccacctgtgcccacgtgcacccgaatgggaacccagaggtcgtgggaggggcttcctgcaaggtgtgcagcggggtggggagcggcgtgagcagctctgtccttgtaaagacaccgctgtc

SEQ ID NO: 147215 - DNA, 176 bp, Homo sapiens
tactgatttgatccgcagcacatcttgccttcccagttaatggattattacatgtgtatgggaccttgactctgggcatctcttcccattgcttcaagagagggtctaatcagatgatcctgggagtctcctcggctctgaaggtctggcttcctctgcttcaaaccactcagagg

SEQ ID NO: 147216 - DNA, 375 bp, Homo sapiens
gaaaaaaaccccagtgtatcaaattgaagagtgttatgcattatagctatgataacattgctaatgacattattcaaacaagaaagttgtagtcaatcaaaatacccaccttagcctctgaaaggtctttcaataatgaaaatactttttgtaaataagggtgtaattttaagaggcatatatgaccattaattaaattgagtttaagctaagacaaagcaatggactcaccactcgtacaaaagtgcataagctcatgaattgtagctagacgtttagtgttgttccatggtgggggtagagggaattgaagaaattcccacagtggcaacttggactgcatctcctgctcaatttgaactggatcaaaattct

SEQ ID NO: 147217 - DNA, 772 bp, Homo sapiens
gccctccagtgggaagtgagtgatgaccctgaagtgaggactcatctctagatctccaagggctgcagctcagccagcactttacaagggtgatctggagccaaactggcctgttggctgaccataggtgactctgggtagcccatacccaggctcagcggcagttggggagctgcctcgatttctggttacagaattcctggaactgagtcactgcagtaattgctgtgatgaattgtgtttactttgtgtgggattccaaactgtagcagcagtgactacagctggaagacagcatgatcagcagcttccaaggcagagcctggcgtcagaaagctgcattgcgctaatgctgaagcctgtgggagcctgttggagagacacttggatgtttagcgagctggtgactctccttgtcatgagtaagcttaggactttgggcaagtcatccaaactcttctgggcaagtcattctcctgcttggatgccttgaggcagagaggcagtgaggtgaagtggtcagtgcgtcgactctgcctctagcctgctggggtttgaatccacctgtgtgatgttgtatgatattgacctttctggctctcagcatcctcttgtgtgaaataggagattttaacagtatctatttcgtagggttggtgtttgaatgagttaacatatgtaaagtgaatggtacagtgcctggcttcctggcaagattgctatcaggattaaggcaggttaagcccttggcacacactaagagctcaataaa

SEQ ID NO: 147218 - DNA, 440 bp, Homo sapiens
acaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggag

SEQ ID NO: 147219 - DNA, 506 bp, Homo sapiens
aaacatcctgaactctaagttgtaggcagtaactgggcaaaactttaagttgtttacagagggaagaaaagtgaatttttcatatataaagaagtgtgcaaattgtatttcatgagtagtcttttgtcttctggaatggtgatatatacaaagtaatctgggaagatacaatttggtaatagtagatccttcgttaacttgaattattttttgcaggaaagatgcgtctttagccaaaattacttatggtaaactgttatgtaagcaagaaatcaccttctacttggtttaagctattcagtgtactctctagatagatatgacacaaagctagcattatgatacagtaaaccaagtgttaatgtaactttatgttgattttgactacattctgaaaataataaaagtcatctggtattttaggcttaccaaagaggccaagctttgaaacttctgggggggcccagtgcccaataaagcctatagggaggcgaatacaaatcaat

SEQ ID NO: 147220 - DNA, 360 bp, Homo sapiens
aaagaaagagaaagaaggaaggggatttgtgggggatgtgttaaatttgagacaatcaagtgtgatatggagaagacagttggatatacaagactggagctcagagaagtctgggtttgaagatatacatttgggagttggtatttatcaccacaggagtggataagtttccctagaaagtgaaggagataagaattccaaggcctgaatctggagcaattcaacatttagagatctggtcaatgttaacaacttcatagggtgttcgtttctttctttctttctttctttctttccttccttctttctctttctttctttctttctttctttctttctttctttctttctctctctctc

SEQ ID NO: 147221 - DNA, 329 bp, Homo sapiens
ttggttcccaaaacaagtttgtagttggtagcagcagcaataatgtgggccatggaagtagtactgggccatggggtttttcccatggagccataataagcacatgtcaggtctctgtggatgctcctgaaagcaaatctgaaagtagcaacaatagaatgaatgcttggggcactgtaagttcttcatcaaatggagggttaaatccaagcactttgaattcagctagcaaccatggtgcctggccagtattagagaacaatggacttgccctaaaagggcctgtagggagtggtagttctggcattaatattcagtgcagtactata

SEQ ID NO: 147222 - DNA, 745 bp, Homo sapiens
gaggattgattgagctcaggcgttaaagaccagcctgggcatatagtgagatctcctctctacaaaaaaaaatttaaaaattagcccagtatggtggcacatgtctttagtcccagatacttgggagattgaggcgggaggatcgcttgagcctgggaggcagaggttgcagtgagccaagatggtgtcattgcactctaacctggtgacagagcaagaccctgtggaattgacactaggaaatgaccaaatattgctactatgaggagagcagtcaaaaggcttgaagttgtttgttttcgtactagctgtgactaaaaactttatgttggtttgtaaactgattgaatgtagttccaaaaagaagttccagaaatgtttagaatattagcagcatggccaaaatgatgagcagaagccttcctaaagagacacctcaaaaagggcaacactcttttgcatgattttcttagtacttaatgagccttgtacatccttgctcgtaggaggcagttaattactcagttcagccagatgcggtggcttacacttgtaatcccagtacttttggaggtggaggtgggacgattgcttgacttcaggagttcaagacaaacctggacaatatagcaagaccccatctctatttttagttttattttctatttttttgagatggagtctcactctgtcgcccaggctgaagtgcagtggcacaatcttggctcactgcaagctccgcctc

SEQ ID NO: 147223 - DNA, 475 bp, Homo sapiens
agtatttttaggatgcctgatttagtaaaaataacctaaagtaattctttgcctttttagtgaatttgccagcctcagatctcagagttctttgaaaagattaattcaggcaggaaatgtaatgctggtgatacttaactttaccttttcaattctttgctgaatgctctttttaacaggaccacgaaactttttttgaatttcctacaacagccctgtgaaataggtagccaggaaggttgtagccagattacgacatgctatacaaaagcaacaaataggaacaaactggacattcacaagtccctgaagttacaggagagcatagaaactgagcttagaactcttttctggcaagctctgctcacctcccttcccagcatacagaacagtgcaaaaatggccagatagtttccatgacagggtaaaaacttgcccagctgttcacagcaacacaaatttgaagtttaaaaaa

SEQ ID NO: 147224 - DNA, 306 bp, Homo sapiens
  misc_feature (30)..(30): n is a, c, g, or t
aaatgtctttaagtttttcaaaatttacancctatgggcagctttgttaaggcctgcaatgaggcaagtaatcatatggctacagtacacttggccaggttctgtgggttgggaacaaactggacattcacaagtccctgaagttacaggagagcatagaaactgagcttagaactcttttctggcaagctctgctcacctcccttcccagcatacagaacagtgcaaaaatggccagatagtttccatgacagggtaaaaacttgcccagctgttcacagcaacacaaatttgaagtttaaaaaa

SEQ ID NO: 147225 - DNA, 502 bp, Homo sapiens
tacacttttgtgcaacgcatgaaaatactatttttgtgccagtcttaccaacaaacttggatatttatcaagtgctgtgaatgcatcatctcatttaattatcataccaacatgcaaaatagtgatattattcccattgtatataactgtgctgtgcgctcacatgactgtatggaagagctggctttccaacagttatgctgtgctgcctctttaataattcactttaccttaaatttagttagttgtttctttaatcagatatttagaagattgtcattttggttaataatatattatatacacacacatactctgcatcttgtatgtgtatccaacttcattttgaaagattaaaaataagtttgtaacgcctaaatatccttattaaaatactgcaaatcccaaaaaaaaacggagtctcctttgtttcttggctgtggatttttttaaagttatctttaatttatcatcaatttctgccttgatttcagttaattag

SEQ ID NO: 147226 - DNA, 517 bp, Homo sapiens
tacacttttgtgcaacgcatgaaaatactatttttgtgccagtcttaccaacaaacttggatatttatcaagtgctgtgaatgcatcatctcatttaattatcataccaacatgcaaaatagtgatattattcccattgtatataactgtgctgtgcgctcacatgactgtatggaagagctggctttccaacagttatgctgtgctgcctctttaataattcactttaccttaaatttagttagttgtttctttaatcagatatttagaagattgtcattttggttaataatatatgtgtatgtataaatatatatacacacacatactctgcatcttgtatgtgtatccaacttcattttgaaagattaaaaataagtttgtaacgcctaaatatccttattaaaatactgcaaatcccaaaaaaaaacggagtctcctttgtttcttggctgtggatttttttaaagttatctttaatttatcatcaatttctgccttgatttcagttaattag

SEQ ID NO: 147227 - DNA, 728 bp, Homo sapiens
atcatccccagataatccacagctaccttctttttcagctattcagatataaattcaaagtttgcctcttcaaaaacacctcccctgaccatgcgaacttacctactttttcctcattccccaaccaccctagatttagtcactttatttccttcatggaagttaccactatctgaaattacctcaatctcgtgttctttcattttttaaaatgtctacctaacccactaaaatgtgacgtctcattcactatgcctatatcatgtgaaataaaatcactgattgtgtaaaatatctcaaatgagtgaaggattgggacatcctgaaatcttgtaaaatttcctcacaggccttctaaaagagggcatctatttggacatttgtggagggttagcaatttatgggaagagatgagacacatgtgtgcactgaaagttctgagcctccatatgctttcttttcttttcagtctcagtgtagtccctatactagaatgtctgatcttgctgccttgtatagatcatattctcattctacatgaatagttttgcacatttagtttatgccacctgaactagatgttttttccccctgttaatccttataaggataaaaacaatcactagcctttattgagtgttaaccacttgccagccactatgctaacagccttaatgcctcagcacctttaatccttgaaacaactttatgaggtaggtattttattt

SEQ ID NO: 147228 - DNA, 374 bp, Homo sapiens
  misc_feature (301)..(301): n is a, c, g, or t
  misc_feature (316)..(316): n is a, c, g, or t
  misc_feature (350)..(350): n is a, c, g, or t
atacatttgctcctctcatgacgttaatattctaaaaaaacaaaggtatacaccaatccaatcaatacattctgaaactcatgaccatcaaagttatggaaatgtattttttacatcttcaatgttcagctaaaaatcaataaaaatccattatctaatatttcaaccgctacacactagagaaacaattagaaataaatctctgcaaagaaaaaagttaaactgtcttacacaattactaattattgatatttatttgttataatagtatacctggtgggcacttactggtaattaagtnctaaaaatataaatntaaaaactagttgttttttttttttttggaaacngcatttcagggtccggagcccgaa

SEQ ID NO: 147229 - DNA, 1280 bp, Homo sapiens
tgtcctgagtgcctagcacatagaagatgctcagtaaatattttttgaatgaatgaatgtagtctgccttctccaatttttttttcagtgaatttcccataaagcaacacatgcatagtgttttagcatttgtggatctaacgttgacttatcccaccagcaagggagaagttcaagaacatttatagtttataatggagataataatacagagagtggttatgagaattaaatagggtgctctctgtaaagtactaatggataggaccaggtcacttaactgacaaaaaagcctggccaagtgccctgattcacatctgaatgatgtgaattgtattctagaatcttctctctttatatttcagtttttaatcaagagtaggtgtggcatcacctgggagcttttcaaaacatacctgggttccctggtaaatatcagtgatatactgttactatattttgttctttaaccagtctgcaaatatttgtcccttaatgtgggtgataactatttgctctcccccttttaatgccttcttgctgtttgggacatctttcatggccccttctagtcttttttcctatgaggttcttgctgaaataacttctaaggtgattttgaaatcctcagagccacttggatgcacgtaattgaaccttttactaaatccacaaaatcaaaggatctcagtcctttaccttctgttttccagacaagagaatgttgtagtcatccctacagcaatccttatagcagtcattttattttattgtttttaaaatacctgatttttattttttcatatgaattatattaaataattattatgccccctctagtcgtcacacaaatctgagaagtggatgagcactgtatttgatctcttggacacttccctttattttccatggctcctcatgtctcagacccttaaagtatttgcattcttttcttttctttttttttctaattgtattttatttttacttccaggatacatgtgcaggacatgaagatttgttacataggtaaatgtgtgccatggtggtttgctgcacttaccaagcagtcattttaaagttttgcttattgtgtttctaggctccttttgtgtccttcaaatccaagaatatctcaaaaacatcagactcactttcctcctctttcttaatagagcaagaaacatttgtagatttttactgttgcaatttactgtgcaagcaagtgctgtgatttgcaagaaaaaaaagatgattattttagagatggtttatgcaac

SEQ ID NO: 147230 - DNA, 489 bp, Homo sapiens
aaaaaaatattgtatccatgctacagtgaagcctctactagttttataaaccatgcaagaaaacaatttttctattttagttatatcttcataatatttcagtgtcttgagaatgatagatttctttggctgaaagggaccttttagaaatgatgaaattgtatactttcattttacagatgaagaaatgaaggaaagaaagaggagataatgacatgcttaagatcacatttttattgataaagttggaactaaaatcctgatttccttattctaacacaggcctttttccatcataccaccttaggggacagattgacatagattgttgttctattctttcctctgtcaacaatgtttcttcatgtcagtcctatagatctaatttggcaagcaattaatttcaagaataatatcagtgtttcagagaagtattgcttattggtctgaaggaagattggtatgtatcttaaacttactattttgttg

SEQ ID NO: 147231 - DNA, 266 bp, Homo sapiens
tttaagtaactatgaaagagaggctgctctaaacttaccctaacaaagcctaaaagcaagactacaaattactgaagtgatcccaagtaaatcagctgcatgacagaacaaagtccaccacttttcaaaggaatccaaaatatccagcaatcaacaatgtaagattcacaatgtctggcatcttacccaaaactatcaggcaaataaagaaacaggaaaaggtgacccataactccaagaaagctcaataaatttagacccagaag

SEQ ID NO: 147232 - DNA, 309 bp, Homo sapiens
attcacttgcttcagcctcccgagttgctgggaatacaggcatttgccaccatgccctgctaagttttgtatttttagtagagatggggtttcatcatgttggccaggctggtctcgaactccgtacctcaggtgatccacccacctccgcctcccaaagtgctgggattacagacgtgagccaccacacctagccagaactatgccctttggatttgaagttgggatgtaaggcaggacaagggtcaatggttgatgaaagtgggtaaggatttgggactgaagggacatgacgttggaggaatagga

SEQ ID NO: 147233 - DNA, 348 bp, Homo sapiens
gcagcgttggatattagatcgttatttacgtttatattacgtcccaaataaacaggttttaaaacgatactacaaaacctaaaagcaagaattgctcgcattgaattctgatcttgggtactactggggttcgccctttcaatgttctcagctgttatttttaaatctgggacgaaccattgtgacgtttacctccccaccttcctaattttaatgcattccattcgatcagccctttttctcaccttattgtcatcgctttttcagacacgacaagacaaatcacataatagtttcctggaaatgttgcattatgtaactgccgaatttgctggcagtgagcataga

SEQ ID NO: 147234 - DNA, 468 bp, Homo sapiens
taagctccgtagaaaggtttccattcctcatagcatcccctttgggtggacaaactgaggcatgaagaggttaggtaatttgctaggcagcctgacttcagaaaggcctactacagaagccctctcaagaatctccttctgggccagcgtggtggctcacacctgtaagcactctgggaggccgaggcggatggatctcgtgaagggattctaagggtgggactaggggcaggagttagggaaggagttgaggcaaagagttcgagaccagcctggccaacatggtgaaacctcatcactactaaaaatacaaaaattagccaggggtggtggcgtgcacctaatggtcaccgtgattgtcccggccactcaggaggctgaggcacgagaatcgcttgaacccgggaggcagaggttgcagtgagccgagatcgcaccactgcattccagcctgggtgacagagcgag

SEQ ID NO: 147235 - DNA, 300 bp, Homo sapiens
ccagaatcaagaacaaaaaccatgtaatcatttcaatggatgctgaaaaaacagtcaatgaaatttaacatccctttatgataaacaccctcaacaaactggatatagaaggaacatacctcataataataaaggccatatatgacagacccatagctaacattgtactgaacagggaaaaatggaaaacttttcctgcaagatcaggaagaagacaaagatgcctatttacatcacttttattcaacagaatactggaagttctggccagagcaattaggcaagagagaaacataaagg

SEQ ID NO: 147236 - DNA, 199 bp, Homo sapiens
ctgaattgcattagatttatgtactttcagaaaatagacatttttatgaaatttgttcatccaaggacaaagtatgcatttctatttgctcctatcctattttagattttcttcatataaatcctgtgcttttctgttgattcttaagtatttttgattttgtgattactatgaatggaatttcctcatttccatttct

SEQ ID NO: 147237 - DNA, 762 bp, Homo sapiens
aggaaacgtacaatcatggcggaaggcgaaggggaaacaaggcaccttcttcacatcatggcaggaagtagtgccgagcaaaggaggaagagccccttataaaaccatcagatatcatgagaactcactcactatcaccagaacagcatgggggataccacacccataatccaattacctccacctggtctttcccttggcacgagattatggggattataattcaagatgagatttcagtggggacacaaagcctgaccaaatcagcaattctcctgcctcagcctgagtagctgggattacaggcatgagccaccatgcccggctaatttttttgtatttttaatagagacgagttttcaccatgttggtcaggctggtctcgaactcctgacttcatgatccgcctgcctcagcctcccaaagtgctgggattacaggcgtgagccaccgcgcccggcccttgaaaagtttcagaattactataaatctgttctgctgtggagcttgatatctggggttcagagtgggacattggatcccagtgtggcctgcagggcacagatggcttagggggctggcccatgcaggcgggatcagaggcttattcagactgctgctctgccgaattttttcatcatccctgatttatttgggtttttgtttgtttttgagacaaagtctcgctcttggagtgcaatggcatgatcccggcttactgcaacctccgcttcatgggttcaagtgattcttctacctcag

SEQ ID NO: 147238 - DNA, 197 bp, Homo sapiens
tgaaaaaatctcttaaaataggggaaaacgttaaaggttaaatacaatagtatgtagaaaaagtactttagagaatgtacctaccacatgtagtcatgtgtgcttaggagtaatctttttttcaatagggagtaatctttttaagagcagaaacggaaattgacctgcccgccatgtgttaatatccaccgcgatgg

SEQ ID NO: 147239 - DNA, 175 bp, Homo sapiens
tgaaaaaatctcttaaaataggggaaaacgttaaaggttaaatacaatagtatgtagaaaaagtactttagagaatgtacctaccacatgtagtcatgtgtgcttaggagtaatctttttttcaatagggagtaatctttttagggagtaatcttttctcaataattcttatggt

SEQ ID NO: 147240 - DNA, 490 bp, Homo sapiens
agatgtgaatatatctcgtctcacttgcgcagatgggaaggagctgggaccgagaaagatgtggtggacgtcaggagggctagggaggctgggtctgagggaggcggtggggaacgagtgcaggatcgccaggcacaggctccggggtgagtgtccaggattcctcatgctcccatcggccccctcctgaaggttgatttgtccggagtcaggtttgctaggtgagtggggcaccgggacccagatactagtccagctgtcttctgagcccacgcctaagtaccttacaggtactgttagctcagtggatgctcgggtaacttccatgaccggatggtcagttctgaggctgagagagaggccacgccgccggccagtgcagagctgggccttgggtgggttgcagacaagaaaggctgggagtgctgcctggagccccaggtgcaggtggaggggctgagggttactctgggagaaggtggattctgaa

SEQ ID NO: 147241 - DNA, 338 bp, Homo sapiens
ccctctcccgccggtggacatcaggcggtgtccaggtaaagctgctgtgagcactccgggaggtgacccttgctggacgcatcattcttttgtggggagatgccgaggagttgccattgctgggccacgtgtccactcagcagacactgacggtttgttaaaggggttgcacccacttctgcccatctgctccacatccacaccagcgagtggcactgggagtcttgaatgtgagatgttttgttggttgtgttatctcgctgtactctttctcaattgaggtaaaaattacatacaccaaaatgcacatacaagtaaaagctactcaatgagtctta

SEQ ID NO: 147242 - DNA, 208 bp, Homo sapiens
cacgtggacatacagaatgtccccacgtgtagcatgctctaaattctgatttgtgacagccgttagagcatgcatatgtacaaaataggctgttgctttgcagtaagtttggttcctaatataagatgtattgtttttaatcttttaaaataaattactagtggaaaattcaggtcaaattatttgctatcaagcattttctttagac

SEQ ID NO: 147243 - DNA, 134 bp, Homo sapiens
gaggaaagatagagtcatgtgtcataagagaaggctagtaataggcttgagtttcaaagaaaagagtttatcagactgaggagtaaagaacgttggtaactggccttcaaaagatagttaagattgcatccgga

SEQ ID NO: 147244 - DNA, 410 bp, Homo sapiens
attggtaagactcccaatcaacagtaggctattagtagttaattctcggggagtcaaaagtgacacacaaattttcgactggagggtaggtaggcattcctaacccctgagtggttcaagggccactatatgtgcaaatcaattgtttggcaccttgaatgtgtgttctctttctcttatttatatccgtctctcttaaaaactgagatcagaaatgcaatttagtgttgaagaaatacacctttcagccaggcgcagtggctcattcctgtaatcccagcactttgggaggctgaggcagggggatcacttgaggtcaggagttcaagaccagcctggcccacatagtgaaaccccatctctactaaaagtacaaaaaaattagctgggcgtggtggcagctgcctgta

SEQ ID NO: 147245 - DNA, 250 bp, Homo sapiens
caccattgccactggacactttacttccaattttgcttcctgctctaaaagataaccccttccttcctttcccacattctccctacaacctcgtcttcttttgagttcatccactttctctcatcattgtccatctctgcttcccaaaaccttacatagtatagaaattggccaatcaagattatcatgtggaagaacatgcatttactgaataaggcagctggctcctgggggcagaaaggtgattaga

SEQ ID NO: 147246 - DNA, 290 bp, Homo sapiens
atccacgaaggcctcaaggaaaacccctgttaaccctccactgacatctcctggatgatctcattatttgaaaaatagtctcaaaagaagtcacagctgggaggtcaacaagaaagaagggttggcaagatatttcctttttcttctttttaattgcaaaaggcgtgccagagagcaacctacagccagaggcagagctcactcactgctaaactaagggaaaacgctcaggaggccgtcaagatccttcccctggctgcagaactgtacggaaagtgagctgaactgta

SEQ ID NO: 147247 - DNA, 429 bp, Homo sapiens
gtaattttctgtaaggagcatctgttgcttcttgtaaaataaaaaaaaagtggggaatttgattttaacttttcaaaaatgtcagtcagggaaaatcagggaatgtcgtttggcttcagtgggagactaggggacaaaggaaaaattcagatagggcaggggatctagggtatagaggccttggaagccgggctgacaaatttgacccatcattttgggtaagagggagctgctgtggctttaagatgggaagaagagaaagaagtagaaatctgccgtgcaatccagacctgagataaagaagacacggtcccaggtggaggcaggggtggtgtggaagacatggctaggtgaggagctatttgtaaagacagacttagagatgacgaagcaaagatgagctggttggaaagggcactgactagggcc

SEQ ID NO: 147248 - DNA, 222 bp, Homo sapiens
catggatttgctggtgcagtacaactaggcttaatagggacatgaccccaaacccaaggagcttattgaaagacatttagcaactatactaataaattgcaaaagagatgtgttttaaacaaaatgaaaacagggtgctatgaatacacattagggaatcagggagaaactgtggggaagtgaaatttaagatgagaaagaaaagataagtagaacctacga

SEQ ID NO: 147249 - DNA, 317 bp, Homo sapiens
cactgctaataccttgatttcagatttttgccctgcagaaattttgagacaatacatttctgttgctttaagccactaagtttatggtaatttgtacagcagccacaggaaacgaataccagtgtctcataggcttggcgtacattagggggtggaggattggaatcatgggggaaataacagaagctgataaattaatccaagagaaaaatcacgtggcttgcatcaacagcagtgggaatagcgagaagtgctctatttagaacattctgaaagtagaaccaacaggatgtgctgatagattagatgttggagac

SEQ ID NO: 147250 - DNA, 335 bp, Homo sapiens
caccaagcccaggaacacctggagccaccagaagctggaaatggcaggaaggatcctcccctagagtctctgcaggagcatggccctactgacaccttgatttcagagttctggcccatggggctgggagataataaatttgtattgccttgtatcgcctggtctgttgttccctgttagggcagccccagacaccagtgcaggtctcccatcacagcactgctgtgaggctgcatgagatgagaaggatgcaaagggatggcgtccagagctgcgctgctgccaccaccctcagctccttggttagatattctgaccttctgacctcctggcag

SEQ ID NO: 147251 - DNA, 345 bp, Homo sapiens
aatggaatcggaggcactggcccttcccaactggaatctaatgccaagcaaaccacgtgggtgctgggtccaaaaagaacgtgcagcagcagacagcccatggaaccacccaacaggaccccataggaccataggcacatggctcccacccagcaagccctccctgccctgggctcatggatggagttgcctgtcccctgccattcagtcactaacacattcatttattccaaagtctagactgtgtgtctaccaaggagaggcacaagagagacaaacattcaaaaggctgttctgagaaaggtgaggtggtacatgtctgtagtctcagttacttgggaggct

SEQ ID NO: 147252 - DNA, 725 bp, Homo sapiens
caattatttattttatacatcatgtctttagtgttgtgtctatttttatttatatatttgttgcatgtagatgtccagctcgtctcgcactatttgttgaaaagttgatctttgcttcattgtattgcctttgcttcttcaacagatatcaattgactatattagtatgggtctacttctgggctctctattctgttccactgattattttcccattttttcaccaaccccacactgtcttgattactgttttgattacatgacttacttcatgtaggtcataaagctgtgttgtgtcagtcctccaattttgtacttcttcaatattctgttggcaatttaggtcttttgactcttcatataaagtttaaaattagtttgttgatatccacaaaataacttcctggattttgattgagattgctctttctaaaaaaaattatttggctcctctgcttctccctcccctatgcccaaacttgcaatataaataagaattattcttcaatattacacttgtttcttctatctgtggcagggatataaactctcatgaaactgggagagggagtggtcttgtgaaacaaataatgatttataaattttatggtaaaattatgaatttggcaaataataagttgttatatgtaacttgagctctttatatacatacatgtttttaggtttagaagagtttaataactttataataaaacaataaattc

SEQ ID NO: 147253 - DNA, 352 bp, Homo sapiens
gagaggcgtaggcaggaagattgagcatagaagtttgagatcagtctgagcaacagagcaaaaccccatctcttgaaaatataaataaaaaactaaacgggcaaaggactaaacagacatttctacaaaggagatagacaaagccaacaggcacacaaaaagatggtcaacatcattcattagacaattacaaagcaaaaacacaatgagatactacctgacacccacacccactagaatggctataatttttttttttttgggatggagtctcactctgttgcccaggctggagtgcagtggcaccgtgttggctcattgcaacctctgtctcttgggttcacgccattct

SEQ ID NO: 147254 - DNA, 370 bp, Homo sapiens
accacgatgtgaagtaggcattactgttattcacattttttaagatgtggaaactgaggcatggtaatcaagtatcttgcccaaggttgtacagccagcaggtggtagaacagggatcttgagcccagccccagtgtctgtgtctaaccacttcgccaggtcggcttcgcatggggacaacacttgaaactctagtttgttagtctggtgcccctgcttccgcctgcctccctcagtctttatggcccattggaaaaagcaagccagagctgtggctcccagggtgacgatccttcagctgcctccttggcactgtcattccctcctcccatctcctgccaagggctgcagccaagaataccacagacgg

SEQ ID NO: 147255 - DNA, 334 bp, Homo sapiens
tcactgaggtctcatgatttaatatattctcctctctttagacatctatttaatatttttcccatatctgaaaaccttgcttaccttctcaccggtagcgcaggactttgttttacagattcacctgaaaaaaatagaagtaattagaagagagtttcctcatcttccctccagcaaactgtagctgagctacatcagaattcatattctgtgctgtactttctgttaaaatgatgagctatatcccttttccgaattaagatcagaattttcacttgtgttctgaaatctacttcttgtcctggtgcagtggctcacgcctgtattcctataa

SEQ ID NO: 147256 - DNA, 723 bp, Homo sapiens
gtggaaccccgtctctactaaaaatacaaaaacttagctgggcatggtggcgggagcctgtaatcccagctacgtgggaggctgaggcaggagaatcgcttgaagccgggaggcggaagttgcagtgagccaagatgccgccactgcactccagccggggcaacagtgcaagactgtatctcaaaaaaaaaagaaagaaagaaagaaagaaagaaagaaaaaaaccgactaaaatgggccaggtgtgacccattgtcctggcttgtcttgggtaactgggactataggtgtaaccactatagagaggaaattcacaggtctacagtccccattccaaataatactaaactctacaagctcacgcctgtaattccagcactttgggaggccaaggcaggcggatcacttgaggccaggagttcaagaccagcctggccaaaatgatgaagcttcgtctctaataaaaatacaaaaattagccaggcattgtggcacatgcctgtaatcccagctgctcgggaggctgaggtaggagaatcgcttgaacctgggaggtggaggctgcagtgagccaagatcgtgccactgcactctaggctgagagacagactaagactccatctcaaaaaaaaaagaaaaaaccactgaaatggactagggggcagtggcttgcgcctgtaatcctagtactttgggaggccaaggtgggaggattgcttgagg

SEQ ID NO: 147257 - DNA, 476 bp, Homo sapiens
ccctgcccatgtagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggccccttttggcacggggggtctgacggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctgtacatgggcaggagcccggcgt

SEQ ID NO: 147258 - DNA, 416 bp, Homo sapiens
tctcttcctccggcccctggtaaccaccattttactttctgtttatgaatttgactactttagatacttcacataagtggaatcctgcagtatttgtctttttgtgactggctgttttcaggtagcatgatgtcctcatggttctacgttatagcgtgtgtcagaattttcttccttttagaagtctattgtatgtatatgtcttttaggtctgagtagtttatagtgttgtttaagccccttccatttccttactgattttccgtttggtcgttctatccatttttggaagggtataatgaagtcttcagctattatcatagagttttgtgtctatctctccttttaattctggtaatttttgctttaatatattttgatgcttagttgttaagtatctgtatgtttagaactgc

SEQ ID NO: 147259 - DNA, 408 bp, Homo sapiens
tgggcaacatagcaagaccctgcctcaaagagagagagagagagagattaagtcacttgttccagggtcccagaagtagactttctgatcccaactttccattttcaaggctgtcataactcctatctcccactctggctcttcaggtacctcagaacggccacagcaaaaactgatggcaacaaggacgctgaaaggagagaagactaaagagaggaggaacagagagctgccacagggagggggcacccagggccaggtgggccatggaggcactcactctatcccatttctcacacaccacacacacaaaaaactctagccggccaggctcaagctcaggcagtgttcaggaggtggggtcactccatttacataattgaattgctggagtggcttggaacagat

SEQ ID NO: 147260 - DNA, 365 bp, Homo sapiens
tgggaaaaccctttgggataaccatctgctcgagtcatctcaggatctttgtagattatcacaaccacttgaaccaggtccattctgctggtctcatactataatatgggacaggtaaaggtttgataatgtgttggtgtgtgtgtgtgtgtgtgcattctgtacccttaccatattgcagagaaaatcatctgtccttccactttgtaattccaggagcaaaagggtaaagtagcagcatatctcagtgtggatggtctagtgactgtgtgtgaaagcagtgagaacaacatgcctttctgctatcagcacaggtgtcttttttcttgactcttatcaaagggtgggaatatgaggcattttgc

SEQ ID NO: 147261 - DNA, 407 bp, Homo sapiens
gcaacaaaagcaatgtctttttgctgtgagtctcaaagcccccaaattcatagggcagcactgtgagaggatgttacctgcgcatgcagtggggaatgctacaggagagaaaaccctgaaataaaaacagagacagagatagacatttattctagagtgtaagcaaatcttcaccagggagagagagggagagtttactatcctggaatgtcctcagggaggacagcgttctctacctttattataccagtcaggaatattccttctgaccttaaagtaaacactatctcttgcattcagggatgtttgtcatgcaaacccctttgctcagaagatccagaccatgcaaaaacatgagacattcatagagaattctcttccaacacagattttcccaggtttctgtt

SEQ ID NO: 147262 - DNA, 283 bp, Homo sapiens
tgctgttttcttcccttcctcctacactgcctatggaggctacaagcaggagattcttcctgggcacctggaggtatcttctcagtaatgcttataaaaggccatctttctatagaaaaactttggtatcagaagcaggacctctctcttaggaaaagtcctgggctctggggctggctctgccacttgctagtcataggactttcagatagtctccctgtgttagtctgttcttccattgctataaatacctgagattgggtaatttacagagaaaggagat

SEQ ID NO: 147263 - DNA, 306 bp, Homo sapiens
ggcccggtatgggcaaaaacaaaggcaggtagatcagtggaacagaatagagtccagaaatgaccgacacaaacatcgactgattttttgtttagttttttttttgagacagagtttcactcgttgcccaggctggagtgcaatggcacgatctcagctcaccgcaacctccccttcccgggctcaagcaatcctcctgccttgacctcccaaactgttgggattacaggcacaagccaccacgcctggcagctaagaatttttataatcactagatgttgggttttgtattttctgtatcaaatg

SEQ ID NO: 147264 - DNA, 792 bp, Homo sapiens
gaactcctgacctcgtgatccacctgcctcggcctcccaaagtgctaggattataggcaggagccacctcgtccagccttcttagctgattttttaaaaatgatagttgcttttattgcataaaagtgtggaggactcattatagaaaacaaaatgactttttttttgagatagagtctcactcccaggttggagtgcagtagcgtgtgattgctgctcagagcaacctccacctcccaggttcaagtgattctcccgcctcagtctcccagtagctgagattacaggcgtgtgctaccatgcctggccagtttttgtatttttagtagagatggtgtgtcaccatgttggccaggctggtcttgaactcttgacctcaggtgatctgcccgcctctgcctcccaaagtgctgggattacaggagtgagccattgtgactggccaaaatggcatttttgttttatttctaagttaaggatttcttttttgctttatataaattggtatcaataaaaggattctagatttcttcaagattgacagcttgtaactccacttaataacaaaatttagtaattatataagtaaagtcagtttctaaatatatggttaaataattaaaattggggtgggcccagtggttcatgcctgtaattccagtactttgggaggctgaggtgggagaattgcttgagcccaggagttcaaaactagcttaaggggtcttgaattagcctaggcggtcttgaattagcctaggcagtcttgaattagccaggtgttgtgggcgc

SEQ ID NO: 147265 - DNA, 453 bp, Homo sapiens
acatacaattaaaaacacagatcttaaatattcaatttgatgagttttgacagttgtaccaccatgtaacccaagcaccaaacaagatacagaacatttccatcactctagaatgtagccttgtgcctctttctgttcgattccctccgcctcagccaccaccgccactgccgccttctgactagtgttgctataaataaggctggcttattcctgaatttcaaaaaagtggaattctacagtatgggtcttctgtgtgtgggcctgccatctttcactctacataatgtttttaagattcatacaggctaggcgaggtggttcattgtaatcccagcactttagaagactgaggcagggggatcacttgaggccagcaggttgagaccagcctgggcaacacagtgagactcacatctctacaaaaaaattaataaaatttttaaaaagaaa

SEQ ID NO: 147266 - DNA, 304 bp, Homo sapiens
agaaaggggcagagagcagaagctgggaggaaacggagattggaactgtccaggtgacgtgaggcatgacggtggcttagacaagggtgctggccgcaagatgtgaacgatcggatgagaacagggtgaaggagaaggcgcagtacctacaagaacagccataatcattgccaggctgtcctgagcctttctcgtgtattatctcattgaacccacaaagcaaccctaggagacttacttgttgcaacagcaacactcattttccagaagagaaaaatgaggctacagagaaatgaacagacct

SEQ ID NO: 147267 - DNA, 505 bp, Homo sapiens
aagcggtaccagcttacccttacgtctctatgactctgactcctccagttaccttatataagtagaatcatacggtatttgtcttttggtcactagtttgtttcacttagcatatgtcttcaatattcatctatgttgtagcatgtgtcagagtttccttccctttgtaaggctaaataatattccattgtatgtatataccacattttgtttatccattcacccttccatggacacttggatcacttccaccttttcgctattgtgaatacctctaagtaatatttaatacagtagccatgtccacccttttgaaaatctctgccttgtactggaccatcttccgtcatttcttttcctctctctcacccaatcttagaggctttggatttattcctttgacttagaaaacgtttcttgttcgggcacggtggcttatgcctgtaatcccagccctttgggaggccaaggtaactgcagtacctgaggtcaggagttcaaggcc

SEQ ID NO: 147268 - DNA, 121 bp, Homo sapiens
aattgatcccacctatggtataataagaaaataaactggtcaaaaaagtattgggggttgtaaaggtacagctcatgactttgggagctgagtccatggagcagtcagacacatgccaata

SEQ ID NO: 147269 - DNA, 485 bp, Homo sapiens
caggcctccctgcctatgtgcacagaagatccgagagaaaagctgactgacagcagtaggtcatgaggatgccacttgtttagatttcaaatgcattccactctatgtctcacttaagaccagttgacagccatgtgttccgagcctgggctgcctctggtgaattttcctgagacagaagtgtcattggattctttcttgtgccaagtgtaggcaccactgcctcttttagaaactatgtggacactttgaactgtgctcttttaagccagtgccggaagaatggcattcgcagggcctggtaaactggggagaaactttctgatgtttttatgaaaggcatgttttgctctgaagtcaaagagtgtgtgttctggccaaagtagcaagcatagatctgctttttccacacgcaccaggcttcagaggagaagttgactagatagccagtgtctcattttgtttgtggtgggcatgggatggtg

SEQ ID NO: 147270 - DNA, 146 bp, Homo sapiens
tgacaatctctccaatggggttttggttagggggaggcttaaaagtaattgatttatgattcttttaaccaacatgtaagtcaagaggctggccaagagtttgaagagcccgaacctgttagacagtaaaccaattatctttgtga

SEQ ID NO: 147271 - DNA, 744 bp, Homo sapiens
ctggataacatatgctttctgctcagttccccctgttccttgtggctggaccacttgtcagagaagataataccatttcattccgcttgcttccaggatttttccagaacaggctgagagtctcaaaatcctaactttcattttcctatatagcatgggcctcacttcaaaagtgtctgcattagcctctctgtttgtaaaactctggacaggatttcctaaggacctgtctcccctgaatgaacatggtcaagtccgttgatccctgtgttctaaagtgggacaggggttccaagtagacttcataaacaccctagtcattcctttggaatttaagtgttctagaattatcagtgcagctgaggcagcttcacgtaagaagtcagcagtctaggtttcctttttagggaaatgaagcttttaaatgtgtttggccctcagtgaccactttctgtgcccagagtaataatgcgagctttagttgagatcccatagagaaactggaatgcatttcttagatcacctgacttcgaagtcttttcccctaaatcccaagagagaactaggcagtgagtgccctggaatgttatgactagttcttccttgaaactgaagcagttggccaggcgcggtggctcacgcctgtaatcccagcactttgggaggccgaggcgggcagatcacctgaggttgggaattcgagaccagcctgaccaacatggagaaacccctgtctctactaaa

SEQ ID NO: 147272 - DNA, 441 bp, Homo sapiens
cagtgagtcatgattgcaccactgcactccatgcactccagccggggtgacagagtgagagcttgtctcaaaaaaaagaaaaaaaattagcaactattatttactgagcccttaattatgaaacacagactatgccaatgggtttacataaatgttttattttctccttggaactacaccaagaagtatttgttattataaccatttcacagatagagaaaccaagacttagaggttaagtgacttgcataagatcgctcagattattggtgctagtagaactaggactcaaactaagtatgtttgaatccacggcatgcacttttaaccatttgcatcagtttggattatgagtaacagaaaataaaaataatggtggcttaaacaagattggagtttattcttccctcaagtaaatgaaatccagaagtaggcagctgg

SEQ ID NO: 147273 - DNA, 223 bp, Homo sapiens
aaagtagatctgggtagggttgaaggaaattgtagatgggagtctggagtaagcagaagaccattaaagttaggttagttagttaggttagctaagcatacatttaagaaaaataattctaattataatggtaataaggctaatattaatggaagatttactatcttcagcactatcctaaactctccaagtatattaactcatttatacctttcaacatttc

SEQ ID NO: 147274 - DNA, 410 bp, Homo sapiens
ttgctatctgcctattagtatctaccccaagctacgaagacttccattccttcttattaagcattcagcaactacatttagtgcctactatgccagtgatgcaagaatggataagacagtccctacactcaaggataacgcctctagtaggtgagagacaaaccgattaattctgcataagggataagtgctgtatgtgggaagcaatccaatgagggctctgaggatggcaaaggaagggttcctggaggatttacatttaactggtgccttgaaaggctcatctcccttaccgtccctccccccaaatccaacacacccaccgcacaatcgaatctaattaagatcaggaagaaatttgcattttcttttcactgtacccccagtaatcacagaagttcttcaaattt

SEQ ID NO: 147275 - DNA, 130 bp, Homo sapiens
tccaggaggcgaactcgtcaagcatggaactggcgagtgagaccaaatcagactctttgtttcttgaatgggtctccctggtcagcatgacctgtccttttaaccactgtgccatatttggtttttccca

SEQ ID NO: 147276 - DNA, 301 bp, Homo sapiens
agatgggtgaaggagcaggggcaggtcctgctagacctcaagggtgtgagaagactgcatctgattctgacagcggctctgtcttgcccccgtggactgtggcttaggcagaggctgagaacagccacagaggaggagaatggaagggcaaagagagcagagacacttcccaggcagccagaggaggcccaagcttgaaagggggaaggctggggagtggccatggctccccacacttcacctagggttggaagcagctgctggaggcctggggaggcagctcggtgctctgggcatgttg

SEQ ID NO: 147277 - DNA, 383 bp, Homo sapiens
  misc_feature (7)..(7): n is a, c, g, or t
  misc_feature (18)..(18): n is a, c, g, or t
aggatcnccgtcctcctnctgctgctgacatctaaaattctcaaagtacagaggaggagttcctggcctccacttccattcaaaaaccatcctgtgcagaggccacttcttatctaggacatgccaatctgctgaaagcagggaaaacttggtttcatagcacggtgaagcaaatcacctccatgagtatccaatattctccataaacaggtttgaaaagagctccacaggatttgtagtttctcatttgcctgctttatggtagggactggattttatccatctgagtgttccccagcactaaagcagggtcccaagtgtacttgttgctcagtagtggttttctgaataggcttaactgagcagcaggaggaggacgggct

SEQ ID NO: 147278 - DNA, 265 bp, Homo sapiens
tgtaatttcaaggagttctaggaactgcttcttcccttcaaagaatcctgaggctggagaaggaactcaggtggggactggttttgtgcacattactacttttgctgtagctctaactcagaaagcatgagaccattcataacttcccagatgacagagacgcaacacagtgtggtggaaagagcgtgggcctgatcccagacatacctagatgtgaggcttcgcgcttgctaggctgggaccttgagcatgctcctagctagcc

SEQ ID NO: 147279 - DNA, 420 bp, Homo sapiens
gttgcaacctattagtggaccatgagatcagtttcatgagtcctgaccgtcattttataaatgaaatgagaatggaatgaaatgaagtggagtggagtgggatggaatgagatggaactagcaggaaataatagaatattccagaatagaaactatcaaagtacatcacatgtagtaaaggattagaaagcaaaagcaatctgaagattgaaagtcagaagcaaagttagaatggtgatttttttcccccaacccaacttggaagaatttgtctttggagaaccaacctaatcaaataaagtagcatcaatttactggagacataatccaacttgcataattgtcctggctggtttacaccacagctgttcatatgacgtggttcattaaataataaagtcttcatcaggctctcctgct

SEQ ID NO: 147280 - DNA, 302 bp, Homo sapiens
  misc_feature (17)..(17): n is a, c, g, or t
  misc_feature (39)..(39): n is a, c, g, or t
acacaaaaaaaaacaanaaaaaaccacatacacaaagancgccttcccctttaatttttaccgattagaaagcaaaagcaatctgaagattgaaagtcagaagcaaagttagaatggtgatttttttcccccaacccaacttggaagaatttgtctttggagaaccaacctaatcaaataaagtagcatcaatttactggagacataatccaacttgcataattgtcctggctggtttacaccacagctgttcatatgacgtggttcattaaataataaagtcttcatcaggctctcctgct

SEQ ID NO: 147281 - DNA, 1467 bp, Homo sapiens
aagtttgctttctatttaagtttagaagaactttaaagtatacattgaattttttatagaaataagaaactggaaataaatattactaatgatgacacatatataaggccaaaaatatcaacagataatttttaaaagatcaaggttgtaaggtttaagctatagattaaaaatattttaattgcttatcagaaatattttagagctaatatgtatattttcacaaacaaatggggaactttccattatgtaatcagtcatgagaaaagaattgtgagaattatgtcaaatgtcccatcatgttagctaagagataaataactttcttgaacttgttaatttgctcagtgtacatagttgttttaataattcaggcacaaaaaatacatgttagaacttgaactacctatagcatctagatagttaatgaaaagtatgtttagatttgaagatgattatgaatcagataatttaaatttttcataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgccctccagcctgggagacagagcaagactctgtctcaaaaacaaaaaaagaaaagaaaagaaaagaaattagtaacatacttataaagtataaacaaaattaacttaagaatacaactagtagtctttaaatgaattaaacccctcccaatattagtcctggaatttctttctctgctgctttaagcacagaaccttatccttcttttatggaaaataggtggaaattaaacagcaacatctctaaaaagacttccagggaacttttcagctttgcatttcaaaggcacatcccctaagaggattaaactgaaatgtgtcccagaatttccaattaaaacccatttttcatgttttattccaacacatacattggtgattataatattttaaaacttacatttaagtacagggctcagtgggaagagaaaaaagaaagaaacatcctcaagttgtaccctgttgcttggtaatgccttagtagaccagacccttgagaaaatgtgttttcatataattataaaggaacagattttagatcttcactgtaagagaacagtaattgcagaggtcaagtgttattttcatggatctcagagcaaagctaatagtagcctattccccagccaacagtctgccctcgcctgtgggggtctactgaaccagggtaattccaccaaaaaaaggaa

SEQ ID NO: 147282 - DNA, 786 bp, Homo sapiens
tgaattgagatttgtgaatttgtataaagatttttttctacatcttttaatagacctacttatagttttatgttagtaagcatgccacattacacatgttgtaagtggcagtagtttttttttgttaggaagtaatgtactcacgtttaattctgtttgatttctgtaggtgtttatctctaaacagattgttctattatggttataaatccaacatcttatttagttatgatggtgttacaactatagtatcaaagggttgtaagagttttgtaatcctctacaaaattaatctatgtggcccatcttctggtagttatattcgaggaggcctagaaaactttttcaacattagattccttcacacacctttctcctttgaaatttaattttgttactgtgtgttcattggctgttatgaatacagttatatcaagttttattttagagccattttattttttcaatttgtgtatttcccgggaatttgaaaatctgtttctgttttaggctgccattctatatgatgaattttttcccacaaaagtatagtgtttaagaacatagagtttatattttcccaaatatgattgtgaattctgtcacttactagcaagtgcaatatttgtgcaaatcatttaacctctttagtttcagtttcctatttaaaaaattattgatttttaattgacaatatatatatattttgggtgtacaacatgatgttttgaaacatcatgaaatggctaagggagctaattacctcacatactttttgtggagaac

SEQ ID NO: 147283 - DNA, 232 bp, Homo sapiens
tgctgggattgcaggcgtgagccactgcgcccggccaagaaagaactttgttaacagtttaatctgcccaaaagagaatcattggaatctcatcattagaagtcttgtagcaaagacagaatacctatatgtttggaatattataaagtgaatttctacattaggcaaagaattgtactaggtgacttccaacatcatgtagaggatttaagctaagagaggtgcaaactaa

SEQ ID NO: 147284 - DNA, 315 bp, Homo sapiens
cttcccaggcgctgagtttggtttagaatggtctctgcagggaagtgcagtgaagcacccgttggagagctggtgtgtttgcaccgctgctcagcgactgctcctgtgtttgctgaccttgcagaagtccaggtgagtgctcagacaccacctcttccttcctaagcctggcagagcccatcccatttgcttccttagctaccctcacggagctccagaactctcgtctggtgcctccttgaatttacattcattgaatgtatacattaaatatgtacagttgttcatgtcaatcatacctcaaagcgttttttt

SEQ ID NO: 147285 - DNA, 806 bp, Homo sapiens
aagcttggcagctgtgcagacaatcagtttttggtatttgcccatttaaaatacaaggttttcgagggcagttctgtgaccctttcacagtttatatttatttttcctctttgggcatcagtttcctccgctgtaaaaagaggcctgaggagtaggatttaatgagcttctaagtactgtgtgcaagtctaaagcgcgaggattcgacgtggatgtagaccaactgatattctgagccaaggagtgggggcaatgtctattcctgttacactgggggtctgtccaagagctactccccaatcacacccgcccctaaaactgtttctaactgctgaacactgcctccttgtctttaccacatccagcctgcttacttcttcccgtgtctccccccacacaactcacgcacccactcaccctgggaccatttgaaacagcagctctgtcctgggatgacacaccaccccatggccatgtggagtcttactgtgttgctgaggctggtctcaggctggtctcaaagttctgggatcaagtgatctcctgcttcaaccttcccagtggctgcgattataggcgtgagccgctgcgcccagctgggaggactctttaaactagctctgtccagtagaaatatgacctgcaggccaggcgcggtggctcacgcctgtaatgccagcactttgggaggccgaggcgggcgaatcacgaggtcaagagatcgagaccatcctggccaacatggtgaaaccccgtctctactaaaaatacaaaaattagccgggtgtggtggcgcacacctatag

SEQ ID NO: 147286 - DNA, 250 bp, Homo sapiens
gctgctccagtagtggagcagctgccatccaaacttgaacaaaagctatggcattggaagctaagatttagcccaacctcagctgtgtctgccttgccacaagggtgccagatcctaaattaggttttgctttaatacttatgctgaaaatgggatgggagacatttttctgctctttgttctctgagtactatataaagtgagttctttatctttgggccccagagtcctcgagcagcagggaaagaca

SEQ ID NO: 147287 - DNA, 311 bp, Homo sapiens
taagtggacaagacagtgtactgggtcttcctatttccagttgtctgacattaggtaagtatcttcagcactcaggaccttcatttctacatcttaaaaatcatccacggtagcgtctgtatcataacaggcagcacagtgtagtggttaaagcatagactctggatccagagtgcctgggttccaatcttggttctgccacttgctagttgtggttacctgtgtgtgtgtgtcagatgaatcattagagcatattctctgctcgtaaacgcaaggtaaaaccagtgaggtgcggaaaccaatggcggaaa

SEQ ID NO: 147288 - DNA, 297 bp, Homo sapiens
ctgtacgtacttcctgggccctccgtgctcttctgagttctcttctcaaatacctgttttcttgggtcacaggagattaggagattaaagccattctctctggtcctgcgcctcccttgccaggcgtggctaagaggtttgtccttgtggaaggagctgagtgggttggtcgacctgtgcttttccgtgggtaccttaattctaccccatattccgtaatgctttcgttccgatttgcagttcacactgtagtttctcaggccaaatgtctctgtgaaatgtttggccagagtaatc

SEQ ID NO: 147289 - DNA, 482 bp, Homo sapiens
tgctgaggagacaactcaaaggaggccattccacctatccacccgcctcccccatctgtcaggtcaagagggcgtgctgtgttctgctgagcattcagcactgaacaaagcaaggcagaaatccttgactccacggagcttacattctagtggggaggagacaggtgatggatgattattaatttactagaaacgataagtcacatacaaagggcaggagcaggaccaagagagagagcggggaggagccacatccttttaaacaaccagatctcaggaagactcactcactatcgcaaggacagcaccaagggcatagtgctaaatcattcatgagaactccgcccctatgatccagtcacctcccaccaggccccacctccaccactggggattacatttcaacatgagatttgggcagcgacacatatccaaactataccaaacaccatctttagaaaacaaggcactagagcccaaac

SEQ ID NO: 147290 - DNA, 355 bp, Homo sapiens
agacatgtgccgctcaggatgtgtgagtttctgcagtgaccttgctgccgcaagtggtctgttgaagggtcagatgctggttgaacatgtagcaaattctctaggcctctgatttttccaaccacgttttgccttgctgtttttggttcttctgctgtgttctggcctgtagcctgctcttctgagaacctactatgcttctatttactgtcttcaaggagtaccttccctgtttcatttgcctggctgatttttactggtcttttatgttttgcttttctggatgtctacttctccttccagttcaagagttaggtgcttgacttctgtgctcccatgtaccctgcacttaact

SEQ ID NO: 147291 - DNA, 295 bp, Homo sapiens
tttttgagtatggtgtgaagtaaggatgtactttcatttttttcttacatacaaagctaattctcccagcaccatttgtaaaggtgtttaatggtttatattttttctatttatttgcaatgtcacctctattatggattaagtttctatatgcaggttgggtgtggtggctcatgcctgtaatccgagcactttgggaggccaagggggtggatcacttgaggccaggagttcaagaccagcctgaccaatgtggcgaaacctcgtctctactagaaatacaaaaattagccag

SEQ ID NO: 147292 - DNA, 276 bp, Homo sapiens
aaagactcaccttgtttgattctagtttttggcagttatgagtaaggctgctaaaaatgtttgtgggaggacttttgtgtgaacatcagtgttcagttcatttaggttaatatgtaggattgagactactgaatcagtaagaccatgcttattttcttcagagctccacagactgtcttccaaattggctgtagaattttccattcacatccatagtgaaggagagttcactgtctccagcatttggaagtgtcagtgtttgggatttaggctacc

SEQ ID NO: 147293 - DNA, 407 bp, Homo sapiens
aatgccactccatagacattgtcccagtctgttctcctatcaggagtgtcagagaggaatgtttcagtatttgagttggagagagtatttcctttagagaggaatgttgttgcagtatttgtccttttgtgactggcatatttcatggagcagaatgtcctcaaggttcacccatgttgtagcatgtgtcagaatttctttccttattaagtctgaatgagatttcattgtatatagagaccacattttcttcttctttttgtctgttagtgtacacttgttgcttccaccttttgtctattgtgaatagtgctgttaggaacatgggtgtgcaaatacagagtgcacctgtaaaattctaaattagattctgtccctctcctgctcagaccttccaaagaatgaat

SEQ ID NO: 147294 - DNA, 302 bp, Homo sapiens
actacagcgtaggcttgggcgtcagcctggctttgagttctagcactgctgcttacctatttaagtccaagtcccatttctatatttgtaaagtaggagtgttactagtacctacttcacaggacctggtgaggatgaaatcggataatacgtgtgaagcgcctggtgcagtaaatgcttatggttttgttgttactgcagcagctctcaaccagggatcctcccacaccagagtgttgtactccactatgggttgggttacaagttatgtttcttactaaaagtaccaatggttgggaatt

SEQ ID NO: 147295 - DNA, 464 bp, Homo sapiens
ttgccagatgtgggcatctgggcacctctgggtactcgtttacctttgcatgggacatcccccaagcttgatgttctgtcaagaggctgctcggggaagatatatactgatgagaaatctcagcccccaaattcatttttcaaagaagccaagcaaatctggtgatttattctctgtcattctgatcccagcatatgttccacatcaggtaagtgagatagaagggatggttcagcaaacattaagttaaaagaaaccctgtcaggcttccccacgaatagctggtttttatttaaagccacaatgtcattaattacattcagtaaaaagctaaggctctctcctgtgccacacttctctagtggactcggaagaagataggctgctcttacacatctgcagtccacacacccacgctagctggggtttctgttgcttccttatcttcttccttctgcagtctt

SEQ ID NO: 147296 - DNA, 303 bp, Homo sapiens
tgaaaaggatattagccaggatgatagactctggaccagacatagtcaaagacaaaattagtggattggcagttacttcacaaaattgacccagatgacagggacaagatggaggggcacaatgataaaattcaaggtcctgaattcaggcaggcctgtagccgactctgtactttgacttgacagttatgtgccatattatggctatttattaattattattttttgagatggagtttcgctcttgttgcccaggctggaatgcagtggtgcaatctcggcccaccggaaccttcacctccc

SEQ ID NO: 147297 - DNA, 488 bp, Homo sapiens
tgcctcctctggattcagatgcaaataaagaaaagaggaaaaaacgcaaaactcctaacttaagatcttcccggttaacgcggtccacaaggggcccttcagggtctgtgccatcatctctccccagtccagagacaagggaaaatggctaagcagcaggcctcagagatcttatttctaagatcaccaggccaaacccaatagcactgccaggttctacgtctttattttaataccaccagggctgtcctttgagggcccaacaagggcagtttctttcctcagggacatgataaccgtggtacttgaggagaatgcaacttgcacgtggaaactggactggaatgggagacagttctctaacaccctggatgaacggggggcatgggaaggctgcggtcatctcaagtgcagatgccagggatatggttcagggggcagaggctgataaacggggaagaactttgaaggaaacttaaagagaaccg

SEQ ID NO: 147298 - DNA, 490 bp, Homo sapiens
  misc_feature (452)..(452): n is a, c, g, or t
cgtgggttttttgttcatatttaaagttgagtcctctagaaccgaagagtcccagtcatctgccgaaggtgcgctcccaggccccctgcttgggcgcgcccacctggaacctgggcgtagagctatgaaaatgcagacccgcacaagcgcgaggccacgcggggagacccccgcccgccaggagttggggcaggtccggcctgggcgggggcgtcgggggaggggtggtgacccggagtcccgcgcggcaggggagcgtcccccaacccccggcaggggcgagggccaccgcaggtggcggcgttggcagacaggcaagcggggactgaagctccggggtccttccggctttgttccgtcacgagccgagccctcctttccggagaagccaattagatctccgacggaggaatcatccgacctgcgtcccccacccggagggggctcggaangggcggggcccagcgcttggtcctcgggagcgcggcgc

SEQ ID NO: 147299 - DNA, 274 bp, Homo sapiens
catctttgcttggaaaaggcactgtccagaatgtgtggctaatggattgttgaaggagctggacatggcccaggcagtccggtgaatcagtgactgatggttgtttgtagtagctaatgctgttccctccccccaaagataaaagaaccaaaaaaccatcaagtggcttgatttgactatagcagcatttgtgacagaactgggaaccaaatgaaaatcaacttagtactactcttcaagagattttttttttctccagaggcttagcgtaggt

SEQ ID NO: 147300 - DNA, 370 bp, Homo sapiens
gccactccatcttcccacactgctccctcctcctcctgagccatcaccgcccacatccccctgctcccacctgtcctggctcaccatgccatctccatggtctcctggaccctgctgtcccttccttgtctcctccaagatctccagtttctcaggggccctcttttgcctcacccatttgggctccagttgtccccaggatccctcccccgacccgggggcccccttggtgcctgctgtctcagcagctgctgccttttcatctctctgcacattcctgttcccatgtgggcctttttctgggaggaacagaacctttccacacggcagctcccgggagagcaggagagagcaggggaacaagccagca

SEQ ID NO: 147301 - DNA, 315 bp, Homo sapiens
cctcttttttcccagcacagtgtgggattctgatgggatgggtccatcctacccggtacctcctgctcacagggaggtcagggctagacctggacttgtcggctctttccctcacctactgtgggaatcacatgcatcctgaagatgggtgggtgaacctgatttgggctcaaagaaggaaggaatttctgacagtcagggctgccagggagtagcagggagcagcctgtcacctgaggcatatgagctgaggatggagaattgcagaagggaccctgtactggtgggcttatggcttctgaggcctgctgtagg

SEQ ID NO: 147302 - DNA, 259 bp, Homo sapiens
gaatcgcttgaacctgggaggtggaggttgcagtgagccgagatcgcgccattgcactccagcctgggtgaaagagtgagagttcatctcaaaaaaaaaaaagattggatgcggccaagctgaatccagcatggccccctggaagagaccattggataggaggcaccaggaagtcccttttacataagaaaatataggctgagcgcagtggctcacaccagccttctttggctcacaccatgttggccaggctggtctc

SEQ ID NO: 147303 - DNA, 137 bp, Homo sapiens
caccaaggacaaacttgtgaggaagattgttggggtcacatgaggaagaatcagtgagtatctgaattgttcctggcttgttgttctggcttagctccagtttcttccaactagttctccagcccctacagtcctcg

SEQ ID NO: 147304 - DNA, 347 bp, Homo sapiens
ctcacaaggctagcctcactgaccccatcctctttgaggcctattttgggctcaatgaactggctgagggcattccggcatttctccaccacgtgctccatctgcaggtaggaggcggctgtaaggtagttgacgatgtccctaacagcgaattccaaggcgcccgtgtagcaggagaggagcaagtcggccacgatgcgtgcactgtgcatcagggagacctgcagctccgagctggggttcagcaggaactggtcccgcaggaagggtgagcaggcggccaagatgaccttgtggcctcgaaacttgaggctgtcggccacaatggtcacgtcgcagaaccgctc

SEQ ID NO: 147305 - DNA, 186 bp, Homo sapiens
agatatacagtgtctgattgtcctatttttagtgatggagatcacagagtaggttcaggtcattccagtctgatcattccactatactattcatctgatctttcacttaatggttttagtagctaatgataatgattgtttagaaccatgatgtcattaagtattgccaaatggtggttttctaat

SEQ ID NO: 147306 - DNA, 294 bp, Homo sapiens
aaaggggtggggtaaagaaaagcaaatatataatttactcttgttaaggaacgactgtaaaacactccacaaatacagtgtaaagtacaaagctagtgataagtattaatgacagacatttgtgggtgtacctatgcatgcaaccacaacacacagtataattaaaccttgcaaaatagccattgtttcaggactagaaatgatttacatcaaataagcagtgaaaggttgttacacacccctctccccaaacttcctaagttacaaggttagggcagggtagtattttttaaa

SEQ ID NO: 147307 - DNA, 695 bp, Homo sapiens
gcgggtgggctgggtatgagtgtctagcttggcccttcactgcaagactgtgcaaattgcttcacgtcttccagtttccgcggaaggagcgaattgtgcttacctctaagttttttgaggattaaatggaccacaacgtggtggctagttattatatcctgacaaaacagccaaaacctgattcttttttcccatttaagagtttatacaggccgggggccgggcgcggtggctcacgcctgtaatcccagcactttgggaggccgaggcgggcggatcacgaggtcgggagatcgagaccatcctggctaacacggtgaaaccccgtctcttctaaaaaatacaaaaaattagccgggcgtggtggcgggcacctgtagtcccagctactcgggaggctgaggcaggagaatagcgtgaacctgggaggcggagcttgcagtgagccgagattgcgccactgcactccggcctgggcgaaagagcaagactccatctcaaaaaaaaaaaaaaaaaaaaaaaaagtttataatacagggccgagagcggggggggcatacaggctttaataattcccaggcacttggggagagtccagaaaaggggcgggactcaaggagggccagggagttcgaaaccgggttggggccaaaaaggggaaaaaccacaggcttctattaaaattccaaaaccta

SEQ ID NO: 147308 - DNA, 280 bp, Homo sapiens
aggaaagatcccccagactgagagctcttgatgggaccagagattgaatagcctaccctatagcacaagatttctaccttgggattgggttagagctggctggcaggtgagtcacagaagtgacagccacccttgacaaccctttccactccagagagctctaatgctcactcctcttcccccatgctccctctctagggtgttgtggagggaaggagagaggtaagaaagtccttcccagtaacctcaaaatagtgagtgcgcctatttaagtccagca

SEQ ID NO: 147309 - DNA, 436 bp, Homo sapiens
tttctcccacttgatattcacaggtctctgagcagtctatcctctctccttccttgcctggggctctgaggagagtgacctgcttgtaggagggtttccctatgtttttccagggcagtcagtcaattaacacctggccacttcttttggaagttactcctcctgaacctgaatgaaacttcaggaacagtcactcagcttaagcacaaccatgtacaacaagcgcttctggagtcagtggcagtactgtcctgtctatcagaaacctgtctgatcagtaagtcttcttgcctcccttttgagtctagaggctgtcatcctgggtatacctttgaatctcctggatgtttttttaaagcattgaaggaagtcctgtcaccacccctagagattgcaaggtatttgatatagcatctagatttgatctacactggta

SEQ ID NO: 147310 - DNA, 360 bp, Homo sapiens
ctcttgtattttcctaaaatcggctgaggaaagtgtcagttgagtactgagagatccggaacgacaattcagagcctccctagacaaaagaaggtgtaccaaagtgaggcgctatgggggaacccttgtctctctgctcgcctcccagttcactcctcttatcctcttgctatttatcatcaaacgtacagggacgtcaaagtgaggcagcccctggaaggagaagggaaaagatcaaacagggatcaggtttcggctcaaagactataggagaggtcaggccaagggtttcacaaggggccaagagacaagagggaatgggcattcaggaacagccgtggagcaaacaagctcccctgc

SEQ ID NO: 147311 - DNA, 200 bp, Homo sapiens
catggatttgctggtgcagtacaactaggcttaataggctcatgtgaacacagtttactggaggaaataaaatctcaacattccaaataaaaacatcttctatgattagcagatcctagtagtattggtgaattaacatcacagcactaaccagaaataagagaccccagaagaaaaatatcaacacaatgattatgaaa

SEQ ID NO: 147312 - DNA, 249 bp, Homo sapiens
cacgatttgactacgcggctcgatctgactacgcggcttgtctgactacgcggctcgatctgactatgggctcggtagatacagactgaggccacaacactttgcagttctatcaacaggtggaatcaatttctctactccttgaatgtgggctggccttttgatgaacagaacgcagaggttacaaggttgtagaggttcttagctagaactcaagaaaccgcacagtatctacttatactcttagat

SEQ ID NO: 147313 - DNA, 354 bp, Homo sapiens
tttctgtgtcggggttgtattgagaatgtagattttgtctgatgagagtgtagattttatttgtagtgagtgcatgtggatttttatttgtctagggttttaaaagttgtatagtcatgaatggacactttttaataccatctatgagaaattcaatggcaaagtgttttcatacccatatgctaactgctgatgctttttataaaacattgttaaggtgttacttgccccaggaaatacaatgttttatgacagagacagtactgaaattcagtatttaagttctttaaataccagctatgttgagtagatattactttctcccaagagcctatttttggtttatgacatatt

SEQ ID NO: 147314 - DNA, 328 bp, Homo sapiens
cacctgccggacacgtccaggccgccaccctcccactcccatgtgctgccccagcttctgctccccatctgggaaccaccctccactctcccacagggaagtgcttgcttccctctgaggctctgagggcacccggggagggcagggcacagccttttgtgtctctacttgccgagacgcctgagatctgaggttggtcacagatatggtgcaagtgtcaggatgggagttgtgaccacggcaggcctgggccctacactcacacacactgcccacgccgcgtcctgcctctccacgaagtcccccttgtgcctccacccatctcctc

SEQ ID NO: 147315 - DNA, 296 bp, Homo sapiens
tcagcctcccaagtagctgcgactacaagcatgtgccactgtgcctggctaacttttgtatttttagtagagatggggtttcgccttgttggccaggctggtctcaaactgctaacctcgggtaatccacccactgaaagttctgggattacaggcatgagccaccacgcctggataactcccttctttctgatactctatcctgtgaccttcagttgcctgaatctccctgaatgctcacttctgtctcctcaactcagagagtctgccagactccacctcaattccccctccct

SEQ ID NO: 147316 - DNA, 321 bp, Homo sapiens
gctttaatgtattagaagttcatattgctcataaagttccttcttcctcatttaggcaggaaaatgaattgagttctcttctccaggtgactttgcctttttgacctgctatggcccagtgctcactttatctggtgattcattttcaataactccaacagtatttgttctgacattttaattaaaatatgaccactacctcatcctgatgataaaaaggcctatgtgtcagtgaaaactagcttttcagtgcctcagtgcacctgaggacccttctgagcacatagttcttatcaaagaattcctctcaggttctaaaca

SEQ ID NO: 147317 - DNA, 664 bp, Homo sapiens
gtaagcattggtagtccagttttgctgatgagagatcctagtgctccaagaggtaagtaacttgctcaggaccacatttagcaggtgacagggggataccagtaataaccacgcttctactactaaatgctgtatgtgaggtatattttattatccccattttgcaggaggcaaccaggcctgagaattaaggtcatttgctttggtcacgcgtctaataagtgggagaactggagttagagcccttcctcttcagtagaacattttgactgtatttttagtgaggaaagaagggttactgctctttggcctggaagctacagggttatttcagatcccaaataggcatacgtcggagatattgtggatttggttccagaccaccacactaaagtgactatcacaataaaacaagacacataaattttttggtttcccagtgcatataaaagttatgtttacactatactgtagtctgttaagtgtgtagtagcattatgtctaacaaaaagtacacaccttaaaatactgctgaaaagtgctaatgattatttgaacctttggctagtcaatctttttgctggagtgggtcttgccctgatgttggtgactgctgacttatcagggtggtggttgctgaagatttagtgtattattattatta

SEQ ID NO: 147318 - DNA, 209 bp, Homo sapiens
actcctctgactctgcctggaggacaatcttgaggcttgggggaagatgactatagaaaggtgctcatctgtgcactgttgttcacagccaaaggaagaaagaaaacctcgaagctgccgaggccaatggctacatgtccctgggctatgcaggaggctcggtcaagggtactggagaagtgagagtcgtctctcccctcacaccacac

SEQ ID NO: 147319 - DNA, 359 bp, Homo sapiens
acacaggacttgaagcaggctgtgagtgtggaatttctgaattcattgaaagttcatgtttctcatccacatgtcacagaattcatcttgtgttgttttttagggtcaaacttcactattactagtaaatgcctctgataactggtacatgcttctactcccttttccccagtggtcctccagagagcccactcctggatttgtcaggtggggtaggtgatactgatgtgaaagtcaatcttccgctctcaggagtgactcttcccactaaaagaccatattaacactaataacatctaagagtttatgcttcccaaaacattttgcatgtgtattaccttattcagttctcacaaaca

SEQ ID NO: 147320 - DNA, 226 bp, Homo sapiens
gtcattagagggaaggttactaggtcactaacttactactctgaaaagtgacttaaggatgggggaaactggggaagatactttcatttccgggccttagttttatcatctgaatgcagacatatgtatcttataatatgtaataagtgtttattatatatacagatatagaaaagatacaaccttctacacgggaagacacacatcattacaaaatgtgaaaata

SEQ ID NO: 147321 - DNA, 416 bp, Homo sapiens
agcttgacacaggaaagtgatcttccttatcacctaaaaggctgagtccctgtaagacagggaccaggctagtgttccagggagggctcgtaaagtcaacattagttccttaaaagtaacttgtacctgtttaagtaagcatcgttctcaaatatgacactctaggtaaaacgtcagttgctcaataagttgagtagctgggattacaggcgtgtgcccccaagcccaggtaatttttgtatttttagtggagatggggttttgccatgttggccaggctggtcctcaagtgatcctccctccctggcctcccaaagtgctagaattacaggcatgagccaccacacccagttaacagctatattttatggatggatggatgtatgtatttatgagacagagtttcactcttgcca

SEQ ID NO: 147322 - DNA, 500 bp, Homo sapiens
actggtttgtagagatataattgacataataaatagcccatatgtccagtgtgtaatttgacatttatatacacccgggaaaccatcaccagtcaagataatgaacatattcctcatccccagaagtttcctcagcctctttataatctttccctcctggccttccctatttgtccctaggcaaccactaaatctgctgtcactatgggttagtttgcattttctagaaatctatataagtggaattatacagtttgtatcctttttagtctggcttttgctcagcataattattttgagcatcctccatattttttcttgtgtcagtagttcattgccttttgttgctgagtagtatcccattgtatggatataccacaatttgttttgtttccagtttttggctattacaaataaatctgctacaaacatttgtatagatgtttttatatggacatagactttcatttctcttgggtagctaagaatagaatggctga

SEQ ID NO: 147323 - DNA, 250 bp, Homo sapiens
agccgagattgtgccactgcactccagcctgggcaacaagaccgaaactccctttccaaaaaaaaaaaaaaaagtaaacggtaggcagaaataactgctctaaagtcacatcagcacactagggctgcagcattgttaatcaggctctaattagggagtcttgttttaagagaaaactggtgcttcagaggaaccccagcagtctcctaactggttctgctatctccctattactgattctcctggtata

SEQ ID NO: 147324 - DNA, 110 bp, Homo sapiens
ttttttccccccccatttgcacaattgcgagtcttctgggaacttttcttttactgacactatggttttgcatgtttaaaaaattggcagacatcctcggaggtaacgca

SEQ ID NO: 147325 - DNA, 165 bp, Homo sapiens
atgttatttttaaaccaattataacctactgctagtaattatttgtaagtacctgcttgttttattaagcactggtcagttatataaaagaataatttgcaagaatgatacttggcaatgggttaccttaatgcttctggaataaacagaagcattaacaaaaca

SEQ ID NO: 147326 - DNA, 238 bp, Homo sapiens
tatcagctcgtccactcatttacaaatgggcaaaagctctaaatagacctttctccaaagaagatcatgaggcaggcatggtggctcacgcctgtaatcccagctccttgctcacacggcatacaattaactcaaaatggatcaaaagactaaatgtaagagctaaaactagaacactcttggccaggcaccatggcttatgcctgtaatcccagcaacgatgggaggctgaggtagg

SEQ ID NO: 147327 - DNA, 521 bp, Homo sapiens
cccgctccctctgccccactccgcccctcctggtctctctgcagaacctacgattgttagtagaaacagctggaaggttcttttaatgtggccctgaggtaataccaaaaagaaatattttaataaatttttctctctatcaaaggaaaagccaagtgcaatatatttggtgtaattctttgaaaaagggcccagctgttttcccaaggagctctggtccattccatcttgtgcagaagattcattctgacagtggaatataattagaaatgcgtcgttcagcctgcccccacccccaaacacacaaacacacacagattcaagaccatggggaagtagaacacagcagatcttcctccaaagagaccgccgcacactggagtcacctattcgtgcggccagttaggacagcaggcgccctggacagccggcctctgctgtgtccctgcacccctgattagggcagcttcggacggcttataattggttccagttaatctctgccgccctgagaactgccg

SEQ ID NO: 147328 - DNA, 329 bp, Homo sapiens
ggtggacttccctacagtgtcaaagcaacacgtcatcatgctactgctgagcaaaatgatcctcaagggcttgcccggctacctccaccacatggtgtgaactctgcctccatctgtgccaatcagaccctcacattccctcatccaattttacctccactatttttcaacacttagactagctgggttggcttctagctctttcctgaatatgccacctccacctccaccacctgactctaactcctgtctggcccacatgccaggtgtgtctacactccatccatctttcatctcttgcatctctcctgatgcttgctctgcttcct

SEQ ID NO: 147329 - DNA, 189 bp, Homo sapiens
cttctcagtcaccgctggtatctaccctctagtcttagctcaattcaaaggctttagttgtcacaagtgtgatatcccaacaagggaagcaccaccctacggtagtgtccttcacctttctgcaaatggattggaggctgcaaagcagaagacaaaagcaaacagactcagcaggaactctcccttccc

SEQ ID NO: 147330 - DNA, 448 bp, Homo sapiens
cagcaaccccagtgagggaaggctaccaggggtctggtgtcacagaagtctagtatctgtgtggcagctaggactgagaaagtgggacagccactgccatgtgggctctgcacagcacaccaggactgcctgatccacccagcaacccctggatggaggtggaacagcagtcattcttcccatcctatagacaagagtctcagagaggtcaagtgacttcccaaagccacacagccaagaagtgagagaacctgtacctaaacctagctctccagactttccaagtttcccttcccgtcagtcctgttccaaggcttcaaaagctgctgcctttggaatcagcaggatccttcccaaagggtcattctctgagtgctgggagctttgccctctctctgttctgactgcccagctgttgacagtgtctttggccacaatggccaggatg

SEQ ID NO: 147331 - DNA, 355 bp, Homo sapiens
ggccccacctcttaatactaccacagtggggattaagcttcagcatgaattttggccccattcgagccatagtaggcacttaatggggtaattcttgtttgacttttcaaagccttgccagattgatccttcattttacccataaactgctgagactcaggttaagaaacttgcccagtttgcgggtttattgcagcaagacagccagacccacatactggggtaggacaggctctgtgggggcagatgcgacaagcagaaaccaaagtagcagaatagaagtgcaagtccacagaaaagagagttcaaggaggctctgcgtctccatgtctcctgccctgctcaggaactcacc

SEQ ID NO: 147332 - DNA, 565 bp, Homo sapiens
gaaatgtcttttctttcaagtggatgtcgttttttttctaaagaattgctttgggcggagttgaaccgtccctggattgggacttctgagatctgagattttatcctggccctgcccccttaccatctctgcagcagtgacttccagcttcgtgggcctcagtttctctattgtaaaatgaaggagcagtgtatgacagcagtttcaaacttcagtgtacattcgattcaatacttactgacctcgtactgtgggggccttgcagggttctaggaaacgggtttggtataaactaggctaacaaagtccctatcctcatggaatttattctaaggtggggaaagagacaataaacaagtaataaattaaaaaaaaaaaaaaaaaaaaaaaaaaaaaaaaaaaaagagaaaaacaaaaaaaaacaaaaaacaaaaaacaaaagaaaaaaaacataacaaaacaaaaagaaacaataacacaacaagccaacaaaatacaaaacaacgcaccgaggcggcccgcaccatcaccaccgcctgggccgtggcgatcattcgtgcggagc

SEQ ID NO: 147333 - DNA, 706 bp, Homo sapiens
gaaatgtcttttctttcaagtggatgtcgttttttttctaaagaattgctttgggcggagttgaaccgtccctggattgggacttctgagatctgagattttatcctggccctgcccccttaccatctctgcagcagtgacttccagcttcgtgggcctcagtttctctattgtaaaatgaaggagcagtgtatgacagcagtttcaaacttcagtgtacattcgattcaatacttactgacctcgtactgtgggggccttgcagggttctaggaaacgggtttggtataaactaggctaacaaagtccctatcctcatggaatttattctaaggtggggaaagagacaataaacaagtaataaattattgtctagtatctatgaagacaatagttaaactgtggtaatcagttagactagatgggctacttttgtttgggtgataagggaagacttctttgaacgcagatgccaaagtattaggaatcaggctcggtctgggactggacccagaaatctgcgtgtctagcaagatccctttggtgcttatgacttcacttggagaagtcctggcttctgactggctgtgatcccacgtgctcacataacataacagcctggaatgttggccatctccaaaacaagaattagagcacacgacctgctggatctaggagaagactgaatgaaaagcctcttggaact

SEQ ID NO: 147334 - DNA, 192 bp, Homo sapiens
tgaggccccaggcaaggagaggcaccctctttccctccttcttcagaatagggagtgaggagagaggaagaaagagggaaagaggactttacataaaggatacataattttttggccttttttccactatgttgaatatattttcctcacagtgacatctatatgatgtgttttttttgttgctgttttttt

SEQ ID NO: 147335 - DNA, 363 bp, Homo sapiens
atcctaagctgggactggggtgaactctcattcagcctgtttctccatctctctttcgtctcgaaactcattctcatgcccacagttattggggcataaagattccttaaatggcttcctccagagaaaaatacgtttaaggcacttccttagtggtttgagccctgggcgagcccctcctccactccgtttattttccactatgtatttaaatcttccccgatggtgcctgtcttctcgtcactaaggctgactttctgtttttggggtgaaacctgtgtctccttcaacctccagtcactcagtggattttttttttttagattcataacatattttattttgacttatctaactgatgtc

SEQ ID NO: 147336 - DNA, 536 bp, Homo sapiens
ggctcggtaccagttcgacggagactctctcagagttccagatctcagtctgcattggttgagcacccagtccatgcagtccctgggaactctgagatgagtccctagtctggagtcaggcagctagagggagaaaggtgcttccacagaggttctgcggaagtcctgcccggggcttcctgaatgttgccccagggagtaaggagtgactgagctgggtctaagatgacgccattcagtacagtagccactggccacatgtggctgtttgtgaatttcaattaattaaagggatgagttaagcttatccttggcactaaccacattcaagcactcagtagccaccgaaggctggtagccgccttgttgggcagctcagactctagaacatgtccaccacaacaggaagctccatggacgacagacagcgctgtccaggaggatagacttaagacagaggtgcagtgaggacactagctcagagcccacaagtgtaacagtgcaggagagtctccgtcgaacctggtgccgagctc

SEQ ID NO: 147337 - DNA, 182 bp, Homo sapiens
ttggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcctgc

SEQ ID NO: 147338 - DNA, 780 bp, Homo sapiens
actgtttctccaagccatcacagctgatatctcctggtgctatccccaaactgccactctaaactcttgaagtaaataaataatctttgctggcaggactacgctgaatctccttaggcactctctaatcagatgtcctaggtcctcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaagatcttccttcagcttaatctctcccactctaggttcccacaccgcccctaatcccgcttgaagcagccctgagaaacatcgcccattctctctccataccaccccccaaaaattttcgccgccccaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaagtgaaaaggacctgccccaccttaactgatgacattccaccattgtgatttgttcctgccccaccttaactgagtgattaaccctgtgaatttccttctcctggctcagaagctcccccactgagcaccttgtgacccccacccctgcccaccagagaacaaccccctttgactgtaattttccattaccttcccaaatcctataaa

SEQ ID NO: 147339 - DNA, 247 bp, Homo sapiens
atttgccaatgttttctcccatctgtgggttttcactctcttgatagtcatttcacaggatttccgttttaatgaaggttttttgttcttgcttgtgtttagtgtcatatccaagaaactgttacgtaatccaaggctacagagacttacctaggtttcctcctaagagttttatagtttcagctgctacatttatatctttgatccattttgagttaatttccatattaactcacacacacatatg

SEQ ID NO: 147340 - DNA, 338 bp, Homo sapiens
gatattttgaagacatcatatgtggaaaaaacagtttctccctagagcagagattgggacttctaggacaactttcccagaggagacgggaagtgtcagtggtaaggaaatgacagagtgggtggatggtgtggaaagctatcacagacaagaataatttctattaccagcattaccaattatacagcacttttcttgttttctcacttgattttataataaccccatgagcaagtaagggagctccagatcacgaaatggggctcagaggtgaagtgacatatggaagatgacccagctaacacatggagaaactgggattgacttcagacctttga

SEQ ID NO: 147341 - DNA, 131 bp, Homo sapiens
cgtgagccaccgtgcccggccgggtgtggttttaactgagtctcctaggtcttaatgagggctcctttggatattgtaagtaataatcatggttggctgtaacactcgggggggggtggcatcgataaaca

SEQ ID NO: 147342 - DNA, 269 bp, Homo sapiens
aaaaaatgtatttaaataagtaaataatatctgtgctagttggtactcggtggacatttcagaggtgtgtccatactttatgtattttatcactgtttgaaatggccaaagaggtggattaaactgggtcactgatctttcatgtgaagaccctcaaaatgcagatgaaatcagttttattttcagaaaagataaacttaaaaatatgttctaatctaaaactgagaaatcccataagtctggcacagtcggtttttctctctagcgtc

SEQ ID NO: 147343 - DNA, 300 bp, Homo sapiens
caagccatgtttcctccactccatggccatatcttgaagcttcactcttctgggtgatgtaggttggacccaggattttgagccagagcctgtggctacattggtgggtgactgctgtcagagcaaggaaaaccatcctagggatgggctcgacttacagaggtagctttgtttgtttgcttttgtttttgaggcaagtcttgttctgtagctcaggctggagtacagtggcacgatatcggttcactgcaacctctgcctcctgggttcaaacaattctcatgccttggcttctcagag

SEQ ID NO: 147344 - DNA, 316 bp, Homo sapiens
ctgtaccattttatattctcaccaccaatatatgagtaatgcagtttcttcacatcctcatcaatgttgtcactattttttgttttagccattctgataggtatgtagtaatatctcattgtgagttgaatttgcatttccctagtgggtaatgatgttgaacatcttttcatgtactcatttgtcatctatgtatctttggtgaaatatctcttcatgtcttttgttcgtgttccaattagatttgtttacattgagtttttaaagctacttatgtagtcgagatactagtcctttgtcaaatatgtcatttgtg

SEQ ID NO: 147345 - DNA, 302 bp, Homo sapiens
cctatggagcatacaagatgctggtattaagcatgtgacattatctcattaattgtcatgagccctatgagagggctgaaccttcatcatccccttcagagatgaggaaactgaggttcagaaaggtaagtgactagtccagttatgcactttgcatgtggcagaacagtatctgaaatcagctctgtccaattccatagcatgagctcttaactgttatgctccacttttataaattataattgattcatcaagattagttaaaaaatttttaaacccacaggcattctctgctgtatgca

SEQ ID NO: 147346 - DNA, 269 bp, Homo sapiens
accacaattgcaccacaaattcagaaaacacatttcaaagctacaggacaattactggcattagagaaaccttacgtaaatcacttaatctcttggtaccttggttttctcaactgttaaatgaaagttttagaagagatcatctgaacttcatcactttgatctatttccacaactctatgatttctccaaatcttttaaataaaaagtctcttagctattcctaagtgttgtcctaaatctttaacagggatctaaaatatataaaa

SEQ ID NO: 147347 - DNA, 463 bp, Homo sapiens
atccacgtgccattgtggttcgtgcccgtaatcccagccactagggggactgagtgcaggagaatcgcttaaacctgggaggcagaagttgcagtgagctgagatcacatcactgcgctccagcctgggcaacagagtgagactccttctcaaaaagaaaaagaaaaaagtggtctagagatgggcagcattttgacaagtagaggagtgagggcatttctgaggaggggttacccccattggcattgctgtagtttccaaaaattatttcacggagagaaggggagaggagcactatgaaccacttgttgatggcattgcccatggaactgtttcctctgtagatattcttcctcttacctgccatcaacaaggtgagtttaattgaattacagtggacaaaatgaaaacacatgtagattggaacagttaagtaagagaactttgagactctgtagaagga

SEQ ID NO: 147348 - DNA, 250 bp, Homo sapiens
ctgtttagaggacccccatttaggtcatggcattgctgtagtttccaaaaattatttcacggagagaaggggagaggagcactatgaaccacttgttgatggcattgcccatggaactgtttcctctgtagatattcttcctcttacctgccatcaacaaggtgagtttaattgaattacagtggacaaaatgaaaacacatgtagattggaacagttaagtaagagaactttgagactctgtagaagga

SEQ ID NO: 147349 - DNA, 439 bp, Homo sapiens
cccaactcccctttccggagggggcagggcggcctggatttgggggccggcggaggaggcgtgggggctgggagttaaggagacagggctttccttggaccaaaccaacccagcaatgccacattggaagtgggtttgaggaaccgggcctgcgtgctcatttgaaaaaaaatcagccaaacagaaaggtatgaagaagaaacacctataattccatccttccctgacttctccactcgtaacattttgaacagcaaagcttggcacagaactggcactcaatgggaggaagagagggagggaaggaaggaaggggagaaggggagggagggtcgatgatgtggacaacgtggcgtgacacgaagtgcccgcccccttgggctgaaagtcacaggcaggcccgcagagctgacgggatataacagacttggatttgggg

SEQ ID NO: 147350 - DNA, 343 bp, Homo sapiens
tcggctggccttagttcacttatacatctaacattcacacgactaaaatagtccccatgaagccaatagtgccattggtatcacgtagaaggatacaagacacgaaacaccgtgtgccagcagatgtatcctgcctgtgtctttagcaggaatcctcacggctgtccacacttcaggccaggagctattctctggatcctgctccccaagtgacacctcacgtgcaaagcagcaaggtcacatgggtgggcacagggctaccaagcttagaagcctgtgtcccaaaaagacactgagatttcttttaacagtcccatggtcaaagttttcaagggtcccagca

SEQ ID NO: 147351 - DNA, 287 bp, Homo sapiens
agcagtgtccctggtcgatccccggtagattccaataacaagctgccaatcatgacaataaaaaatgtctgaaatattgccaaatgtcccctaagggtgcaaaactgcccccagttgagaatcactgatcagtagagatgaaaacagaaaaagaatctgtaggcattttgtgacctaaataagacattcttatctccgtgttgctagcttttattttgtggctgagtgaattgttttcagtgtgaagaccaatggtacactggatttctatttaaagatggtttcaa

SEQ ID NO: 147352 - DNA, 367 bp, Homo sapiens
ataaataaacaacactgtaatcttccacacaggattctgtcacctggagaagggcaaatgaatagtccaatacacaaaaaaggctgttttgagacggagtttcgctcttgttgcccagggtggagtgcaatgacgcgatctcggcttactgcaacctccgcctcccaggtttaagcaatcctttgcctcagcctcctgagtagctgggattacaggcatgcgccaccatgcccagctaattttgtgtttttagtagagatggggtttcactttttaaaaaaagttactttggctggcctgtaagacaaatggaatatagaccaattcctaaccctatatctgtgaagcctgccctacctctgaactt

SEQ ID NO: 147353 - DNA, 184 bp, Homo sapiens
tttgaaaactgtactgttgaggcatgggggtcacctatttcagtaagaaagacaaatgaggtccaatgtagagaaaaaattgaggcaaattaaaaacagcttattaaatcaaaacctcagcttttccttctaatgtcctcaatcttgttctctaactcaaactgatataagccaattatatcag

SEQ ID NO: 147354 - DNA, 515 bp, Homo sapiens
aatcagatgggatattcctatgacataaaatgatgataataggacatgagagttaaagggattctaatccaaaggacaagtttaagaggctgctttatacctccgtatgatcaattagttttcagtacgtttatgtttatttagtctgcttctgtcacagaaacatagtaggaagaagttaaactagagatggagtccaacatttagacatcctaaatgttgatactgggcatgcatgggttagggtaggaaatgtggtatgagaatagggtgctgctgggggcatttggtgaggatggagactggagatgtcatatgggggatgaatttgaaccaggcagtacttagcaagaggtagtgggagctgaattagcgtggtagcaataaggaaaggaagttaccacccagagagaacttgatatgcctgattgggtgtggaaggtgagagatgttttactgcctggatggtgcctttcacagacatcatgataaagtgggtgggagttaggtagaga

SEQ ID NO: 147355 - DNA, 376 bp, Homo sapiens
gaacttgactacatagtcttctctttctagttgaagactggattcttcttgaaattgactgcatagtcttctctttctattctttgaaatcttatttggatttccattaagacactgatgttcaggaaatgctatcattccttacaagcaccatcagcataataatttacttgaatgaccatatgtggttttaattctgtattttcagaggctttcagaaggatgttttcttgcagttttactgctttcatgcctaacatcttagtccaatctggatgctataacaaaaataccacagactaggtagcttaaacacagaaatttatttttccatagttctgcagtctggggagtccagtccaaggtgctggcactt

SEQ ID NO: 147356 - DNA, 822 bp, Homo sapiens
cctgttctgcaatatgtggaccaagcgatatcgaggcacaggatgattctgagtgatgaggggacactgattgtgagagctctttatgagccatataccactgagatgtccatataccactgagatgtccatataccactgagatgtccatataccgctgacatgtccatataccgctgagatgttcatatactgctgacatgtccatattccgctgagatgtccatatactgctgacatgtccatataccgctgacatgttcatatatcgctgagatgtccatataccgctgacatgcccatataccgctgacatgttcatataccactgacatgtccatataccactgaaatgttagctgtcattgcttccctgaaaagttggtgtgaacccaggagggctggctgcacactgctggtgttggggggatgagagagccagggcttgctctttgttgttgttgcttgtgcttagtgttcaggtcacctgtagcaggcagagtgtggtatcggtccccgaatggaacagagtcagggctgggatgcctggtgcagatggaggagggagcccttagctgggccggaaaacctcgaagggtactttgtgtgaaaagaggagtgaaagaggaagtggaaaggtactgttgacctgtgtccttccccagtcaccttcctctgaaagctcctcccttagtatgaatgaggtagggatgccggccagcaggcaggtgtgttccccagtgaggtgaggtcctcatgtcacagcagaatgacaccctggagaataaagttcgggaatgaatcaaggctcctctaggctga

SEQ ID NO: 147357 - DNA, 487 bp, Homo sapiens
aacacaaggcaggctgaagtgccgcagggacacagcacgttgcaggtgggccctgggggcagatggggctccatctggcactaccacttacaatggaatggcaacgaggcccaaacctaagttagaacagatcaagagggccttggattcaatgcagagaagtgtgggctctttcctgaagatgggggaactgcagaggttctggaggagccatgaccatgactggcctgtgtttaggatgagggctctcctggctgatggagaagggactagatgaagcttttcccccagtgttcttggctctgggaattttccgcctcctccttccatggataattatccttcctaagaaactgatcagatgggaaactgcaggaaattgtttgggacggggattgtgtaggagttgaggggagagtggagaggatgtagccggagaggggtatccgtgccaagcagcaggtggtggctcccttcagaggggagg

SEQ ID NO: 147358 - DNA, 295 bp, Homo sapiens
gagtctggagtcagttctgtccctcggtcctcgtcccacaggcggttggttcaagcccccctgtaaattcgactaagctagatgaagcttttcccccagtgttcttggctctgggaattttccgcctcctccttccatggataattatccttcctaagaaactgatcagatgggaaactgcaggaaattgtttgggacggggattgtgtaggagttgaggggagagtggagaggatgtagccggagaggggtatccgtgccaagcagcaggtggtggctcccttcagaggggagg

SEQ ID NO: 147359 - DNA, 215 bp, Homo sapiens
caactttaagttcttttgggtacatccccacaaatggtattgctgggtcatacggtaattctatatttagttttttgaggagttcctatactgttttctacagtggctatacaagttcacattcctgccagcagtgcacaagaattccttttcctcgcatgcttgctaacatttgttctttctagtttctttcttaaaaaaaaaattgccatcct

SEQ ID NO: 147360 - DNA, 391 bp, Homo sapiens
ccactcccttcgcctgtgccacattcgtactggggcgaagggagtgggcacaggggcgaagggagtgggcacaggggcgaagggagtgggcacagggaccagctgccgggtggacagtactcctgggggctgcctctccggtatggggtccgacccccttctgcaactcactcccatgacacagcatgagggcctcagcaactcgctctgtcgcccgggctggagtgcagtggcgcaatctgggctgattctcctgcctccgcctcctgagtagctggtacaggtggacgccaccacgcccagctgatttttgtacttttagtagagacggggttttgccatgatggtcaggctggtctcgacctcctgacctcaagtgatctgctcacct

SEQ ID NO: 147361 - DNA, 687 bp, Homo sapiens
tttgtcccatgtacctttttaaaattctgtctcacaaaagaaatataagagctaggtgtccaaaatttataaaatacagaaggtgatttcctaatgaaaagagagatagtgagaaagatgtaaaagaggataggcagtgtgggttaatagattatgttagcaaagtagtttgaataggaaaagactttagagaggagcccaaacattgaggagttatgaggcccaggagatactttatgcctaggatctgattctagctctgtctcaaatgcatgtctctgtgggtccacctataaaaatggaggagctaaattagataatccctgaaaggattttccaggtttatgatggaatgaattgggcaaaacaggaagttgcaatttagaaaagttctgcctaaagcaaatagctgtggtactgactgcccacattctctgggatgattttgatgtcagatactgttcaatcatccctctgagaatatttacatttaccaaactgtttccctgttctgctttagaacccttggctgctttaaagtctgtgagatcccataatttatctgtaaatttcattctttgagtctgccttatagaaatgtttacagttacagttctgatgttatgataatttgtaatgtaaatttgaaataaattatggagtatttttgttgtttaaacaagatca

SEQ ID NO: 147362 - DNA, 343 bp, Homo sapiens
ggctccttgttgtgtgttgttcccttccatgtgtccatgtgttctcatcgtcaaaaaaatttgtttaatgcagaggaatgttgaagcaaaatctgaggttataaataataattttaaaagaagtaaaatttcagtcaatagaaaagggaagtataaagcgttgagagagagagcatcaggaagaatagctaatggatgctgggtttaatacctaggtgatgggttgatctatgcagcaaaccactatggcacatgtgtaacagacctgcacatcccgcacatgtaccccagaacttaaaagttacagggaaaaagttttttgcatgtcaaacaaatgaaaaaa

SEQ ID NO: 147363 - DNA, 452 bp, Homo sapiens
ctttagtcagcttatgactaaacaggtgctgataaacagaaagcctgggattgttagaagtctattacttcattctatccaactgtgtctataaatgtcatagaaggcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcagccgcctgccttggcctcccaaagtaccgagattgcagcctctgcccggccgccaccccgtctgggaagtgaggagtgtctctgcctggccgcccatcgtctgggatgtgaggagcccctctgcctggctgcccagtctggaaagtgaggagcgtctccacccggccgccatcccatctaggaagtgaggagcgcctct

SEQ ID NO: 147364 - DNA, 475 bp, Homo sapiens
acacaacccctcacacacctcaggaacccatataaggaacccacacacctcaggctcatacacacaagccctcacacacctcaggaatccacacacaacccctcacacacctcagggtctcacacacaatgttgacacacctcagggtctcatacacaaaccctcacacacctcaggacccacacaattcatcacacttctcaggacacacataaaacccctcacacacctcaggggcccatacataacccctcacacacctcaggactcacacacaatcctctcacacacctcaggactcacacaacctctcacacaccttaggacccacacacaaccactcacacaccttaggacccacacacaacctctcacacacgtacacctcatcatgtgatcgtggggatgtaatacaaccccacgatcacccctccccaaatcaagcccgaatgatatgacctatacgcctacacaa

SEQ ID NO: 147365 - DNA, 378 bp, Homo sapiens
ttttaatttttgaggaatctccatactcagatgatcttatttccttatttttcaagtgtgtgggtctatgtgtggttttggcagggaagcgagtctctgttattcccacatactccccatgactgttaagtgctgtgttagaagcatatggtttgatgagaattctaggagagacaaatgtttcaaaggatctctgtattttcaccggcaataactaataaatcatctggcttcgctgttccccctgtaaaaattataaaatggagaaaataatgcatgttttatcatcttggtaaaatggtcaacataaatgcagaatatttgaaaactccggggttttcaaaataagattgtcaataaaaatttataattgctaat

SEQ ID NO: 147366 - DNA, 504 bp, Homo sapiens
ttatggtcaacagtgtggatgttccttaaaaaattaaaaatagaacgaccacatgaccaagcaattccacttcttggtatatgtccaactcaaggaaatttaatcagtatgttgaagatctgcatttccatgtttattgcagcactattcataacagccagtttgtttttcttaaaaaatagttgtccttgaccatttttgaaacgttattcttacatcattttaattgcattacttcttaactcatcctttcacaatttctttagctaactcttcctcctgtctgtcaaatatctgttttcctttaagtgcagttcttggttctgtctctttctattctttctctcaagtcttagtcacttaaaaaattatatgttatagacaatttccaaatctatgcatctattccttaccttttttgatctagttataactccaaatctaacttacctaaaatctgtaaatgttatgtactttcgttctttgagcttgaaaccttatttt

SEQ ID NO: 147367 - DNA, 189 bp, Homo sapiens
ctacctgggtacttagctagatgacatgtcccagttcctagctggaacaggtgaccatgtgtcagttctcattaatggaagtgagcataagtgaagtgtgccacctccaggttagaacttggaagaaggtgtatgcctcctccatgctttctctcccttcctgccagctgcaatctggacgtagctgcc

SEQ ID NO: 147368 - DNA, 184 bp, Homo sapiens
ggaatgtcatgatcagattcgtgcttttgaaaactcaccagctttgagtaataggatggatttgatggggaaaaggctgttaggaagcagggaggttggataggaagttgctgcagaccaagtaagagaagtccttggggaaaaggtcagcttttgctgaccatagaataagaattttgcaaga

SEQ ID NO: 147369 - DNA, 457 bp, Homo sapiens
gatcgccctcccatacacacttcacagtattttaaaaagtatagtctgtggactatctgtatcagaatgcacagtctgtgggctctgtaacagatccacttaatcagaagatttgaaaatggtaccgaggaatctgtaattttaacaagtacccaggtaattgtatatccatatgaagtgttgaaaattactgtttgtaaccttgtcgatagaaataatcttcaacccagtcttagtaggcaggcaggcaggcaggcaggcaagtacttgcttatttaagattcgttacttttcataattgacattggagcttgcatttccttttgcattgatttaacttctggctttaatctctgatatactgtgtcctccatgttaagatgtgtcgatgagacagcagaaaatgaaacctttgtcctctttccttacattattttgtgttttcactattagccac

SEQ ID NO: 147370 - DNA, 351 bp, Homo sapiens
gggcctggctctcttgcacctgtggttttgctgggtgataatcttctttctccgttttaaaatttatcctcttctttcattgtcatatttactcatttctttctcttttttctcccttttcattgtgaaggagaacttagagcagtgttttctgttcttctgccaccggcaatggcttttataggcagaaagaacattggtgtctctagtgtggaacacttataaggcattttaaaaacatttacgtctgtaattggaaaagggcaccataggaaaatatgagctttaatcattaactttctagaagtttataagatgggagtattttctcctgaaagaatacctatggtc

SEQ ID NO: 147371 - DNA, 450 bp, Homo sapiens
gatttcaaaggtttaagagaatagatctcgagcagattaggaaagtctggatattaatagcagcaaaatatatggaataataggaggtgagatcaaagatattttgctatgcttaagcgcaggagaagattgaaaaacaaaactatggagtgaaaaacttggaggtcaaagatacatactctattttctccaaatcagcttttttcattcaaaaccagcaatagccaaacagcttcaaaatgactttttaaactttttccttaagttatactttaaaattaaataaaatctccacaggaaaactactattagatatttcccttttgaaatgtgtaattataatgtcttatgttacaaataaataggcactaaaatggcattaatggtaaactcaatgttaatccaattaaaaataataggccaggcttggtggctcccagcactttggga

SEQ ID NO: 147372 - DNA, 317 bp, Homo sapiens
ccatgcaatgagataggttggtgttacctaagtgcataataccactatgacattattctttatggtagaggtcaacataagactgaattgcaatggttatttctgctaagaaaatactttctctggacaaaagagggcatttggagaaatgggaaccaagagggtatagaatggaaattatgctgtgttaatatgtctccagctatgaagccccagccattcctattaaccttgtgtcaatttgtattatttagagacagtcaattatgtgaggtacattataatttttttaagccagcaatagttggaggttgtca

SEQ ID NO: 147373 - DNA, 518 bp, Homo sapiens
tcaaaatgatgcatctcacagtctaataaatgcagcaatctgtgtaaatctgcatactgtagtctattttcagaaaaatttccaactcaaattatgttgctgattcctgttcggccttcttccttggttttatgctgaacctgtactgctgatcagggatgaagtactgaattgggggtaagaatggagaagaggcactgagggagacagacatggctatgcctggagtaggatcatatagttccagaaagactgaggaagaaagaagtcctgaaatcttcacataggttatcagtgatgcacaggttatgaactatagaaaagtaggctgggcgtggtggctcatgcctgtaatcccagcactgtgggaggccgaggccagcggatcacctgaggtcaggagtttgagaccaggctgaccaacatggtgaaaccctgtctctactaaaaatatacaaattagccaggcgtggtggtgtgcgcctgtagtcccacctactcaaaaggctgaggcagga

SEQ ID NO: 147374 - DNA, 296 bp, Homo sapiens
ataaataaggaacttgccccaggtcacgaagttagatagtattagaaaaggaggaagatattgcagcccaggttggactgctgcaccccacagccctacccaaagtccacctacacaaggaggcctttgcttcctgcttctttcagttggggtcctgactcatggacttcgtatgttcccttttcctttctcactgaaatgaaaactctcacacagtatacccatgatcatgctgcaagagtagaaattaagtttatgaatgacacccttcacttactgcccctttctctcataca

SEQ ID NO: 147375 - DNA, 742 bp, Homo sapiens
gatgggacttggctttctggaggagcagccacattagccggggtgacctcggtcaatgctgcggggacttcagttggcaccactgtgactgtgctttccaaatgcttttcatgttccccctgcttctcatctatacccttccttaccccacccaccccaagcacagggctgcctgctgatgtcagatggaagacttgaatcagaattgccacctggtagaaaagtagaccatccgaaaggtggccatttattcattcattcagttggtggttatttactgagcatctactgtttgccagatgctgtgctgggtgttaaggagacaaaatgtacaagctagcatccctgcccccagtcacctgtgtgcagggaggcagataagaatatcagcttgagagctggaaggtgcaaaaaacccaaatgtccaacaacagatgtatggctaaacaaggtgtggtcaatccatgcagtggattatttttcagccatacaagaatgaagtacttaccaaacgtggtggcttatgcttgtaatcccagtggcagtacaaggttggaagaagtctacagccatctcccaggtacattagaagcccagagggtcccttacctcaacctggaggtttagtggcttccaaaaggagaggaatcttgactagcatcatgaggaaacaatcggtgcaggaaatgggagagggtgtgccaagcagagggaacagcacaaggcacagagacaaacgcaa

SEQ ID NO: 147376 - DNA, 802 bp, Homo sapiens
ctcgtagacatggacagatgcagtggttaataatggacagtgggcatgtctgaaatggtaccaccctttcttcctagcccagtagacagacctgcacagaatacgctagttctttctgctgacttagcaagcctgtaacaggatagaggcttctaatcaaacatgatagaaaaagcagtcacggtagatatctacaagcctgccaccagggctgaagtctacacgtgcccagttcttgccccactgagcaactgacactgaagttaccaccagggcaatgtggaactcaagaatgggaaagagctgtccctctcaaccctccccatccccaagcctgcgagccaaaggctcacaggtacccggtgaaaggccaaagaatggatcaggagcctgaggctgcaggctgagatccagaatgaccctgaccacctgtgggccctctggccttcctgagcctcagtgtgctcacctgtaaaatggagacgattgtacctgttctttatttttagggctgtgacaatgaaaggagatgccaaagatctttgtaaactggagaatggttctacaaagtcttatgctcacaactgcttttagatttgatatttttgatctctctcttcccactttagctaaattaagcaaagactttcaggggaaggccctgctggaaagactctactgtttgaaagcaaattgtttccctcacccaggtctccatggattatgtacagaaaagcagtggactctgcctcctatttatctgggttttctctgctctattttgtttttattttcttctatt

SEQ ID NO: 147377 - DNA, 460 bp, Homo sapiens
atctaataagagttcactcacatacatgtaaaatcagcatattgctgcccattaacatatttaagctgtaagtaatggatctgcccaccttatcctctttttggtttctcagtattcactttggaccccctaaaatcccttgcctttcccatatttctgtatttacagagtacaaacccaattagcttaatagagtcttggttattgctttattatttatcaattttttaaaattaaataacaattgtttatattaacggtgaacaacatgatgctttgaaacatgtatacatttttgaatggctaaattgtgctaattaacatatgcattacctcacatatttatgatttatttgtggagagaacacttaagatctaccgtcttagcaattcgcaagtatacaatacattgttatgaactatagtcatcatattataaaataggtatcttagatttatt

SEQ ID NO: 147378 - DNA, 519 bp, Homo sapiens
ctgtctcctgctaaagaaataccttctgtctatgcaacttttctttccccctttctatacctctcttataagggcaaagcatttatagcctctgagttctaagaaaccatgggagcacggtgatctgctggtgagataaccgagataacagggcccatggtccaggtgccaacaccgaggacccttgttcctttatgtgcacagaaagaagcattaaagagagttgtctcatttctggttgggcgcagtggctcacacctgcaatcctagcactttgggagtccaaggcgggtggatcacctgaggtcaggagtttgagaccagcctggccaacatggtgaaaccccatcactactaaaaatacaaaaattagctgggcatgttggcgggtgcctgtaatcccagctactcgggaggctgaggcaggagaattgcttgaacctggaaggcagaggctgcagtgagccgagattgcgccgttgcactccagcccgggcaacaagagcaaaactccatctc

SEQ ID NO: 147379 - DNA, 335 bp, Homo sapiens
agttccattattcaaggaatcgaagtaaaattttgttttaagagagggtggtgctaagaaataaagtccatctgtaggccagggttaaaagaaaagaaaataaagtgcgaataatactgtacggctgccttggtgtatagtggtgagcatagctgcctccaaataacaccgtacaacaaagtatttacctttttaaaaatacatatacgttttgcactgaggctctcggcttcaggaggctgataaaacttcaagttcctttgctacagaccaccagggatacacctgtccacccacaaagaagtgaggtttactagctgcggcaagggagacac

SEQ ID NO: 147380 - DNA, 394 bp, Homo sapiens
tccctgaagagggtgctgaggaccaggtggctgacgaggggaggagagactggtggaggcaagagggacagggtggtctggatggggacccccagccacagacctaagagcttgagaggggatcactatggccagtggcagggagggggtcatttggcctgagaccagcccttgtcttgtggtggctggaagcttaggaaaggttttatagagaaaagagactagattgccgaagcttactcagaatggtagggacaagagtggacacagaagccggttgggagtgtggcactgagatccaggggagatggtggcagctggctgagacagtgtgggaggtacaggggacagggcatggtgtgagggtgaaggaggcgaaggaggggctggggag

SEQ ID NO: 147381 - DNA, 451 bp, Homo sapiens
aacttaccaagcaatgttagtgtatttctctagttaacatctctcctcttctctgcttattctagaccttcttcaccttttttcaaccttggaacctcttccattctcctccctcttagccgtctcccctgtaccttcgaactctttcaactggattatttccatgagtattaattaaaacgtgctctaattatcttctatcttttaaaacaaaccaacagaaactctccttgggctcgtttgccatctaccagtgccttatctctttcttctcattcacagtcagccttcttgagtttcagtgtccagctactacttcatcaccaattacccatgcaactctgtgaagtcaggcgtatacatcactgtttcattgaaagagctcttgttaaatgaacagtgaccttcatatggctaaagaacatgaaatgtctttggttcaacttacttg

SEQ ID NO: 147382 - DNA, 295 bp, Homo sapiens
ctctggatcctagagatcagggctctcacctgcaggggtttaaaaataatccacacatgtgtacatctcgtggggccaggtcttttcaatgaaccacaggtggtcctgagaagcatgctgcctctatgccgcattggaccatgtgagtggccagagtaggcaagatactcgattaacgggcattttaaagaactgacagttaggatgaatcaacagcaattcaaagcaaccaagacctcctgtgtacttgcaaacagctggtgctcctggatacagagaagagcaagtttgccag

SEQ ID NO: 147383 - DNA, 372 bp, Homo sapiens
ctgttccactggttgatgtgtctatttttaaggaagtactatcctgttttaattactatatcttcataatacagtttgaagtaaggtagtgtgatgcctccaggtttgttttgttcaatgaatcccatgctcaagtgtgaaaaaaacaggatacatgcccgatgtaggactgggatcaaagagaggacatttctgtccactgtacttaacaatttggctaaccatctcagaagatccaacccactccccttgtcacccacacccacaaactgtcacaaagtggaagagaagaagtagctgagacctcaacaggcaaggaaagcttaagacagttccgtgaagtttccggggccccaggtgcaaaggagaagc

SEQ ID NO: 147384 - DNA, 215 bp, Homo sapiens
aatgaatgaatgaatgatgaatgaatgaatgaatgaccaaagtgaatgggaaatgagaaaatctggggacagaatccagaaataaaaaggagggtaggcatgtgtcccaattctgaccaaaaaagattccaggaaatggttgttagaggtttctggcaaggctcttctccattcttagaagagagtcatggaaagcctttctgtctcctacggga

SEQ ID NO: 147385 - DNA, 356 bp, Homo sapiens
tactttatacatatcattaaaataagatgttctcacgggctataattttatgaatttaaagcttcatttaaaacttatgtacatataaaaactgccagaaagatacatgttttccttacatgtaaagaaatactgaacaatcactgagtaacccctatgggatattgccacatactgaattgtgtacccttaaaactcatatgttgaaatcttaccccctgggcctcagaatgtgactgtatttggaaattgtaccttaagtgaggtgattaagattcaatgaggtcctgtgtgtggggccctaatccgatatgactggtgtcttcgtaagaagaagaagaagctgtggatgcccc

SEQ ID NO: 147386 - DNA, 345 bp, Homo sapiens
caagcagatgcttcatagatgtctagtaatctcctaatcctttcaaagccagttattgtttctcttttctaatttaaataaatttgtgtggatattaattagtaggagtagtatcaagtttctgaatttgcccaacagaagtatgtcttggcgaaaactatttttaaggaaattgagaaagaacaaggaggaatacagagtctcactctgttgaccaggctggagtgcagtggcacaaacatggctcgctgcagcctcaatctcctgggcccaaatgagcctttcgcctcagcctcctgattagctgggaccacaggtgtacactaccacgcctgaccaacttgt

SEQ ID NO: 147387 - DNA, 315 bp, Homo sapiens
ccagccatcttttagggggtcatcttcccagtcactcattctggacattcttttctatcccctaaaagacaagtgagcattttcctttgagctcctgctgacattgttcaggcctttggcatagtcttgtcatgatttactgcccaatttgttcccctgctcttctcccctctaggctgtgaactcttgaggctgtctgaacagtgatggcatgccatctcctatagggaatggacatgcaaaaaggacacacatcacaagtgtgcagcttcctggctgtaaactgtaaactgaacctactcatgtcaccagcac

SEQ ID NO: 147388 - DNA, 363 bp, Homo sapiens
acccagcagtgggctagtagatgccaggcctgtggtggtcagggtttttcaactgtggctgtgttgacaatccaggctggatcattctttgctgtgggggctgtcctggacactgtgggatgtttagcggcagccttggcctccagcagcccttccctgcccagttgtgagaaccaaaaatgccttcacacattgccacatattccctggttgagtgccatctgcctatctggtggtgtgaaagagcatagctggccttgggctaggaggatgcgaaatcagagcaaggagacgaaggctcagggcctcacaaggcagtgtacgagcaactgtcagcatttttctgcctgcctgcctccaatc

SEQ ID NO: 147389 - DNA, 602 bp, Homo sapiens
gtttctttttaaaatcattttaaagagcagcatagtatgattttaaactccatattttgtttaatcagtttcctattgatttgctacatccaacaatgctgcaaggggtaactttgtacgtgtattatgctcacacgtgatagtgccatgtgtgatgaatatggaattaccaggtgaatgcatatgtgcatttgtacttctcacagatgttactccagctgcctttcatggaagctgtgctaacttatgctctcacaggcaaggcatgaaagcacttgtttctttatatcgttgccagtacagtatgttatgacatttcttaatctttaccaatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagc

SEQ ID NO: 147390 - DNA, 670 bp, Homo sapiens
tcttataccaaggagacatcccattgctttttaaacatgaaatattctttaataactccattcttttgtgcttactcttccagccaactggaatgcctttctcccattctctaacccaagttaaatcttcgtaagatgtctgattcccttagagcagaggtcagcaacctttctgtaaaaggccagtcgtaaatatttcaagctttgcaagccatattgtctctgccaactactcaattttatcattgtagtgcaaaaacagccataggcaatatgtaaacaaataagcatggttgtgttctaaaaaaaatttctttacaaaaataggtagtgggctggatttggtccttgggctgtagtttgccaacccctgccttagagaacctgtcactcttctactactgccatcctagctttttctccatgattatctgtttacaagcacattttgccaaaatactaaattctttgaagtcaacacttttattcctattccctaaaagctagaaatctggaaatagaaatgattcaataaagacatattattgaatatcaagaattatcattatgttgctggtggaaaaaagtggagaaaaattcttcggttgggtacaagattaaatggcttacttctaagatttatctaaaataaaagattatataaaaatac

SEQ ID NO: 147391 - DNA, 192 bp, Homo sapiens
gaagcccttcagaatcaaaaatcaccttttcagcctatttcccagtactctcctttatactccggccatagataagtatttcatacatctgagagatgccatgcactctcatatgatctattctttttaaactctcacttcttcaagacccagcattatctgtaatcttttgagtgacatcatcctcaactt

SEQ ID NO: 147392 - DNA, 299 bp, Homo sapiens
cagtggtgtgatcttggctcactgcaacctctgccccccgggttcaagcgattctctcgtctcagtctctcaagtaactgggattacaggcacacaccgccacggccagctaattattttgtatttttagtcgagacgagaattcaccatattggcctcaggtgatccgcccgcctcggcctcccaaagtgttgggattatgggcgtgagggcacacggtgcccggcctgttttattgtttgaaaaacaagtacaggttgttattatccaagaattgttgatagagtatatactgtatt

SEQ ID NO: 147393 - DNA, 183 bp, Homo sapiens
cattggtcttaagaaagtaactctataccagttggctatccaagttattaattcttttaatcactttaattcacccctacaaataaaatgatttcgtttttcgaaaattaaaatctaaaagtgtcttaaaatttactttttgggccaggtgtgatggctcacacctataatcccagcactttt

SEQ ID NO: 147394 - DNA, 407 bp, Homo sapiens
tattcataatagacaaatacagggaacagcttaggtgcccatcagtaggtgaatatataggcaaactataatacatatcaatgtactactacttaacaataaagtagaatgaactgttgatttacacaacatggatgagtctcagacattatattaattgaaagacttacattgaaagtacataccatatgattccatatatatcaagttctacatcatgcaagataacctatggtggggggaaaaagtcagaacactggttgcctctatatgggaggggaaggactaaccggaaaagggtaggagggaactttccatgtgaataataattttctatatccttttttttttttgagaaggagtttcgctcttgttgcccaagctggagtgcagtggtgcagtcttga

SEQ ID NO: 147395 - DNA, 515 bp, Homo sapiens
taaaaagaagaggagtgacaaaatcctgtttcttgacctttttttataaaatgaccaatgaccaaaaataattaaattataaaggaggagcagctaggcagagtttccagagtttcctccagggatgaatcacacaggacacaatgtctgcaaggagacgctcaagccatgagccatgagccatgagtgagacctgaacctagctcacccgctatcctcagctctcccccaaaggagaggcaagtgctatgtgagaaggataaagaggccgggtgtggtggctcacgcctgtaatcccaacactttgggagtccaaggcagatggatcacttgatcccgggagttcaagaccagcctgggcaacatggtgaaaccccatctctacaaaaaaaaatttagccatgcatggtggcatctgcctgtaatcccagctactcaggaggctgaggtgggagaatcaactgagcccagaagttcgagaggctgcagtgagccatgatcacgccactgcactc

SEQ ID NO: 147396 - DNA, 298 bp, Homo sapiens
tgactgatgtatatacagatatgagagttattagaaagcaccttcattttagaaggaaacaggagcacatagcactggacaaaaacagctattattattatacagctattattattattgttattattattattctgagatagagtctagctctgttgcccaggctggagtgaagtggcacaatctcagctcactgcaatctctgctcccaagttcaagtgattctcctgcctcagcctcccgagtagctgggattacaggcacctgccaccacgcccagctaatttttgtattttta

SEQ ID NO: 147397 - DNA, 299 bp, Homo sapiens
  misc_feature (273)..(273): n is a, c, g, or t
cctagttctaaatgtagagcaaggattgcaagggattatttagacaagttcatcaattaagtaaaattagacatgaaggatataagaatgaatgataaagcaagctaaaaatggtgaaacaagggatgtctgattggaagtagaagatatttatttaggttctaggacattagtatcagtgaggacagtaatttcctgctctctagtaatatacaatctagcattagatcataaaaaataaacaaataaagaatatgctacaagagaaaattngtgataaggaccagtgattactttag

SEQ ID NO: 147398 - DNA, 193 bp, Homo sapiens
attgtcattaatactgcctataaaatcaaaaacaaaaacaagtaattccatgcctctgccaaactgcatcaggctatcaactatatctggctttcactgagtttgaagaaaccttccctacttttcaactctagctggaaacatgagaatggcctgtcagttctagtgacttccctaaaactgtaatgagtta

SEQ ID NO: 147399 - DNA, 300 bp, Homo sapiens
caaggacagcatggacctgtcagatgaaatatcgggataccgtagcgtcgacattcattatctcatggatcatatcgtgtaaccggctgcagatattgtagatcagtcctcttgtcttcttctgttaccatgttaatagccacacccttatggccaaaccatccacctcgaccaattctgtggatacaggtgggaaggtcacagttgataactgaagaaacctgctgcacatgaatgcctctggctgcgggtcagtggtaatcaatactctgtgagagccagaacaaaactccctcatga

SEQ ID NO: 147400 - DNA, 469 bp, Homo sapiens
ggctgtgttgcccaggctggagtgtagtggtgtgagctctgcttactgtaaactctgcgcctaaccccaggttcaagcaattctcttgccttagcctctcaagtagctgggattacagttcaacatggctgccataaactggatattgatatctatgagcagaggagtccctccctgtgtccaccaccatcacaagcccagggcaagtactgctagagggctgcctatgatcagatcttctgagaacatcagagaaagactgtccttgcaatctacactacagcaagacttcaggaccttgaacttcaggttcataatctcacaactgagaaggatccttccacactcttggaacagtgcacccattggaactctgaaggttaagctcaccaggaaagtttctctccagaagaagataacacccttaatgtgaacagcttttcccaaaatcacggattgaaacttctct

SEQ ID NO: 147401 - DNA, 194 bp, Homo sapiens
aggggctgcctcctaacatctgtacaaggctggggtgggggcggcgttcccctggccctggttgtgagttgagttgagcttccagccctgtcctggaggagctggcctcagtcatgctacagccaatgcccttttgcagctgagacttacaggaaagagatctcattcagtaggagtactgagacctgaggctg

SEQ ID NO: 147402 - DNA, 576 bp, Homo sapiens
tgctttctgaggtttcacatacccaagatccactgcaggctgaaaatattaattaaatgggaaattccagaaataagtcataaattttaaattatgtgccattccaaatattataattgttccattttattattagttattgttgttaatctctgactatggctaatttatgagttaaattttatcataggtatgtatgtataggaaaaaacatagtctatatagggttctgtactacccacatttcaggtatccactgggggtcttggaaccaattctgcatggataagcggggactaccatactggcaacaaaaaaaaatcacgaagtcctcggcttctaaatccaatttccccattagcttactgtgtaactttggacaagtcactcattctccctggacctcatttcctgactgtaaaaagagcggattgagttagataatccctaaggtgctatttagccccttcagtggttgtctgctggccatattgtccatattctggattaggcgtcatctgcccctcaattctcatttcccccccaagagccactttgaggtttggaaaaaaaaaa

SEQ ID NO: 147403 - DNA, 378 bp, Homo sapiens
aggaaactcagaacagatacgtttcggcaaagagcaagtcgactgggattttttctatagtgggtgtgtaaatttcagactttaaaatccactcagtaaaactgacatccctgcttattcacttttgccgactctgctagaagcctcctgagttttgtttacaaggtctccggcacacagcctgccttctttgaaaggccaggccaggaccagcctgcccatcccttctgttctcactggatttcgtggccagtggcctggacgtgactaacagatggccattgcagagctgatcacctgatttcatggcttattcttgggaaagcctctgatctttttacagaaggttatccatcccttggtaaatccttccccttg

SEQ ID NO: 147404 - DNA, 480 bp, Homo sapiens
aggccccattcacataatctgcagcaagcgtgtgaggaatgtgcatgagagtgtgaaggtttctggagtaccaggagtctctggagattgcctgttctcagctcatttgtcattgcctaggtttcctggagcatttccatcctaggaaattttttcttggcctcaggacagaacttctaagaacatgtcccaggattgggccctctggcaccgagtccctctcaccccaccacttctggccagcctctgctgtgtactggatcctgagctgcttacagagctgagcgcactgaggtatggcccctgctctccagggactaaggatccagtaggctaaactggatgagggcagaagcctggctagacctgggcctatggcagggctggaccaatagacgggaatcagctgatggcaggagaagaaggttgcagggacagggaaacaggcagacctcatagatgggtcagctagagaggaat

SEQ ID NO: 147405 - DNA, 342 bp, Homo sapiens
ctatggagcaaggacatggggactgaatgaaagaggggaggcagacgtccagcccaccattcctcacccaaggagatgatcccacaagctcacaaatgagcagaactggaaaagacctcaaagtgtggctggataatggcaacacaggcctcgagtgctcactttgtgctgggtgctatgccaagcaccacgtgtgtaccacggcactggcaccccaccacggcccttgttcacagaccaggaaaccaactctcaccacctaatcagtatggagccttggttccaacccacatcatctatctgtgcccagaatccaggttggttccatatcaggctgcctga

SEQ ID NO: 147406 - DNA, 435 bp, Homo sapiens
ccactgcagtccacaacagatcaagaccctgtctcaaaacaacaacaacaaaagcatctgaatccagagtggcccaaaacctcagttttccagtccaatgataattccccgaggaaaagaagctaagatctcagggatgtcgctgtgcccaggctgtttcaggccagtcggccactggtacatgtcttatgaaatcagtctcttagaaaacacacgcccaacatcccatgtagctcagaacagaagcctgcgtggtgggtgctgccccgaccatgtcaggggatctgcatggatttgagtgcggtatcactgcaggggctacatcaaccagtttcccaggggcttggagagtggggatctggtcttgaccgtcacagggttaagtacaggtatcagtatctacgggcaattcactccccagcacccaggggcata

SEQ ID NO: 147407 - DNA, 149 bp, Homo sapiens
acagaagctgtaggtcagaaaagtgagagcttagagcttgccattaactctgggccaagttacattcttagagggagccttatctgctatattgttgtgtgggacttgtctgattttctattaccgcctgtttcccagtaccctgtgat

SEQ ID NO: 147408 - DNA, 553 bp, Homo sapiens
aggtataggttgaagttctttttttttgcatatggatatccagttgttccagccccattgatagttgaagaaactcttttctccatctaaatgcttttgtacctttgtcagtaagcagctagccattcttgtgtgaggttacctctgggttctctattctgttctattgttctttgttcctgtcccttcaccaatatgacacagtcttactgtagctatgtagttgacccttgaacaatgtgggggttggaatgttgaccccctgcccccattcagaaatcaaagtgcaacttttgacttcccaaaaacataattactaatagcctactgttgactagaaggaaaccttacagataacataaacagtcaattaactttgttttgttttgtttcttcttcttctttttgagataggatgttgctctgtcatccaggctggagtgcagtggcatgatcatagctcactgcagcttcgacctcccaggctcaagcaattctctcacctcagcctcccgagcagttgggaccacaggtgcacactaccactaccatg

SEQ ID NO: 147409 - DNA, 335 bp, Homo sapiens
cttgagttacttaattctcaccatgaccccatgaggaagggaggtactagttaagggaggtactagtttacactactctagagataaggaatcctagatccagagaggttaagtgacagctccagattcacgcctacatctctgggaccccagaggctatgcataccagctgcagaggttaccccactccagtggttatgtccctgagcacccaccatgcacgggccactcactgagcaagggcatcaaacatcccctttcatcctaccccatcttacacagggcgcacctggcctgctgggtttggtttgtttgtttgtttgtttttgagacag

SEQ ID NO: 147410 - DNA, 489 bp, Homo sapiens
cctgaaaccctcagcctggaacctggagcctggagcctggaacccggaagctgaaacccttagcctggaacctggagcctggaacccagaaccaaaaccctcagcctagaacctgggactgggaacctgaggcctagagcctggaaccaggcgtgcagcctagaacctggagtgaagctggggacagaagccaggcctcggcctctgagtctgaaagtctttgagcacaggtggcagacagcagcaactgcacacacgcggtccttggccagcatgattccctgaaggcccatcctaagcctcgtgtctgcattgcctcatagactcctcacagccacccagtatcgcctccccttgccaggtggaaacactgagactcagagatgcttgtcgcttgtctgaggaggtcgcctggccgcagcacccaatgctgaccctctacaccacactctccctgggtaccccaaagattctctcatgggtgtgcga

SEQ ID NO: 147411 - DNA, 429 bp, Homo sapiens
gttctaatcccatttctgaaagaaagagcataaatatttgccgttagaaatcatggaacagtttttagatgtgttttatgttatttgataggttaatactttatttcaggatttctttttgcattatccttggcagtggctaggtactgtcaatgaccagtattttttgttctatctggggatgtgaatccaaaacaaaggatagaattgcttgtgctctgtttttctctcagttaattttttcaaaatataatcccaagtacaaatcatgcttttgagtattataggggatcatatttttttcttataaccttgaataagatgcagtaaaaacagtgaagctgaccacttttcttccctatcatttaggtatgtagcttctaccagatattttgacatcctgtttcataagaatctttttctttaatt

SEQ ID NO: 147412 - DNA, 250 bp, Homo sapiens
ttgttttaatcagtgctcaaagacaatacaaatgtttcaagtaaagagggcagttttgtagataggacctgaagtaaatctgagcctcgtggggggaagtgctgggaagccaccagctttaactgctagacaaccaagctaaacacttggaagttgttcttgattctcccttccgctatttatcaagctcctcccaatttcaaatcctgaatccttaatccgttccctcccctccaacattcatactgtg

SEQ ID NO: 147413 - DNA, 393 bp, Homo sapiens
tactacgtgctaccaaaatacaccacattctacagtaaggtcagctaagctaagctatcgggcccataccccgaaaatgttggttcatacccttcccatactaataaatcccattatctacactacccttatcataacagtaatatccggaaccatactagtaataatcagctcacactgactactcatctgaatcggattcgaaataaacctattagtaataatcccagtattaataaaaaattttaacccacacgcatcagcacaacattcaggccaccacaggctatggctccactgggtcttccatcatgcctcccacatttcaccaacacacatgccttccggaaaccagcctgattccttgcacacaccctgcctgttccccaccag

SEQ ID NO: 147414 - DNA, 494 bp, Homo sapiens
tttatcctcctttcacctccgtggtgagcttgggacacagaatattgttaatgtattttttgtatatttcatgtttctaattccatcttcttttggtaattttgttttatttatttgtttgtttgtttgtttgtttgagacagagtttcactctgttgcccaggctggagtgcaatggcgcaatctcagctcactgcaagcacctcttccctggttcaagcaattttcctgacctcagcctcccgaatagctgggattacaggcgtgtaccaccacgcctggctaatttttatatttttagtagagacagggttttgtcgtgttggtctcaaactcctggcctcaagtgatccgtctgccttggcctcccaaagggctggtagtaaaagcatgagccaccacgtctggcctatttatttttgagacaaggtctcgctcttgtcccaagctcaccatggaggtgaaaagagggtaacgtgagaatgggttaagag

SEQ ID NO: 147415 - DNA, 414 bp, Homo sapiens
gttataagctttccccacgggagatcgcaattgtggttttcacgccacacccttccctgtcctgcaaagccggcacccgaggttcctgcacccgcggcttctgcactcacggccccctgcactcgcagcccacttttcactctcccacgcctggccctggccaagggagttggtccccacccaaggttatgtatatatatcatgaaacccctcgggagcttcgttcaacctgcgaccgccgtctaaactttttgcctgtcctccacgggggtcccctgtgaggaacagtaaggaacggctgccctcctgtgttgggatttgggagtgcacgcaagtgtcttctgccactgctcctatttttatattccgccaccctccccgagttggtccctttgctgggtggggttaggtctg

SEQ ID NO: 147416 - DNA, 111 bp, Homo sapiens
tgctggaattacaggtatgaggcactgcagctggctctttctaaaacacagatctaaccttgtcccttgactagctcctctttgtctatgtaataccctaatattgagcaa

SEQ ID NO: 147417 - DNA, 669 bp, Homo sapiens
tgtctccccagagttcgtatgctgatatattaaatgccattgccacaaaatgtgactgtatttgaggataaagcctttaggatggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgccttccagcctccagaactgtgagaagataactcttgttatttaagccacctagtctgtggcacattgttatggcagccctaaggaatgcatacaacttccaacaaacacacctacacacgtgctacctgattctctgattctacctttaaaatatatctagaatcatccaaattttccatccctaccgcctttaatttctgtgaaccacaccacttacctcttactacaagagtctcctcctgacaatcatgtctccaatataccccttctgagccattctcaacacggcatcatgagtgatttattttaacacaaattttgtccttggccttggctgttgaaaatcgtttgatagcttccaattgctcctagaataaagttacacaaattgctc

SEQ ID NO: 147418 - DNA, 767 bp, Homo sapiens
tgtctccccagagttcgtatgctgatatattaaatgccattgccacaaaatgtgactgtatttgaggataaagcctttaggatggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgccttccagcctccagaactgtgagaagataactcttgttatttaagccacctagtctgtggcacattgttatggcagccctaaggaatgcatacaacttccaacaaacacacctacacacgtgctacctgattctctgattctacctttaaaatatatctagaatcatccaaattttccatccctaccgcctttaatttctgtgaaccacaccacttacctcttactacaagagtctcctcctgacaatcatgtctccaatataccccttctgagccattctcaacacggcatcatgagtgatttattttaacacaaattttgtccttggccttggctgttgaaaatcgtttgatagcttccaattgctcctagaataaagttacacaaattgctcggaaggctttcaattatctagttttggctaaactcttatctcattcctcaaccaacacatctgttgtatactaggcaggctcagcttagtgtctgggt

SEQ ID NO: 147419 - DNA, 556 bp, Homo sapiens
tgtctccccagagttcgtatgctgatatattaaatgccattgccacaaaatgtgactgtatttgaggataaagcctttaggatggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgccttccagcctccagaactgtgagaagataactcttgttatttaagccacctagtctgtggcacattgttatggcagccctaaggaatgcatacaacttccaacaaacacacctacacacgtgctacctgattctctgattctacctttaaaatatatctagaatcatccaaattttccatccctaccgcctttaatttctgtgaaccacaccacttacctcttactacaagagtctcctcctgacaatcatgtctccaatataccccttctgagccattctc

SEQ ID NO: 147420 - DNA, 595 bp, Homo sapiens
tgttccaagatgtgttgctctcccaagctttccctgctgaaggttttctattaattgtactctcagtccaatagtgggttctctgactctagccttcacttgtctaccatagctgtgatggttaaaagcttctccagtttgtcacagagtttaatatgcaccctacataattatgcaggattcactgtgctatcaaactgcaattcaaattagttcaggattaaaggcacagaacagtactgcttccttaattgcattgtactgtgctgatcacattcaaatacccattactcattccctctgtggagcaataagtcagggggattaatattcaggcaggtgacagggccaagccattaaaaggcagttatgcagaaagcatggctggttttattcacgttaatgaaatcagtgaaatgaaactgtaatagatttatcaaagctcagatggatttgctgtaaatcagtttgattcaagcaatcaaactggacaatagagatagttttcagctctagcaatgggtgtcagaaagcagcatgtgaaaagtgctgatattcttcatgtatggatttgatatccacctcatgcacaggc

SEQ ID NO: 147421 - DNA, 272 bp, Homo sapiens
gtgattcaaacccaggactcccaagatcctgtgagctttctccactttgggctgctcccaccaccccactgggtctcctggcccccaatccagggccctttcccatgcccaggggggcctcggttctgctggccagccatgcggggggcttctgaacttgcccagctgggcagctggatgagtggtagagccacacgccccctccccttgccctgagactctgggaagaggcgcaatcaggaggaacagacaataaagaacaaagaggccag

SEQ ID NO: 147422 - DNA, 204 bp, Homo sapiens
cgcagtggctcacgcctgtaatctcaacactttgggaggccaaggagaagagcaagtaaaatgttgaacaagaagacagaagtgtcttcttgcagttcctgtaagaaggcagaagtatttgcagaggggagaatgtggaagaaatagagaataattatctcttaccaaatgtaatggcttttgttgtgttttttcttttctaat

SEQ ID NO: 147423 - DNA, 736 bp, Homo sapiens
gtagaggtgggatttcaccatgttggccaggctggtcttgaactcctgacctcaggtgatccacccgcctccgcctcccaaagtgctggatcacaggggtgagccaccgtgtccggcctcatcagtatatttttaaatgccaaaaatgattccatatgcagtccaggttgcaaagggaaatgcctgactcttttgttggtggtggtagaagggagggtcatctttaaaagctatgtgattaggaagtagagtgacaagccaggaagtgaaatgacaagccagaaactagcagaagggcttgaacatgtagctgagtctcccaagatttttaccctggtggttgagaatgcccagagagtaaccccatttttctctgaaactcctcagaatgaggctaatgggaaaacaactacagctactgccacaactctttaccccatttgtccaagtgtccagggtgatcttgatgacaactgtcgtaacatctccccgctgccactaccagatgggtttagatgcagtagcagacattgtgtgcaattcagagtcgccccatagtgtctctgtcaagtttggttccaaacagactaagttctgctcttttcctagcaagttagaagccctagtacaatgattctaaatcccgctgctacattagaaacatttgaagagcttcgtaaacaccagcagcccacccccgggcctgtgtatgctatccagggtgaacaataaccac

SEQ ID NO: 147424 - DNA, 597 bp, Homo sapiens
acatccacctaatgacagagcatcaaactacaagaggcaaaaactaatggaactgcaaggagaaacagatgaaactactattatagttgtagactcaaacacccctcaaatcagaaacggaccgatctagcaggcaagaaatcattaagaacatagctgaattcaacaataccatccgttgattggatataattaacacctatcaaccacttcatccaacagcagaaacacattcttctcaagttcacatggaacactcaccaagacagaagacattctgtaacataaaaaacaccttaacaaattaaaaaaaaaaaaacaaatatagtatttactctcaaacaagggaattaaatgagaaatcaataacaagaagaaaactgaaacatcccaaaatatgtgaagattaaaaaagatacttctaaataacacaagtcagagaagaaatctcaagagaaattttaaagtattttgagctaagtggaaaaaaaaatgtacatcttatcaaaatttgtgggatgctgtgaaagcagggcttagaggaaaatgtatagcattgagtgcatatatttgataagaaagatctaaaatccatac

SEQ ID NO: 147425 - DNA, 416 bp, Homo sapiens
cctcgtgatctgcccacctcggcttcccaaagtgctgggattacaggtgtgagccaccgtgcccagccttctctgatgttcttaaaacaccctgcccagtcagcctcccattttctctgctcttgacagacatgttactttcctgcttactgtgtagtaacaacagtggtccaagtgtgatggcacctcgcatttggccccaagggaagggagtcgattgggagtggtgaggactgaggcaacagggtatcagctgagttcatgccctggctgaagagggcagcttcacctggttccagccagttgtggcccagtgttgccacatagttgggttttttaaatagaagcccattctggtttttgtgagtagtctcctggtttttaaatgttggcagctaattcagaagttttaaaaa

SEQ ID NO: 147426 - DNA, 326 bp, Homo sapiens
gtcattaccgcatgaaggccttcttgctatgccctctcacagctcaggacatgttagtcagctattgtcagtcccaaacctatagtgcaagcacacaaggaaagtgagatttgttatctaaacaggaaaacaagagctaaaggtaaaactgcttgcactcacacacatttaagtgttcagatatacagtatttccaaatataatcgctgcagatatctaaggaagaaaacaataagttagcttaaatagaggacctcagatttgtaaacacaataaaaaacataaaatagaggcatccagaaacaaaaccaatacaacaccaatta

SEQ ID NO: 147427 - DNA, 182 bp, Homo sapiens
cagccccctctgggcctcttccctagcctttccttattttgtgttgctttcctcacacccaggaggaacacatatcccaattcctgaggacagtcctgatttgcaactggcatcgtggcacaactgccaatagtaccacctttaaaaagtttagacactgaattatggtcatgctacttaac

SEQ ID NO: 147428 - DNA, 218 bp, Homo sapiens
caaacagcaacaaaaacactagttcgggggccactaaaaagtggtgaatatgtaggctaattcttctgagtcatggaaataagtgaattttacagttcaattgtcagttacattcaatttccatttacatcaaattgatcttaagaatcatggacataatcaaatcgtttttgttgttggtcaaacactgctctaagacttcacatctcttagctttt

SEQ ID NO: 147429 - DNA, 613 bp, Homo sapiens
aactgggtagaaggcactcaccctgcttcatggatggagtggaggaggggagggaatctttcctctgaggggagaaggtgctgggttgtttgggttcccagctgggttgtttcctggctccagccagactgctcttgtttgctcctgagttttattttaaccagattgtttaattgagacttcactagcctttaacttctggattgcctttggtgttcaagcccagaactctttcgtgtaattagagtcttactatttctacctagcaaactttttttttttctttttaaaaagattgatgcatccacatgttatgggggcacatatgatactttgataaattgatataatgtgtaaagttcgaatcatttgagaggccgaggtgggtggatcacttgatgtcaggagttagagaccagcctggtcaacatggcgagatcctggctctactaaaaatacaaaaaaattagctgagcttggtggcgggcctctaattccagctactcgggaggctgaggcatgacaatcacttgaactcaggaggcggaggttgcaatgagccaagatcatgccactgcactccagcctgggtaatggagtgagactctgtctc

SEQ ID NO: 147430 - DNA, 286 bp, Homo sapiens
  misc_feature (24)..(25): n is a, c, g, or t
  misc_feature (28)..(28): n is a, c, g, or t
cacccaggcgcacttctgcacccnngcnacttctgtcatcctctcatttgacagagaggatgacagaagtgtgcttaggagcttcttgccagtgctgttggggcagtgctgcagttgccctgactggtggcacctagcaagggggccatttgccctgggcccatccttggtggggtcatggatacccaggtcctgcatacccagcagtaggtcctgcatacccagggcccccggagccacggtgccctgactgtgggtcgggggacagtttctagaaagcagatgg

SEQ ID NO: 147431 - DNA, 216 bp, Homo sapiens
tcaagcactcgggggaagataatcagaacagggcagtacgtgtctgggtcttgaaatggctcaggaaaggtatggaggcagaagaggcgccacgctctccattgaccaagatgaggagtggaggcagtcagctgtgttggcctgcgggagggagactgttgggggagctcactgcaccaatctctagctgggctggacagggtccatagttgagag

SEQ ID NO: 147432 - DNA, 438 bp, Homo sapiens
cattaggagctcatcatctaaggggacttgctgaatgcagttctactcagcctacacttgtgttatgtctccctccagcttcatgagtggtaaactcatgaaaatataatacaatataaatattgtaagtaaatgacatccacttagaagtctacaaggaaaagaggtgggttgcttgagtgaatttggtcattcaataaaaatcataccaagacatttaggcatgaatgtgaaatgacatgagtactttgaaagttaggagcaccacagaaatatactttggaaataatgaagccgcagcagctgggaagaaggatggtagaatcctctctgggcagcccagagtttcacagtctcggtccaccctatgaccccaagccaagcccaaatgcatagattctgttccttgcacccactgtacatacatatattaaatac

SEQ ID NO: 147433 - DNA, 429 bp, Homo sapiens
accatcttcttttcatgccactgtccctctcattctgaacttaagcccactggcctgcacgggcctgccagcatggacaaagaaaagagtgaaggcatttagttgcttcggatcatcaaggaacagtgagaaactccatgtggttgaacataaacgttgattccttttactgcctgagctgctaagtcttgaaactgaagcctctgttatatgcagttagagtatccaaagctgggttctcagccagtagattaggatctggttgaaagctaggattcttgatgccttgtctggtacatttccaagctgttttgctccaccatgctcttccctctgtgtttggaaattaccagccggagcggtagaagccacctccctgctccacttgggcactttattgtcagcgcagctcatgcgcccaagatccat

SEQ ID NO: 147434 - DNA, 560 bp, Homo sapiens
gtctatacctcactcccagaaaaggctcagcgtgagataaaacagtgcaacaaagatattcagaacttccctttcccctccacctctaagcaatcaactccaactctctttcccttaagggaagtgccccttggagaaggaagcatcggctttgttaatggtcccttaactagctcagaagtccaaagtttaaaagaggaactcagatcattattaaataacccctatgggactgcagatcaaattgatcaattcttagggccacagctgtatacttgggctgagtgaatgtccatcctgggcatcctcttttcaggggaagaaagaagcatgatccatagggccgctataatagtctgggaatgtgaacatccatccaaaacattcctgcagcagaccaaatatttccagcccaagaccctcaatgggatggtaacaatacagctcacccaagaaaagcctgaccctcttctgtggacttctgatgaaatccactaggttgagcagctaaaacacctacccatcgctattcctgtcttagcgctgccatccctagaaaa

SEQ ID NO: 147435 - DNA, 350 bp, Homo sapiens
ctgtagttccagctacttgggaggctgaggtgggaggatcacttgagcccaggaggttgatgctcctgtgagctgagatcatgccattacattccagcctgggcaacagagtgagaccctgactcaaaaaataaaaaaagaaaaggctgctttaggatattgcgttcttggccctctgaaagggtacaagtcacacatccactgtcctctgttgctacggcggcctcacagtggaaagctagggacatactgataattttcatctgctgtgcaccaaaaacggcccaattattttcctagccaaggtcagtcatggagcaagggaatctgaagaacgctccagagaactg

SEQ ID NO: 147436 - DNA, 390 bp, Homo sapiens
ggatgtgtccagtgtggggtgcagttctataccaaagcattagacagagtttggtccatgtttgacttagaaaataactgcagaaatgctccacctttttgttgccttctgagatgtaaaagggattattaagcctcccaaacaggaagggaagtttaaatggagtaccatggattataatcttccccaaggtcttgctcaaggaaaagatgttcaactcttacataatgctatgcttcaaaaagactttccaattcatcacgaggggccgccagcagagttagggatcaggatccctgcgttaaaatatagattctacagtgatttgctgcagacactgggacagccacccaactccgctgggctttgattactcattctgtaaaacaa

SEQ ID NO: 147437 - DNA, 195 bp, Homo sapiens
cccagggtctattgtttccatccttatgtccatgtgtacccagtgtttagctcccacttataagcaagaacatgtggtattttattttctgtttcttagctatttcacttaaaataatagcctccagctcatccatgctgctgcaaaggacgaaaaggattttattctttttcatagcggccagtatactgtttt

SEQ ID NO: 147438 - DNA, 521 bp, Homo sapiens
caaacatgtatttggatgaatgacaaatagctactgaatatttgccctgttccaagcattgttagaggtacatgggacagggcagtgaacaaaacaggcaaaacctcctgctgtctcagagttcacactctaatggggagacccaggcaatgaggaaataattaaaatatacaatgtgtcttatggcaataaatgacaaagaaaaataaagcagaggtgagaaacagtggcagtgttttggtgatcatttgctttgcaacaagccactccccaaagttagtggcctaaaacaatttaatcacagttcatgttctggctacaacaatacacatccctctcatgtgcaaaatacactcattcctccctcagagcctcgtaccattaagggttcaggttcaaagcttaagatcttatcctctgaagtaggtttagggacaaacaagtcttctcaggtacttcttctggggacacagagacttgtgaactaaaagacaagttacctaccttccaacacaactggc

SEQ ID NO: 147439 - DNA, 523 bp, Homo sapiens
ataatagttaacttggggagtcagtaaggaatcaagtggaaagacaaagcactttattatgcttcataacttctgataaggccttattatttaattgtagttggatttgaggatttgaatccacaaagatttttcttttgccctttcaagaatctttatacttagatctatctgctacttgacaatcaaaacaaaattccagaactgtcacggaggtaaacagtaaatagctcgtgatccttgttatgaaaccataattaggaatttaatggccctaaatttgtctcttttccatacgatttttcataggctactgctaaattttaatatcagagtccagcaaaaagaactagaagatgattaagtctaaagaattaatgacatgctttaaaatagaatttccaaagtatatatccagaggaataactactgataggccataagcagagaatttccaaacagaatattcattcaagatcatcattactgaagagaaaactggcacattttaaaaaatgattta

SEQ ID NO: 147440 - DNA, 323 bp, Homo sapiens
gcaaagtgtaatctaagttttgatcaatacaatacatgatattttatgaacataatagatttttttgttttattttttgggaaaattctaagcaggtctctttttcatcattatgaaatatggtctttgttaaagagaaatggctgtgtggtcttctccctgtgaggcactaattgctattggctaatgaggactgctgtaattcctttggctgcaggatttttaatgcaacgagctaagaaaagctttcggtgtgtttcctgtggctgtgaggtaatgccccaaaaaagtcttacaagttttattcacacctttaccttgtc

SEQ ID NO: 147441 - DNA, 280 bp, Homo sapiens
cacttctccttcctgctgacatgtgaagaaggatgtatttgcttccccttccaccatgattgtcccatgtaaaatttccctgttcaacacgaagaaaaaagagaaaggccatctcttctataacagaatggacatttaacactctaagttattctttggtttgtcttcagtataaatgtttataatgtcaataatattgaaattggtcattttgtttctcccacagcttgtgctctggggcaaaagataatatatctttcaaataaatcaggatcggccg

SEQ ID NO: 147442 - DNA, 451 bp, Homo sapiens
agcttgctactaattctttccctagaattcccctagagcaatggatctcaaactagtatacctcagagtcctggagggcttgtcagattcttaggcccaaccttggagtttcagattcaggaattctgggctgaagacctgagaatgtacatttctagcgagtttgcgatgaggtctggggactaacttggagaaccattgctctagagaaggagaagaacagatctcctgggcaggctaactagacagccagactacacttgggcggttgctcagaaataaaagttacttgcttatggctctatgtccagttttcagggacgttgaatcccagtgcatcaccttccatacctcctcattttctgaagtgggagcagcatcagattcctagctcagttcactgtcttccctgaatgggcaaccaaaccatttttaactagcagctttcttt

SEQ ID NO: 147443 - DNA, 288 bp, Homo sapiens
taggggcaggagctggggagaggcagaggccgctgggaaggaaagggcgagcggctgcgagagggtggccactctgggtggagggataaggatcccacttgggtatgactctgaatagctacaagtgttcgggacagggcaagagactgaacaggaccaaggacgccctggggtgaatccaggcaccttctgccacactggacctgcagcaaggtgtacctgctcctctggcaagagaaaaagacaaagatgccagcagggtcattagtttacacacgttccttttac

SEQ ID NO: 147444 - DNA, 169 bp, Homo sapiens
accagtcaaattagcatgtaaaattaaccatcatgtatacattataaattagggcaggttatgccattgtacagaattcacatcaagatttgttggactttgaagaaaggaatagtgtgaaagtgcctggcttgagattgatatagacatgtatacatagatcattcat

SEQ ID NO: 147445 - DNA, 341 bp, Homo sapiens
actcccaggattaggcactctagtccaggaaggtggtgggagtcatattgactggcaggtgcccccaaaagttgtctcctaaatgagagggatgggcaggttcctttgggacagtcgcagagggaagtgtgtgtgcagcagctgtgctggtggaggagtgtgttcttcgagcgaggcttcccgaggacatgcatgctgaagcgtgaggtggtctgtagggggcgctgccccagcgtggtggggaggaaggtgagaggaggcctgcatgcatctgggtcctcactggcttcctggagtgggttgctgccacaggctgagaccccagcgggtgtctagagcct

SEQ ID NO: 147446 - DNA, 238 bp, Homo sapiens
gaagcctagctccttgcccacccagagacagatactcttaagtggttggctccaccacttaatgtgaatccccagaatgctgaatacttttaaccaaagtttattgattatcggacgccagctcagaaggagtttctgtgactctgccatgtgactctggctcagtcaggttcattaacttagatgacatctaaatggcatgcttactaatctgctgatgactaaagtgggagggccc

SEQ ID NO: 147447 - DNA, 350 bp, Homo sapiens
ttttcaaaataaaaaaattgtttcaaaacaaaaaaattaagagaactttaatgtacaaatcttgattggactgtatctggaaagaaatagaaatataaaagaaattgaagggaagataatggggagaatttgtctactgtgtccttccccagtgaaatgtaaaccatatcccaagcacttacaagaccgctgggcataaagtaggcactcaaaatgtatttgggcagtaaatgaaacaaacacattgcaaatcagtcctaggtgctgggttctcaaaaaaggataagactggctctttgtcatgaaggaatttacagtctgcagataaaaaagaaatgttaagcaagagc

SEQ ID NO: 147448 - DNA, 257 bp, Homo sapiens
ccaatttttcagctttgacccttatgtgatgtccttaaactaaatgtttctcgaaacccctggctctagtttttcagtcacggcctctttctagcttcagtgccccaccctaccattcaatcaaaagccgccatcccgttctactccaaccttccttctcagattgcagttcacttctttcagtgagtcaacctgctgccttggatcttcctctcccttactcattccactcatttcatgccaatgtcttgagccaa

SEQ ID NO: 147449 - DNA, 433 bp, Homo sapiens
aggaaagaaaatagtgcaagcatctaggttgttgtctagcatgtctagcacatagtaggtgcacaaccaatgtttgttaaagtggcaatataagccaacaaggtgatatagctacagagcaaagctagcatatccttaggtgacattaacagaagcacagagtctacggtgaagaaggtggcccacattccaccatccccaatcctccatcctgggtttactcctgggtcctgcatagaataagttctggacagacaaagagaatccagaggatgtagcaggtacagagactacacccaagagaagtggcttggggagcagggcacttgacctagggatgagctccacatggatgggcctagtcactgaccccaagtctctgcagaactactccaggactccaggacatggggagcaggtagggctgtgagct

SEQ ID NO: 147450 - DNA, 405 bp, Homo sapiens
aatttaaaaagcttactgtttagtctaaaaggattttcctagatcaaaaacaactgtacctatttggataccaaaaatgaaaaagaaatagtgcagaatctttagattgcctaatgggatctggagaaacagctcttagtcccagtctacattctaatgagttatgtaataaaggctaattcgcttagctgtattacacctcagcctcctcacttataaaacaaaatgagtgacaaaggtgctttccaaagtccctttgacctcctaagtgtgatgactctataatcttggcctttgaagtcccttggcaataccacccaaggatgtaatgatgcttgctgatgttaatgtttgggtgtttgtggttgtatatgtcttgaccactgtcccactccaagcagggga

SEQ ID NO: 147451 - DNA, 276 bp, Homo sapiens
ggacggactggtgggcagtggtgggaatctggaccttctgtgggtctctttacaagtctgtggtggtctatgctgggaccatcctaggtgctactgggagtagggagaagccaagggtggagttcattctgtgcgtgggggaagcccccgagctctggctgagcacaagctagactctctgcggggaaggaggggtgtagtccctccttcctgcaggagaaggaggagtctggagagtggtccctgtttaacacggggaggagagaggtggggaca

SEQ ID NO: 147452 - DNA, 233 bp, Homo sapiens
gagggttctaataacgctccagaatgaaacaaaagacctcagttgaatttataactccaactaccatgcccaaactcccccaagacactcaccatgggaatagcaaccccatttcaaaaaccagcatcataagctgggtgcagtggcatgggccaggagtcccacctacgcaggaagctgaggcaggaggactgcccaggagctggagggtgcagtgactgtgacagagccta

SEQ ID NO: 147453 - DNA, 402 bp, Homo sapiens
cgagcacagccccgttagccgggaggacccaaagctgccatgccgggcacctggtcctgagcccataggtcagccagccacagtcggaggcttctcaccctcccaggagagcaagctggggcagggatgagtgcggcagtccagggctcccaggtttgcaccctggatgtggagagggcttccctctggccagcctgagcctgcccaactgtggctgggcccccaggactggagagtgaggatcagatctttctggtcagaacccaggatgggctcaaaaggagcagtcctgtctctgagggacagaggaatcctcaggctccaccctcagaggcctggccacacccagagccctgattgatcagggggagccaaggccccatggcatcccctggcccctgc

SEQ ID NO: 147454 - DNA, 491 bp, Homo sapiens
caagagaaatggaggtttgggggcaaaagtgaatttctcctattcactctcctattaactctcctattaacccccagaacaagtccctgaggaaaaactggcatctttttccggaggaaaaaatgaagaatttcatccaatagacttgcaagtcagtacccctaattagaggccgataagagacacaaggagagaaagcaggagttggagaggatgtcggaggaagagtctgccttctaaaaagctagactctgccccagacatcagtcatccactatccccaagggccagaggaaagaacctgagaacagttttccatttgtgcttgtcaaactcagctcactcccttgaagccaaggaaagagatttaaactacaagtgtccaccagttccctgtaactaaactagttatttggtattttgagagcatctgagaatcacaatcacagaggcaagaggggctcatttcttcagctcgccctcaccttgca

SEQ ID NO: 147455 - DNA, 329 bp, Homo sapiens
aagtggctgaagctcagagaggttacctgtaaaatgcgattttgttacattacaactaacatttatcgagcatttattatgtgcctattactgcacatactatatataagttctctcatttaatgttcacaatactgtggaaaagattctataattatgaccattttccagaggacaaaactgtatctttgaaaagttaagtatctagcccagcatcataaagcccagccatgacttcaagccagtttagtaagacaccaattcagtaacacgcagtgcgcacagagaatagtcatgcagtaactgttgtctctgatcccaagatcttg

SEQ ID NO: 147456 - DNA, 484 bp, Homo sapiens
gttggggtggcttggggtctgggtgacccctgaagtcagaatcagaagtggccacattcgtgacttgtggtcttctgagtataagaaatgtccccatttggatatcctcacagcctcatgaaagtaagattttattgagtagacctgctcatggaaggtgggtagtttccaagtagcactggtacacaccaagtgaaataactggtaatcctggctgtcagcggagccaggtcaacatgctggtatacgtgctgtttttcctttgagctttaagttcttatgtacacataaccaatccaacctacttttcattaacaccatgttaggtattattttcttagattgatatttttcttttaaagaaaaaaaaatcatagggtggattttaaaatattattattgaaaccaatgatttcttctttgattttagatggaaacccagaagggaccttccccatcttctctctctctctctttctctctc

SEQ ID NO: 147457 - DNA, 189 bp, Homo sapiens
aaaattaaaaagctgtttttaaaagttatatagaaatgcaaacaatctaaacaaaattagaggactcactctacctgatctaagacttaccactgagcttcagtaatcaaaacaatgtggtactggggaaaggacagacaaacggtctatgagaagagcacagaaatagacccacagttaaatggtctt

SEQ ID NO: 147458 - DNA, 260 bp, Homo sapiens
attttattagagtgaaaatttcatagaaaggcaagactgtttttcaaaaggaaaggaaggatattagacatgaaccccaacagcatggggcaactcatatctcctgtaatttataacatctacttctatctatctatctgtattttaattactggatgctgatttacacagcttgatcaatgctgcaatgctaatgtcttgaggactcaggatttattttattgtgaactagttatgcaaatgaaataaaatgactcagg

SEQ ID NO: 147459 - DNA, 242 bp, Homo sapiens
acgctttgcgcaaccggagagaaataacagctttcatgtaatagtgcttacatgaacaagacaaacactgattgagtgcctagcactgggaaaccatgctgctggccaccttgccctctaggactccagatctggtggggaagtcagacaaggcacggaagtggttgggaggacataaactctgcaggctccacaacctctatcctctatcctcaagttaatttcataaacattcagttcgc

SEQ ID NO: 147460 - DNA, 140 bp, Homo sapiens
caggaccccaactggctttttctcctcctcttctcctattctcaggcccatccttctattgtccctctaatatttttcagattttccataatacttgaagtaagtgtacaagggtacatttaggagacgggatgtgtcaa

SEQ ID NO: 147461 - DNA, 269 bp, Homo sapiens
gtggaataacaaatatcagtcttcaaacatttaagcaaatgaaaataaaggtcaaatatccttgtttgccctttgcagctgaaagggcaagttacacaattcttatgtatttttccatctaatcttctgaggaaagaaagagaatctgaatttacgttttgcaaatggctcactttttcttactttgccaatagtggagaattttctgtttcaagactcagtgcgttagtaggctaatggacataaagaattccaacactgctagttct

SEQ ID NO: 147462 - DNA, 1284 bp, Homo sapiens
actcttcatttctaaaccatggttcattgctttgagaggctgttattttagtgttagtctttgaatattggtttgaaaatattacagttactattttttatgattggtattaggacttatggatttgctaaaacaaaatcatcttgtctcaataacgttttctctctttcccaccacattcttccttcctgaattttaatatgtgttataccacatcatcagttatatcttgctttccaggattgttgtgaatgcttgtatgtgagatgcttttacataagggctaggatttggagataattctgcggtggggaaacaactttctctccttccttctccatgccagcctcttcccctacccccatgtataaaatgtgatttgtcagatcctttctagatactatgaatcgtggatttagatatggtagtcttcctctaacccccttttgcagaacataaacatttctcatcctctgttcatacaattttttactttagtcacatgaaaacattgtgagaatggaatcttgttccattaacgttaaccttggtggtgtagaaattaggacatgaagcatgtcactttcagtgtaaaatatgtcaaggaacttcatttctttcatcaattcctgacaattgctaatgtagtaatgcactttagttgctttgagcactttgggctggtgagaagggaaatacatagtgtctttgttaaaagaatgagtgaagagaagagaaaattttaaaagaaattggtgaaaggaaaataactttggcttttttattgttatttttatactgaagtagacaaacaattgttcctgttcttcctgaaggaattgttgtcacaattttattattattagataattacctaagcttctgtgttacaagctgtggcctcagttctaggtggtggtgcttgagtgaacattttacattttgttcctgacagctggccagcattgtgtttatattggcatggaaaagagatatctgattcagagaacagtgttttccaaggattgtgactgaagacttccttaatggtgtaataatgtacctcctcataaaaacaggtttgacagctgtagctcattttttgttgttgaaggaagttttatttgttttgtttttaactacttttaataaagaattgagatccagtgtatgattaagatttgtaagaaattgcagattccttaataaagctcgcatctacagacatgactaatcattgataataataaatgcaaaatattttaaattattaggggtagagtt

SEQ ID NO: 147463 - DNA, 652 bp, Homo sapiens
gaggagatgctgccacctaggttacttgtaggaccctatacggcaacctcctttgccaggaactatttataaacatcctgcaggaaaatgcagtgaagtagaagagacagggatatcccagaaggttatgcaaaacatcaagagaagatgagaggagtctatatgtcagaatacacatttcccaccttgcccaacagtagaaaaacataagaagagaaaaacattaaaaaatgacaaggaagttaatggaagtcagcaatgtgatggtgtttggaggtggagccttcagaaggtaattaatgcccttgtaagaagaggccagagagcttgcgcaccttcttcctgccatgtgaggagccaagaagccggctgtctgcaacctgcaagaggaccctcactagaagctagccatactggcatcctcatcttggctttccaacttccagaactgtgagaagtatatgtttgtggtttagtcaatggtctatggtaatttttttatagcagtcccagccaagacagtgcctcatttactacataccatttatattattatataggctcctttcagaaacccatgttcaaataagagataagatactgaaacacataacaccttcactagtttttagtatacaaatattgagaaata

SEQ ID NO: 147464 - DNA, 1223 bp, Homo sapiens
gaggagatgctgccacctaggttacttgtaggaccctatacggcaacctcctttgccaggaactatttataaacatcctgcaggaaaatgagtcaaggaagcttttcttttgagctatttacagcttttagcaattgagtaaagtatactcctgtgaacaaaatttggaacatatttgtttctctctaactgatttctccagaatttggaactagttaaccaggaaccctctcttggggtgtggatcgagacccctttctggtaacgagagcacagcttggttttatacattttaaggagacatgagacatcaatcaacgtatataagatgaacattttgatctgaaaaggcctctttaaatatacacttctctgtagtgtatgctagaaatggagtggctggaataaaagtggctgaatcatcttcaactctagtagctgagaccaatgatgctgacctccctcaaaagctgcatttctgaatttctgaaggcaaactgtctgcctatattgtacagcaaaataatttcctgtattaaaacgtttttattgctctaaatttctagattaaactctgcttaggtattgctaagagggtagccaagtatagaaacttaaatttactgacagaaatctagagaatgcttaattttttttccagcagtgaagtagaagagacagggatatcccagaaggttatgcaaaacatcaagagaagatgagaggagtctatatgtcagaatacacatttcccaccttgcccaacagtagaaaaacataagaagagaaaaacattaaaaaatgacaaggaagttaatggaagtcagcaatgtgatggtgtttggaggtggagccttcagaaggtaattaatgcccttgtaagaagaggccagagagcttgcgcaccttcttcctgccatgtgaggagccaagaagccggctgtctgcaacctgcaagaggaccctcactagaagctagccatactggcatcctcatcttggctttccaacttccagaactgtgagaagtatatgtttgtggtttagtcaatggtctatggtaatttttttatagcagtcccagccaagacagtgcctcatttactacataccatttatattattatataggctcctttcagaaacccatgttcaaataagagataagatactgaaacacataacaccttcactagtttttagtatacaaatattgagaaata

SEQ ID NO: 147465 - DNA, 275 bp, Homo sapiens
aaccgtctctcccagaaaaggatggagttatcggtctttccctattcctgtcccccaccattatttgtgtgtttgtcttccttacctcttgtagattaaattcctctgcagtactagcctggtaccttgtaaaagcagttgcacgaatatttctttcctgagttaaactgagaaagtctaatggttataattctctaatttctcatacagaaatccttttagtgtccctgtttttaaattaagagcaacttatcttctgctatttttggagtttt

SEQ ID NO: 147466 - DNA, 238 bp, Homo sapiens
aggatggaatgggaaggtgatattcccccagagtttggctgccccacagccgatctcctctctgactgtccccagctgaactcctgttgatgttcagacgctccttctcttctcttcttctatgccatgccactctgctgctctgtcgttctgctactcttctgttcctctgctcgtggagcttggggtttatgtgggcacagaataggggcatggcaggccagagtggtcttagaaa

SEQ ID NO: 147467 - DNA, 239 bp, Homo sapiens
gaggcagaaaggactctgtcatcattctgagtctctttctctcctttgtcaaaaacaatttttttctttgtaaaaaatttctttggggtctcgctatgtttaccaggctggtcttgaattcctgactctactaaaaacacaaaaattccctggatgtggtggcgggtacctgtaattccagctattctggaggctgaggcaggagaatcacttgaacccgggaggcagaggttgcagtg

SEQ ID NO: 147468 - DNA, 442 bp, Homo sapiens
taggttcttctccgtgctgtaaagtaccctgaaactgtgaaggtgccctcaattagagaggctgagaaaacaaggatcccagagcaagctcttcaagcctcagacagagagcctgccaaaccagtctgaatatttttagagtaaacaatcattaataaatatgagctacatttatactcacaggaatccagattatactcatacttttttaaaaaatgggttgcctctaagtgtattcaattcacccatgaagaaattttgttaacatttaatggtaggtgtctaatgaacatctgtggaatatggaattaaaagaataagttgatggttcttaacatactattataaactaaatatgtattacaacattttccttttgtagatggaaattattctatacttcacagatgttgcttatatagttaataaatactctacaaac

SEQ ID NO: 147469 - DNA, 333 bp, Homo sapiens
ataaaaatgttaccattaaaaataggattagtattatagaataaggatttccccattagtcactggttaatacgtaatccaggttggcagaaactgaaaggcagttgcccagatgaagcaaattcaccctgactcacttcatccagttctctctggctttaaccacatcattttcccaatggtagccttttatccagtggcagtaatttcccccagaggtgccaaatgtctgatagctgtgtaagtcattcactaattaattcatccagctggccaagacaccatgagtgcctagtatgtgagtgtcaggcattaggctgccctctactaatg

SEQ ID NO: 147470 - DNA, 581 bp, Homo sapiens
tcaaaatatacttttatcatttaaatgtcttatttgctgctatgaataggaaataacattttgtatagcaggctctgttttaccctaacattaaaaaatttcactgatctttctttcattaacagggtagaatctcctaatttccactttcttgggaatatacttttatagacaatagaagcagttctcaatattagcatatactttaaaaaatcaaagtgataacttaattcagctttggaagtatctcaaacatatttttactttatagtgcattaacttgcttctagagtacttaatgcaactgctctagccacttaattttttatactaatctcaacattaagaaatttggattaagtaataaattagttatgtaattcaagtaatctgaattacagcagtacttttagtgatcattcataggactatatattaacccagctaataactcagtttttttacaaaatgtttcgagtattattggtaaaacactgttctaggctaagcacattgggactgtaaagaaatgagtagatccttggcttcaagtttacatctggacaatttataatctagtg

SEQ ID NO: 147471 - DNA, 385 bp, Homo sapiens
aagaaatctttttttcagaaattgaattactatttctttcactggaggatttttgatgatagaagataattgtaagtaaaggtaatagactgaggtgggcggcaaagaggacaggcttcgagtcagcctcttctggtttcagattctggcctcaccacttaaccagcttgaccttagtcagagaggtttttttgagctaagactcatttttcttctctttaaaaccaaatcataatgaatccttcatagatttgttgtacagattaaatgagatggtataaaagtgcttagcctaatcagtgatatataaacaattggtagttgttgctagtgttattaacaagatatgttttcataatttgacagaacttttgaacttcatgat

SEQ ID NO: 147472 - DNA, 278 bp, Homo sapiens
tgtgacaggaaaaactaccagaaaaaaattctcctttgaccaccatgttacactaatggacagatatagaaaaataagtattataaaaattctaacaggaatttttttaacagaaaaaaattgttggcgaaggattgataatatacacacaagcaaaccgaggcactataatttactgattgctctcagagtccagaattctgaatcaataactttagacttttggtcaatatggactaagcagatccaagaagcatttctactctgcttcaaatgca

SEQ ID NO: 147473 - DNA, 256 bp, Homo sapiens
atcatgctccatcctgattcttttggaagctcagagaatttccattcgtaatctttattttgtctttagcatccccgggagagaaaagggcgtagaagtattctcattttacaacttagcaagttgtccaagcaaagctagaacatacaccaggacaatttttgcctagtgctatttccacttcttcacacctccaattgccattgatctatgatgtcatcacactcaatgtgtattaagaaatggggccggcgtg

SEQ ID NO: 147474 - DNA, 714 bp, Homo sapiens
gtttctcttgcatttaactcacttctgcaaacatttatagagtactattctatgcattgttgagatcagtctcagtacaagcccctgtttaatatttctttctcacagttggaaccatttgatcccatcttaggctcagtcttatcttccactcagcaggcccatcttacactggagaaacaggactttggtccagctataaccccataaccttgagcttgacaccagcatactctggctgctgatttagctccactgagatgtccagttctggttcttatgagtccctgtgaacctactctgtaccctattatggcaccaattcttctgccttggaccgtgttcctgcctcatctcttctttgttctggacagtctcctgtatatggagaagacatttttccagaatttcattctgttggctgaaaatcacctatttataacaaattccccaatgctatctgcaagttttatttagcagtattgtgctaaccttgtatttctgtgttctacccactttaaggttctgagttataaggctagatagattaaagttagaataccagttctaccattactagctatgtgatattgagaacattctttaagttctctaatccttgatttctttatgtgtaaaatggaaataattatggtacctgcttgatataaggattaagcaaaattatttttggaaatgagcacccacaataag

SEQ ID NO: 147475 - DNA, 523 bp, Homo sapiens
gatctgaggagctccccatcccctcctctctgtacacttgcaaactcaagtgaaaatgattatccagggagaactcgaggggaataaaagtgatgaggggagccttaggaggagcatggagaaggggcaagtggaggcttgctctgcaataagaagcttttgagtgagaaaattatttgctgtatgggactgccctacatattgtgaaatgtttagcatctttggccctgtttatgagaatttcatgggatctgttagtgattgtgacaggcccagaagtattgtgacgatacacacacacatactcatatactcacaggtccacatacccttagttctcgtttttctggttccttatttctctccatccctaactacctggagagcaattctagagccttctagaggcctggggcagtgacctgcaggagcatatgtttactgaggaagtattttgcaatggttgatcacaggactcaggaatcaaactgcctggtcaaaccctgactattgcacctgctgg

SEQ ID NO: 147476 - DNA, 318 bp, Homo sapiens
gagtgctatgatagagatatacacagggtgttgcagaaccatacccagaaggcttgcaaaaggctttccaaaaggaagtcacgcctacgttgtgttcaaaggttaggaatctgggcaaggatgtccgggaagggtgggatttcaagtttaggaacctgagtgcaaaggaactaccagtgattattgctgcagtttagagcttgaggccgggcgcggtagctcactcctgtattctcagcactttgggaggcggaaggaggcagattgcttcagctcaggagttcgagacccctctgggcaacatagctaaacctgtct

SEQ ID NO: 147477 - DNA, 142 bp, Homo sapiens
ctctagttttttcatctgtaagaagagagatgtggataattgacagtaatgccaaaactaaactctaagcctttctaaaactaaccagctgtgaatgttggtaagtcacttagcctagacttccactatcacacaggctcac

SEQ ID NO: 147478 - DNA, 284 bp, Homo sapiens
ggatagcaggaatggaggagagtggatatgtttgagagaacattcactgggagaacaaaagtagggttcatgtgctggaaacttaaatcccaatgcaacagtgttgagaggcagaatctttaagaggtgattaggtcatgagggctctgcccttatgaatagattaatgccactatatcaggggtgtgttagtgattttggaagtgggtcctgagaaaaaggatgaattctgcccccttgttgtctcttttgtgctcttgctatctgatgccttccaccatggg

SEQ ID NO: 147479 - DNA, 753 bp, Homo sapiens
gcgatttcaagtgcaaggattcagagagcctgtccctctctgcggtgtacttagagggcagagttggcatgtaagactgggcagagctggaaggatccatccctgtgttaagttttgtgggagcaggatcttcgtttttcttccgactagattcccagtatgtagaacggtgcgtgggcaaagtgtgaactcattcattcagccccttcccaccttctgaacatccagagtcctggctgtccagctgtttcctggaggagtagccgagaatggacaagccatcacaggatacacacttccagttccctgtcgtcagggcagggccagaaggagtggcctaggttagcagcggggatgggcagtcctggacagcttcctgaattaggaggcactgggtttaggtcctcgtggatctagacctgagaaccagattccagatgctccaagaaagcccagagaaaggaattctcttttctgaattttcttgtgaccttccataaaccagggtggggcctctcctatcacacttggcactttttttctttttctgtttcattttatttatttttttgagacagagtcttgttctgtcgcccaggctgaagtgcagtggtgtaatctcagctcactgcaacctccacctctccgagagtgattctcctacctcagcctcccaagtagctgtgattacaggcacgcaccaccacacctggataatttttgtattttcagtagagatcaggtttcactatg

SEQ ID NO: 147480 - DNA, 784 bp, Homo sapiens
gcgatttcaagtgcaaggattcagagagcctgtccctctctgcggtgtacttagagggcagagttggcatgtaagactgggcagagctggaaggatccatccctgtgttaagttttgtgggagcaggatcttcgtttttcttccgactagattcccagtatgtagaacggtgcgtgggcaaagtgtgaactcattcattcagccccttcccaccttctgaacatccagagtcctggctgtccagctgtttcctggaggagtagccgagaatggacaagccatcacaggatacacacttccagttccctgtcgtcagggcagggccagaaggagtggcctaggttagcagcggggatgggcagtcctggacagcttcctgaattaggaggcactgggtttaggtcctcgtggatctagacctgagaaccagattccagatgctccaagaaagcccagagaaaggaattctcttttctgaattttcttgtgaccttccataaaccagggtggggcctctcctatcacacttggcactttttttctttttctgtttcattttatttatttttttgagacagagtcttgttctgtcgcccaggctgaaaggtggtcagggaaggtgagagaaggacactgaagattcaggaagggcctgagagacgagggagccagccaccttgggaaagaacattctggaccagcaggggtcaggaggacagtcccgtgcaaaggccctgtgcccaggggacacaggagcaaacagaagggcaggaaatggggagga

SEQ ID NO: 147481 - DNA, 687 bp, Homo sapiens
tgaacccgaggaaggctgctgctgctagcgcatccgctttcaaactacatctgagcactccacaccttcttctaggaggttccccagattgctgctagcgcatctgctttcaaattacttctgagcactactcaacttattctagcaggtcccccaccttttctgccttcctaaggcattttccttggctaagaagtctccatggatcaatgtgatcctaaggcctcgcgctgacacagggaaggactcggagagccccgagtcaagaccatcctagagattctcttccccgatgcctttcctcctcactatggcaaaccacttcccttcactgacccacgagagagaacttcctgattcaggagggacaggaagagagtggagatggggacagttcattttcttaacccctggaatgatgggagttgacagaggaaaggcgccttcccttcctttccagcagcacaaaaccaggtctgcactgggaagatttggtttaagctatgaacgtggacttctccatcatctaagtgatgaatctgtctttcacaggattcttctataaagccttcatagccagaagtgatttcgaggtccctgccaacttaaattaggttaaaaaccttttcctaaagagatatgacaaccaaacgcgatgcatgatcctggcttgaatcctagatgggg

SEQ ID NO: 147482 - DNA, 535 bp, Homo sapiens
gcctgtgccgagcacatcgtgtacctagtatttccttccaccacgggcttccatttctggagaacaccgacggtcggcctgaagaatggagctgtagaaacggcgctggtatcaccgcccacctgctccagccgtccctcctggctgggaggcccatcgctcactcccggcttccaatttccctcctgatccgagcacctgatctccttgggctcttggcgctaatctgcagccatctaacaccctgcgcccccgaacgaatgtgccaggaaatcttacagacacaaagaaccaattctgcagcatttccgacttccacctcagctgttttgcatctctctggactgagggcctggcaagacacctggcagggaaaatccatctcgtggagggcttcatcagaatacccatcccaggaacaccagcagttaacaggaaagcagtttcagctgtgaaaatagatgcttccttctctagtatggggacagggacacaccttggggacacacactgcccccacctcataggaaggtgc

SEQ ID NO: 147483 - DNA, 207 bp, Homo sapiens
aaatctgttgagttgactggctgggctgccttctgtctagtctgccacagtgagctaggctcctcctgaagtgaactaggatcagtgagggactaaagtcaatctgtagcatgaagatttcacagggcactcactactgcacacaccaaactcccacaaaaggaagagggggagctaatatgtgttgggcataaaatttctgcaagc

SEQ ID NO: 147484 - DNA, 167 bp, Homo sapiens
cctggccgctccttcctttttctatcttggataatcctaccactgtttctgctaccactatgaagctgggtgtatattcctactctgtttcctttctgactcctgactctccttaagtctctacatttttgtttctatttctaatattctactcattctgagatctc

SEQ ID NO: 147485 - DNA, 226 bp, Homo sapiens
  misc_feature (13)..(13): n is a, c, g, or t
tacttagaggacnccattcagagtagccagaaggtacatttccacactcattattaaaggtgatgtgattactttggcaagtttccagacttttgcatggtgtctttttcacaacttgtgtatatttcacagcttcacaacatatttataagcaattggttcaactaatagaaaacatgctatttacttcccttatctttgggatctgacactaactctggaaagt

SEQ ID NO: 147486 - DNA, 374 bp, Homo sapiens
gagttgggggaagagatgtcatgagttcctgggctttggaggcaccagacctgagtttaaatcctgggtttgccttttatgaggtggatgacactggccaaattcccctccctctcacatatggagcaaaatgtgagcacttcagtgcaggagcattgtggcagttttttaaaggcctccatgcctttccctgggtatttaatgctgacaacagctttcattagagctcagcatatccagttttatgaaacatgcagtaaagactttgtaagagtccttaccactggaagataaagtgtctttatcttccacttcagcaaagctccagaacctgggactgccaaggaggatctcataatccatgtcctgtgtct

SEQ ID NO: 147487 - DNA, 408 bp, Homo sapiens
gagtgctttggtgctttagcgcttcagtcaaattaccagtggctctaattagtgttcctgaaatctggagcaatctatatctgcattccaaaaaggggtggaatgtttccctctgataacacattagtatgagtccttcctagatgggtgttctgaaattataaggacgtgatagtgtggaggagaagcagttacgatagagaaacctgttgctttgaaaatcagcagtgatctttgcaatcagctgattaataaatatttatacagtacctatcaagtgctacactctgaaaaaaataagtatgcaatgataaatcacagtacgggcaccaatgtggttctgacctggaagcgagtagacctgagccctgacagccacttacgattgctgctatctttggtttaatc

SEQ ID NO: 147488 - DNA, 484 bp, Homo sapiens
tgtagcttaagaacagacacattttgccaatggtgttagaaataagaaacatggttatctctacaagtgagtgttgggtgatgggtactaaatgaagcagcctcacccaaaagtggacttgcaaaaatgcacgtgttcaggtggatcctttgactcactctaagcagagtaaacaaagaggtggaaccattaggtactgagattttagctgttggctggtcaggtctggcagttaataaacactggccacctcaacaaatggtcaagtgacattggccttgtgtcactgcacatacatccaaaacacattgcactggactctcctgttttagaagtcaattttcaaataataaatataaattttgtaatggtcatgtctctctagccatttggcttacagggatatatcctgtagaaatacatcttcacaggaatattcagtgcagtattatttataatattatcttcatcttacatgtgagga

SEQ ID NO: 147489 - DNA, 918 bp, Homo sapiens
gaatccatatctgtggatgccttatacttaggcaacactgtcaaaaatgaaataaaatgaaatatctgtactttggagcagaaagtatgattcaatgttagttacagccagggctacttaccaatcttggtcttttatcatacttcactacttctatcatacttcactactagggatttggtagtgaagtccacaagttgtgtggcttagaaccatagaaaaatttattgtttcacagttctagaggctgaaaatccaacatcaaggtattggcagggttggttccttctgagggctataaagaagcatctgttccctgttccttccttagcttctttggttttctggctgtatttggcattcctaagcttttagatgtattacctttatactctgacttcatcttcacctggcgtcctccctgtgtgtatatctgtgtgcaaatttcctctttttaagaacaaagctggaggcatcatattaccagacttcaaactatattacaaggctacagtaaccgaaacagcatgaggctggtaccaaaacagacactagaccagtgcaacggaatgaaaagcccagaagtaaggccacatacctacaaccatctgatctttgacaaagttgacaaaaacaagcaatggggaaaggactccctattcaaaaaatggtgttgagataactggctagccatctgcaaaagattgaaactgaacccctttcttacaccatacacaaaaattaactcaagatggagtcaagacttaaactaaatataaaactggaagtattaggaatacctttggttagacgggaggttctggaaagaccaaatgggcaacaatgggggcctttaaaaggtggggaataataagggaggaacgcgggaatggaaccgaggtagttgggattggaaaa

SEQ ID NO: 147490 - DNA, 417 bp, Homo sapiens
gggcttcttgctcttctgctcttgctctgtgttctgcctggaatctctgggatcttgaatcctttttccctgtgattccttatcacatccttcaaaatgcagagcccccaccccacacaacaacacagcaacagcagtgactgcaacagcaaacgctggtggttggtgttcaggagagctctttggcctggatggtggttgagtaactgtgcgccttcaagtcagcacccagatgccttttctttctgtggttctgctgctccatggaatctctcggcagctccggtcctggtttgcttggccatgggcctctgtctcttttctttccttgggcttctacctgaagcagacccagggtgctgagggctcctctttggtgtgcaggtccttgcccatgacttctcgtggttgatgatg

SEQ ID NO: 147491 - DNA, 263 bp, Homo sapiens
ttcacattcacagctgctcactgcacactgaggtatactgggtccccaagaacactcagccctgggcctggacctcaagcatacagagcctgacacaggcacccctaacctccctgggggcagggtcaaggtgcagagagggccacaggacaaagggagactggactgggggaagcaagctagcgaggagaagggggttcctggaagaggggacattggttctgggctttgaagcatgagtaggagcttctaaagcagatgga

SEQ ID NO: 147492 - DNA, 304 bp, Homo sapiens
gtcaatgacacaagatggaaatacatttcctaggcccagtaactgatgactcatgaaaaggtaaaactgctgaactgtctctcaatgataaggaacagctgtttccaaaatctgagtagctccaatttcatctgccttatggaacagaaggcaaactgttatagccgttgcccaggctgacatctggaaaccacggatggggcaataaattaacataaaagcgatgatcaaagtcaaggtaataagaaggtaattctacagaaaaacagtaaaaggaattatttcatatatccttgcctccatg

SEQ ID NO: 147493 - DNA, 199 bp, Homo sapiens
  misc_feature (17)..(17): n is a, c, g, or t
ttcactttgtctctatnaaaatataaaaattggcagtcacagtggctcacacccgtaagcccagcactttgcctggaacagctttgatcttctttacctactaactcttactctgccgtcaggaactcgtccggacgccatctcctctgagaaactactctgaggccaggcgcaatgtctcacacctgtaatcccagca

SEQ ID NO: 147494 - DNA, 178 bp, Homo sapiens
ggagacatgagtgtagattaatcacagttttattttggagaatgagatgttgtaagtagtgtggttgtctatgactggggaaatgtatttgaaaaacgtggtgggtgcacatcattgaggataatgcagcaagagtagatagtggtcatatagacgtagacagagctaaagaaggaaa

SEQ ID NO: 147495 - DNA, 182 bp, Homo sapiens
ctggctccctgctggtctagtacagttccatcctcatggcttctctgcttccacctatgctctactgtctgtcccccacacaacagccagagggacccttttattttattttattttatttgtttgagacggagtgttgttctatcgcccaggctggagtgcagtggtgctatcttgtgctc

SEQ ID NO: 147496 - DNA, 227 bp, Homo sapiens
ggagccccacagaatgacaccattgcaggtggcaggagaaaggcacccccacacacgacaggctacagggcactaggcagggctcccaggagcctggatttgccaaaaccagcagttctggaagaaagcaatgggtcaggtgctgtccagaagctaacatccagggccacgtggcgcaccatggaggggctgctggtggccttggcagagcagctttgatgcgatgg

SEQ ID NO: 147497 - DNA, 343 bp, Homo sapiens
tgtccctcccccatcccagttgtgacaatcaaaaatgtctctaaacattgccaaatgttccccgaggagtaaaattgcctctagttgagaactactaatctaatataaaatgcttaaatagtggttaaccttatatcttggtatttaagtgacaggatctcaaagggggagtgtaactcagctagtagaaattaaacataatccaggatggataaagtagactgttttttttttgtttttttttttgagagttagttagcatgtcttcagtcctatgaaggacagttacaccttgttaggtggaagcatacttttacttctgtctttatttggaagctaaata

SEQ ID NO: 147498 - DNA, 187 bp, Homo sapiens
gcacagacacgcagtgtcacagggcagttgagactgtgttactgagcccagcggacaacctgggaacacatcctggtgtatcaccttactggctgcaggagctcagggacagccgtaatcactctgtgcctcagtttcctcatctgtagaacgggaccagtttgcatgaggctcccgggcagagcct

SEQ ID NO: 147499 - DNA, 428 bp, Homo sapiens
ttccatacaagggttgacttaatacagactgaatatgccctttggtcttctcccagataaacgctctagaaagtcatcatcattgccagacagcaaggtactttgttgtgtatcagggtccccaggaaaattcaaacatgcaaaataaattcttaaatggtttgcagagaaaagtaagcaacttgagtgtagcatgtaaactgaggagccattttggtgcttggcagttaagtacttcttgaaggtccccctggtttttccttgaagtcttttaaatctgatccttcagcatgtaagtacttttacttttcaatagagttgtagaagaataatgattatattcatgagtttgaatgtttattaaataaaaaaagactaaaaatggtaacactttcttagtgaaccttttttgttggaaacagaggcaa

SEQ ID NO: 147500 - DNA, 144 bp, Homo sapiens
ccagaactccgttaaggcagatgtgaattccagtggctgtgaaggatggggaagagactgcagtgattctgtaacttttaattgctccatttacctgctatggtagcacatgaatgctaccactccttacatgacatggagggg

SEQ ID NO: 147501 - DNA, 372 bp, Homo sapiens
cacaactctactgcataacacagttgagataatccattcagtcagaacaacatgatcagtgagcatgggccacccagcctcgaagatcgcctttctggcgactcattcttgatccagtaagtgggaactgttgtaggagtatgtagcctgcctacatgagggagagtgttgtaagcagtgaaacatacaggattattctcaagtgatactcatctgcttaagtttttcctaccatggtccttggctctggttccagattaagtcagggagctatttttagcttcttaatgtgtcttttatttgaacctaacagactcataagtttatcacccagtgttaagtgctgctaacgttttggcatattttctttct

SEQ ID NO: 147502 - DNA, 303 bp, Homo sapiens
tccaaataaggtctatacattgtacattagtacatctattaagtttggtaaagcctctttttcagagtattggcatgaagagttactaggattggggctgggcatggtggctcatgcccaaaatcccagcactttgcgaggcagaggcggatggatcacctgaggtcaggagttcaaggccagcctggccaacatggtgaaaccccatgtctactaaaaatacaacaacaacaaaaaaattagccaggtgtggtggtgggcgtctgtaatcccaactactcgggaggttgaggcaggagaatc

SEQ ID NO: 147503 - DNA, 769 bp, Homo sapiens
gttatgtgatattgacagatttagtgattatctggtttttcaaccttaataaaagcttatttcagtatcttatagctacacgtagcctttaccattcaatatgtttttgacttctcttcaatatgtgtacaatataccttattaagaattacatatgcactggggacagtggctcacacctataatcccagcactttgggaggctgagatgggatcgacctgagatcacttgagcccaggagttcgagaccagcctgggcaacataggggagaccttgtctctacaaataataaaaacaaattagccaggtgtggtggtacatgcctgtggtgttagctactctggaagctgaagctagaggatcgccagagcctagaaggttgaggctgtagtgagccatgatggtgccacctcactctagtctgagtgacagagtgagaccctgtcttaaaaaaaaacaaaaaaaacataagaaatcactgtctgtgctttccaatgtggtagctatgggcaccatgtggctactgagcacttaaaatctgggtagtccaaactgagatttgctgtaattatagtacaaaaaagaatgtaaatttctcaaagcaattttttaatactacatgttgaaatggtcatatttgagaaatataatattactcattatttcttgtttgatgagcttatgagaaaattaaaaattgtataagcaatttgagcaatgtatcttttggatagtgctgatctatatgattaaacatatcaccggga

SEQ ID NO: 147504 - DNA, 205 bp, Homo sapiens
cagttcatcagctcagtggtatcatggactatattagttaggatatagctttggctactataaaaattacaacggctgaaataagacaaatatttattttggtcttatgaaataatctgagcataagccatccagggataataccgtggcttcaaaatatgaaggaactggctggccacggtggctcatgcctgtaatcccagca

SEQ ID NO: 147505 - DNA, 709 bp, Homo sapiens
ccagcagtgtgatggaggcagcaaaatgtgtggaaccgtcattatgaagaaggcaatgctctcctgcaccagggagctcttcaccccacaactacagagctcctgtcttccaaggttcccgaactgttctgggaagtgctcctaatcacctgaggtttacatacaaacaaccccaggacatttcatttagctaccaatgtcatgattaccaaaaattaattaacaatatggtggtcgtcatcacatctgagtcaccaaatcaaaattcaggacacatttccatgcaaagtgcagccttcttcttacgtttcataattgtcatttcaaatgagatcttggttggaaacaattgcttaactgtttcaaggtatactgggttatcactaactcatttctgtaaagcagaatacaagacctcaacctgttagagatcctttgttgattaacaagctgattaataagctgattgttctcctgatttaaggcctataccaaaattcttgaagctcaatttgcaccacagagtacgccaatatgtttgagtgaactggctctggctctccgaagctgttttgtaaagacaagagactataagccatggtgagtagttatacatgaagaacctcaattaatgccttacatatggcatgaggagactagaaattttcttgttaatggggcaggggtataataataaatatcttggcaa

SEQ ID NO: 147506 - DNA, 220 bp, Homo sapiens
gctgtaacttttattcatcctattggtctcagcttaaagattatacatttagggtgggtgaatgtgcacatgtgtggtaagagagggggctccctgactcactcctagactaggttagagactacctgctttatgttgctagaccacctatattttctttttattacacacactggactttattgcacttgtttgtttaaatgactatgagctccacaaa

SEQ ID NO: 147507 - DNA, 387 bp, Homo sapiens
ttcaatcttagaatgctaaaaatgagaaaacgaactatatgaagattaaattacctacctatagtcatgcttatgaccagaagtcaaatatcatattgttcttgtgctgtatacgtgtggtgttagataaacgcaacttttgttctcatgcgtcacttcgccatcaagcgaaagagctgttggatagattagatttttgttgtcttacatacagagtcctacacaattgttcctgatctcttctaacctcatacctttcactgattttgctctggctattggccttttcttttctcctaaaggttgtcatattccttaccatttcagagcctcataaaatgctgaatctttctacataatctattaatctttgtgtttctagcacct

SEQ ID NO: 147508 - DNA, 359 bp, Homo sapiens
cttgactctatgaggatccccaattagctggggcacaggaggggtaaaaagctgttattgactgagatggcaaaatattatgagagacgtaggtttgggatgatgaaaatcaggagctccacttaggacaggttaagtttgagaaccagacttaactgttggataaatcagtctacagttcagagggcaagagctgacgatggaaatagaagagttgtcaatagacagagtcctggggcatttctgacatttacagtaaactgagcatttattaaaactaacttgctttactgaaccataaatcacttgttgtatttacccctgctccatttatagttatacatctggaaacatagcct

SEQ ID NO: 147509 - DNA, 524 bp, Homo sapiens
tgctgatgagcatttaggttggttccaattattttccttttgttttttgttgacagtaataattgcacaaatttatggggttcaagtgatttttttaatacacgtatacaatgtataatgattaaatcgggcaattaggttatccaccacctcaaacatttatcatttctttgcattagaaacattcaagatcctatcttctagcttttttgaacatactaataaattgttaatcttttgatactgtgaaagattgttcttgtaacctcatttattttctcagaataaattcctaaagctggaattgctggcatgcacatttatagtcttcattgatatggccaatagccaccacaagagaaccagtctgtttcttcgccactctaagttcgggtcattgttctttctctctctctctctttttttttttttaaattcttattcatactaaatgttttacacatgttttaaagttgactttcattggagggttgagcctctgttcacatgcttggtaggctcta

SEQ ID NO: 147510 - DNA, 371 bp, Homo sapiens
tggaactgctggatgaaagcaacactgaagcaggttgggaattagataagggcaggtccagatatggcggtttaagacaaagggagactaacacatattccaatgctaattggagggagtcccgcactgaaggaaaaatttgaccatgcaggagaaagggagagataatctactgcatacagcactcagtaaatggctactaaccacttagaatgtgtcaggctttgttgtggacatgagagtacagcaaggatggaaacatttctgcattaatggactataaaataacaggttaaataataatacagaggggactgtcagccactgtggagtaactagcactagatcagtccttcctgcagtcaacaacc

SEQ ID NO: 147511 - DNA, 358 bp, Homo sapiens
gtggtatttggagccaccttgcacggctgatgacagtcaagtgctaaatattccagaattttataaccagattcccctggcaccttaaattgggcaacagaggaaacagtcacaccatggaaaaccagcaaatgctgactcccccaccctgcttcccagagcaggcttaccagcacacccctagctcactccctcaatgtttttaaggagagaaaacacttcttccagactagaacaggaaaaacgcatatactcaccaatataccaagaaaatgcaaataattaaccacatacaacagataagaaaacaactgatatagttattccttatcacaaagactgacgcatggaagaaaaa

SEQ ID NO: 147512 - DNA, 200 bp, Homo sapiens
cctaatcaacagagccgtcgtttaccaaaatgctgtcagatttgatgaacgtcatcggctcttagcattaaattgctagtgaagggattggccttccagcaatttactgtggggtgggcgttccttaaaggtctctaaagcaagttcattgcaattattaaagcagaggctttgctctcactcagccaccatatcctgtg

SEQ ID NO: 147513 - DNA, 786 bp, Homo sapiens
taaggcctaaaaaatcaccatggagaagttccacttcggtggctccgttggggtagctcccaacaggcaggacctgggctcccggtgggggaatcctcacgtctcaccctccgagagcctgacatccccccctgcccctttccattcctcagcatgtgacacatctgggctctcaggctggacaccgggtcacccgccagtcctttgctcccagactgtaaactttgttagggagaatccttctctgggctggtgtctaagagatggctggttgggggtgtcccctgggcctgtgagagatcacaaagctgccaattttactgggccttttttttccctccaatcttaaaataattttggttaggtctgggcacggtggcctatgctttcaatcccagcagcccaaggcgggagattgcttgagcccaagcattcaagactagcctgggaaacatagcaagatcccgtctctacaaaaacatttaaaatgagccaagtggcagggtgcggtggctcatgcctgtaatcccagcactttgggatgccaaggcaggcgattgcctgagctcaagagttcgagaccagcctgggcaacatggtgaaaccccatctctactaaaataaaaagttagccaggcatgctggtgcatgtctgtaatcccagctactggggaggctgaggcagtagaattgcttaaatccgggaggtggaggttacagtgagctgaggtcgcgccactgcacttcagcctgggcaacagagcaagattctgtctccaaaaaaaa

SEQ ID NO: 147514 - DNA, 751 bp, Homo sapiens
agtatgaccaggagaccagcgggatatgaggaggtagacagggagaccagactgcatttgggacccccaagggagagagtttggaagaatgcaggggtcctagactagaagccaggagcttgagggagactgagccccttctctgccatctgctaactgctttgggcctcactgtcctctgtaaaagaagggagttacccctgaaactcacatgttgtatcctgtgtgctgaggctgtagaactgagcagcttcagaaaggagatgagagctgggagtgcagcagaggcagggacctttacgttatgcctatttctgggggccctgtcctttcctgcggccttgcctgcgctagctagtcactggggcttttacagacccatagcagaagattctgctagcctcttctgaagcatgttttcttgttcttaatgatagttaacttggctggtcataaatcctaaatctgcctcctctgaggtggggagcagttaaaatctccacttgattttcttgtttttccaactgtccccttctgctggtttccttggagtttcctgagcacatgcacagttggggtcctgaagacctggctggggtttacacatgattttggaggcttcccctctgtgactccctcctgcctgccctctcttttaagctcctctggctgtccccgtctctggtatccaactccccagggtgtcagagtgagcttttctgcctgagctccagccagcctgcactgtgcc

SEQ ID NO: 147515 - DNA, 209 bp, Homo sapiens
atcatagcccttgccatcactgacaagatcaacatatgtgaagtatttgactaatagtacaagatcatatgtgattaagtaccacagtaataacatggaaaattaggtggcagaggcattcagagatgggcaagacaggtttggaaggatcatggtcagctttatgggacgtggggtgacttactgtgtctactgtaactgtttttgcc

SEQ ID NO: 147516 - DNA, 496 bp, Homo sapiens
gtctaagaatggaggagctgaacatgagggtggctctaaccccggagacagggaaggacaggaggaggggccccaagtcaggccctctctgggctcccctgagggcagtcagctccatatcacaccagagacccacctggaagctgcctttcccgcatctctccccaggccccctccccaggagtccagatgtctggagccccacagccttagctggtgggggtcatgagttccactctgagaggacagtgccgggttcaaatccaagtcccacgttttatgggccgtactatcctggtcagtcatccagcatctcttaggtagcagtttcctcatctataagtctgggcacgaacccccagggatgctgggatggctctagctggtgtagtaccagcattggcctcacataaagcacaggtccaggcatgaaagcactcatgcccaatgcacagctttcccctccctctggcaactggagtgttgctgctgaggc

SEQ ID NO: 147517 - DNA, 524 bp, Homo sapiens
ctgctgagacctggctgataatggagcgagctgaacatatacgagtgggtctaacaccgcgacgcacggggatccgtactaggagtcagaggcgtgccaggttacgagctctctgtgtgtccgttgttggccaaatcgtctcgatatcaaaacaacatagcgagctggaagctgcctttcccgcatctctccccaggccccctccccaggagtccagatgtctggagccccacagccttagctggtgggggtcatgagttccactctgagaggacagtgccgggttcaaatccaagtcccacgttttatgggccgtactatcctggtcagtcatccagcatctcttaggtagcagtttcctcatctataagtctgggcacgaacccccagggatgctgggatggctctagctggtgtagtaccagcattggcctcacataaagcacaggtccaggcatgaaagcactcatgcccaatgcacagctttcccctccctctggcaactggagtgttgctgctgaggc

SEQ ID NO: 147518 - DNA, 126 bp, Homo sapiens
gataatgaaaacaaggctgagaaacaccgccataaacccaccttcagacaggaacaatgattcagactgttttccatagtgctttctaaactgttgtatattgttttaaaaataatttatcatatg

SEQ ID NO: 147519 - DNA, 477 bp, Homo sapiens
ctttccaccctcgtgcctgcattccgcctgctgtctgcctcataaagaatcccagctcccgacacctccaatttctctcatcacacctccgatttctctcatttcatcagctcctccctggctttgctttcagcctccgaggcgaatcccctcaacataccactcacttgcaaatataataccttcatccttgttcttctcccacacctggccagcaacactgcagccctggggcaggccagccatccacccacaccacccctgcacctgggtgctgaaaagtcctttggccacagagcagtgaccacagcaacggcactgcctccagcgcccagcggagtctcccacccccagcagtgtgtcatctagatgcccacggtcagttctttccccacagtggctctgttcatgtttcagagtcctcttcaaggtccccatcaggactcccctcccccaatgctctcatcagatgctctg

SEQ ID NO: 147520 - DNA, 674 bp, Homo sapiens
aacgatggtcctcagctcaaccagcagaaacatctcaccaatttcaaatcggagtcttgttctgcaacccaggctggagtggagggcagtggtgtgatctcggctcacttcaacctccgcctcttaggttcaagtgattctcctgcctcagcctcccgagtagctgggactacagcagcctctctacaagtctcctaacttaacctgatgggaaaacacttcctaccactaacagcatctacttgactactgatactttgatcatggagtttgggcatgccacttgatagaaatttgaagagcaattatatttttcaaaaagagttttgaataatgttaagatagattgcaacatgactatcaattcttcccttcccatcaaaggagagagtccgtttatccagcctttgaatcttgattattcaagtgacttgcttcacccaatgtaacattaataagcacaatacaagcagaggcttgccaagaacttggtttgtttctaatgcttagaagaagaatggtgtatgccatatttctgcatttagaactcacgtggagacatgtgtggcccaattgcttctctttcatctcaggcaataaccagacacgggactgaggccatccatgaccagccagccctagccaacacacaacacacaagctgatcacagatg

SEQ ID NO: 147521 - DNA, 368 bp, Homo sapiens
ttatgagaccctggctactttctagcctatcctgtaatgacaaaaacccgggtatcttcagtacctcaggaatggctaagtaacaagatcttcacttggctctgccaaaaacagcacataaaaactccagttggacaggatgtaaccagtgtatatcacaggggttctcggccaggatgtcattaactttccacatgtgtcctgccaaattctgatcaacatacaacatgtatttttactgccattgaatggacctactgctagagtcgtggtaccagatcaggcctcatgagcatccaagagggcaccatcagggaagtttgcagctcccatcatctggagatgcaggactacagggcccccagggg

SEQ ID NO: 147522 - DNA, 362 bp, Homo sapiens
agctctacctcctggagagctgtgaccttgagtccaagagacaatcccatcaagaccccacttaacagtctacaacatggagaataccactaccagccccccagagaaaaattaaatgagataatgtgagtaaatggcctggcctagtatcccacactttgcactcgcatacacctcattaaattgcagttggttaaagagagtcaaaaacaatttcatacagttagaaatgtgtgtgcacagggggtgtacacatgtgtgtgaatatacttcatgcaagtgtgtgtgtgtgtgtgtgtgtgtgtgtgtgtgtgtgtgtagcgtgtgtgggacacactggattccttgttgagcatctagct

SEQ ID NO: 147523 - DNA, 229 bp, Homo sapiens
aaaagagagcatgtgaaggaggcaaagggggaagagccccttataaaaccatcagatcttgtgagaactcactatcacgagaacagcatgggggaaactgtccccatgatccatttacctcccaccaggtacctccttcaacaactggggattctaattgaaaatgagacttgggtggtgacacaaagccaagccatatcattccacccctggcccctcccaagtctta

SEQ ID NO: 147524 - DNA, 357 bp, Homo sapiens
tcaatgaggatgaataattactttgagttttgtttcaaaggagagcaaaggaatggggcatacctgataagggtatgaggtccataggggatttctagaaagataaatgaataatagcatgttcgtatgccaacagaattttccattagaaagtgaaatattgataaagagaagcaggggagaccttctaggtgttgcctttgagaggtagggggaataggacttaattaatacataagtggaaggtttggctttagataggagcatggatagttgatctatggttataagtggaaagacagagaatgtaacccgagatgtgtagatggattgatatggcggtaagagactgccagt

SEQ ID NO: 147525 - DNA, 707 bp, Homo sapiens
ccagcaatcctaccccttgataacctcagcaagagcaattctcccttctcgctaaggccacattccgtgccatggccttcgtggcatggtttgtggcacaccaggagctgaagccctggggttgcatcactcagggtgggaatgatcaaatgtgttgcatccaagctctgaaatcctctgcaggagcacaggagtcaactgtacgtctccagggccacagacaaagagctgagaaaccctgttgaatgacggaagcagtcagcagaataggaatgcagcacagggacagttacggtgggcaaaaccatacacacaaaaaatccacaggtgcagggcagtggctcacgcctgtcatccaagcactttgggaggccgagacgggcagatcgcttgaagccagaaataggagaccaacctgggcaacagggtgagacctcgtctctacaaaaaaataaaattagctggcgtggtggcaaaaaaaaaaaaaaaaaaaaaaaaaaaaaaaaaaaaaaaaaaaaaaaaaaaaaaaaaaaaaaaccaccgaggcactaccaggggggggggagaaaaaggaggaaacaaaggggacacagggccaagagagcgtcagacagacacaagcgttggcgcaacacacgggggacaaaccagcggggccccacacgagaggcggcaaaaacatatgagaagcggggtcacgccgcgaa

SEQ ID NO: 147526 - DNA, 1027 bp, Homo sapiens
ccagcaatcctaccccttgataacctcagcaagagcaattctcccttctcgctaaggccacattccgtgccatggccttcgtggcatggtttgtggcacaccaggagctgaagccctggggttgcatcactcagggtgggaatgatcaaatgtgttgcatccaagctctgaaatcctctgcaggagcacaggagtcaactgtacgtctccagggccacagacaaagagctgagaaaccctgttgaatgacggaagcagtcagcagaataggaatgcagcacagggacagttacggtgggcaaaaccatacacacaaaaaatccacaggtgcagggcagtggctcacgcctgtcatccaagcactttgggaggccgagacgggcagatcgcttgaagccagaaataggagaccaacctgggcaacagggtgagacctcgtctctacaaaaaaataaaattagctggcgtggtggcacatgcctgtagtcctagttactccagaagctgaggtgggaggatcacttgagtctgggacatcaaggctgccgtgagctatgatcacaccactgcactccagcctgggtgacaaagcgaggccctgtctcagaaaactaaaatacaattgaacaaacacattccaaatgacaccacattttaaatgacccctttgggagggaggggaacaggactaggaaacagggaagaaggaaaaagcgaaaagctacagttctcccatctaattttcagctacctaaaaagctgttagcccaaaaggtgctggtgaggctgtgggtaaacgctgagggtacaatgcgagggacggacagtatcaaaggtagggtctttaggggaggcaattccctagtgtctcttacaattttaaatgcaggccacacaaggtgggacacatctgtaaaaccagcactttgagaggccaaggagggaggacttgagcccaggggttcaagaccagcctgggcaacacagtgagaccctgtctgtacaaaaagaagttttctaaaaaagc

SEQ ID NO: 147527 - DNA, 296 bp, Homo sapiens
agaaaagcatttgctgccttcaaagacccaaactttgcatcatgatccctggccattctgcccacaatagcccttgttctttagagtaaatggaaccctaaaacaactcatcttaaccactcaacactgaatatgatgctatatcgtatcctgctgtagttgacagggacatgtcttgggtactttattttaaagtgatagtaagatatatattccttgctatacccaatggaagtgtgcctggaaaataccgcatgtaagcctgaatttatttacctcgaaaatatgtccttggc

SEQ ID NO: 147528 - DNA, 373 bp, Homo sapiens
atcagatcacactccctgacacccagctctgggaatgggcatatgacccaagacagtccaatcaaattcaaccccaggacttccacggaaacttttaacaaagtgatctctgcccaggggcttgctgacctgaggaacgtaggcaacgagctgcttccagccatatttccaccacctggggagagactgcctgagaatgaggctaacatagaagaaagcagaacagagagaaggcaaagggaggcaagtcctgatgacatcacttgagcgcctggattcaaccattcctgaaaccatcattcctggtcttttctggttaaggagccaatagtgtccctcttcctagcatacacctacttgagttgggttccat

SEQ ID NO: 147529 - DNA, 481 bp, Homo sapiens
cgcatggagaaggtggcctagtaaacaaatgctacaaggcaaggaggggaagtcactaccagagagaaagtgcaggcaagactgaagacaaggaggtgggcattccaagcaacaagaagagcttgtgcacaggcagagaagcagcaaagccaacctggatgagaggtgaggggcaggagcctctgagtctagagaccaaggagagtggtgtgggaggagaggggaggctctgaggacctacagtccatgctgaggggtgcagattttactcaagcaccctcagaaggttttttgttttgttttgtttatttaagatggagtctcactctgttgcccaagctggagtgcagtagtgcgatcctggctcactgcaacctctgcctcccaggttcaagctattctctgcctcagcctccagagtagctgggattacaggtgcacgccaccatgcccagcagatttttgtattattagtagagat

SEQ ID NO: 147530 - DNA, 529 bp, Homo sapiens
tcaaacctctttccttcactatttaccttgaaattttgattctttcttccctaatcttagtagccttaataattcctctttattaagagaaatggcctagagtatttataacgttttcacatagcagaagagaacaaaaatatctctggcacagtggtgtttgtctacaaagttattaacagtctgctcttagctatcacaacattcttaatatccttcagataggcacgtctttcccatggcattccagcttatcaaaatagacaggaactgcttacactacttcaactggtaatacacaaacatttaaagaattttacctccaattgtgtcaccacaagttttggctcctcttaaacactggcactggctaacatttcattggaagaggagtatgagtgagacggtagcctcctgacctttcaacaaaagatcttttcaacgtgtgtgaaaaatatgtgtctcagtacataataccaggcatgaagctttatggatagaccatccaaatcccagagtggttagtatc

SEQ ID NO: 147531 - DNA, 443 bp, Homo sapiens
ttgatagtaggctaactatgcgtaacaactctgttattcatgctctcccgctgacctctgcagatgcactctgtctagaatatgccctccctccttccctggctaaggcgaagtcaggcaaatggagaccatcctccaggtctcacgccggctatcacttctctgatgtcagccttggtgccccctccccagtctgcagcaagcgttcttcttctccatagtactttgtagtcatctttcaggattaaccatcttggattctaaccacctacatcctcaactagactctaagctcctaaagggcagagcagtttctatcttgttcattttcatacaatcccagtatctgcaatgcagaagattctaacaaatatgtgtttccaaaacaaagaaagatataagcctgagaataaaagagcacagggaaagatctctcttacagt

SEQ ID NO: 147532 - DNA, 444 bp, Homo sapiens
gattgcacctatgcagttcccatcacttcctccttagtaatgctgccactaccctagtgaaggccttttgcacctcttgccttggttgctgaattagccttttagctggagtgcctactataattctcttcctcttcttgttctcttacgcatggcttcatgtattttcccaaagcacaactctgttcctcttactctttttaaaaatatccagtctccaaacccctgaaccttctgttggaggccttttccatctcaacctggtgcgagtctccagtttccttctcccttatcctcatctcctgttgtatttgctgggttctctttgtcaggagcagtcttttcatcctttcagtccccttgttttagagtgcttttaagtcagcatgaaactacctgatgaactgtctttctgtttaagctactttctttaaattcccttcc

SEQ ID NO: 147533 - DNA, 448 bp, Homo sapiens
gatacccggacctggttgacgtgcttaagcatacaaccattatccaggcctcagggtacatttataacagtaacagtcaatctaatactgtatatggtattagttacccaggagcctgacatcaagtcagcagtcctccaactggtgggacaggcagacttgcagagagcactatgaaggacagcaggctccaattcaatagaatagaccaaaagagaacagtaagggagaaagggacactggcagccatgtcaatcaagactggtgattaggccgggcatagtggctcacacctgtaatctcagtactttgagaggccaaggcgggtggatcacctgaggtcaggagttcgagaccagcccgaccaatatggtgaagccctgtctctactaaaaatacaaaaattagccgggtgtggtggcagactcctgtaatcccagctacttgg

SEQ ID NO: 147534 - DNA, 535 bp, Homo sapiens
ccttaccccaacttccagaggcactttcacttcaatgtaaaaagaaatgcaataaaaaccctcagactcatatttccactaatatcctgctttcttagctacaaatgtattgttatatgaaggcatacttccctttctctctgattaagactgattcctctacctaggcccaagatctcacccctgctcttgcatatttattcatcactatctacctttagaatctttctttttttcctctttttttttttaatcttcccaccttcagaatcttgaaggcaagaatttttgcctttacttagctctagcacgatacctgtcacaaaggtgggatgaaaaatagaattaattaagtgtgaacagtgcctaattctctcaaatgggtataaaacccaaacccaaacacataatatttttggactcatctatttcttggaggcactgggataaagacaaaagcctttcttataggtgaaaggaaattcattcaccttgtttagtgctgtgtttataatacccatgggatactttaggt

SEQ ID NO: 147535 - DNA, 452 bp, Homo sapiens
aagcctagatcaggcattaagaggactctgaccatggcttgggatgagcagtatattaacttatagttataataacctagtagttattttagtgaaagaatttataactacttcaggaaataaggcaaaacttcagattaatactatatgtaaatgaaagttaagaagccaaaaatggctaaagccaaactatggggttgtcaagtatcaaaatcatacgtctatttacatttaatcttctaaagactggtcattgattatttccaataaaatggcagttcatcaatccagatccctagaaaggaaagtattaactttggtccagaaacctgctgtgaaacaaggcagggaacattcaattattacattatataacacgttccctttgaaataaaccctaccaattttaattaaaaatcatttccctcaaaataaacaaataattaatcatg

SEQ ID NO: 147536 - DNA, 209 bp, Homo sapiens
ctgaattccaacctaatggatggagagagactatgtctctaaaaataaaaaataaagagattaggaactgtctgcactaagatgactttactattccaagaaatccttgcctaagaaagtaaagttgaaattacttttttgtcctggaaactttccgatctatgtatctgtactcatacagcctcatcgggctaaacagccttcttttc

SEQ ID NO: 147537 - DNA, 466 bp, Homo sapiens
tgtcttccattaaaataccagttccttttgatttatggtaaatcccaaagagtacaagttgcctctgagtttgtatcaggaatagaattgtctccaagcagcccttacagcttgcttctaacacaattgggatcatttgagtttggttcaggtataaaagatgaagaacccttagaaagaccaagagttcttagacgacttgtacagaattacgatttccaaacaacttcagggggaacaaaaagaatccattttctcccttaaattccctttttaattttatcgcccaaaccacatctgttttatctcacagtggatccagccatcaggtatgttcctgccacctaatggcccgaggcccgaggttagtttcctactataagtcactaaaggaactttgatacagaaacataaaacaaaatgtccgaaatctacgttgtagtactagccctgttaccagttagat

SEQ ID NO: 147538 - DNA, 320 bp, Homo sapiens
cattcccctagcccagcttgaataataataacataagagcattaacaatgcctggttctaacactggatttcatgactctctgtgattactttttagaaagatggagaagcaatgaagagacattcacgtggatacccacatatgcagggaaagtgcccacacatgtttggactggagacaaactacaagagttgatgtccttgaggagggagactgggactatccaaagatggcatgagtcccccacacatgctctttcaaaactttgccccaccttcatcaggaaatggcatctaattccctttcccttgaatccagg

SEQ ID NO: 147539 - DNA, 746 bp, Homo sapiens
tattaggtccgtcttaataaaaggaaaatagagtagtccattaggaattatgtttcatagagtcattttggtcattgtttcacaatatatggtattatatatttaattatatctgtacatttatgattagtaaaaagatatatccaaagtttaaatttctgggttttcctgttttttttcttgctgctttaattaatcaccagtaattttctgcaacatattttctaaacatatcaaagagagtttatagatcttacttaaaagtctctcagtaagattagtctcccagtaagattcatccatcaccttcctgacagactctattcagatatgaaaaaatggtgtaagaagctgcagtatgcttggggtgaacacattcaatcttaggcacacagaaatcctccgcttggaatatggcaactcagtgggtaaaaaggttaggagacattagtgttctttgttatcagaatttcctgtaaactgagcaatagaacaggaataaaatgacctgaaaagggaggatatggaagcattgatttcccaccaagttctttataagcagtttctaccgacaatgaagaaaccttgtttttggcctacttctgtagctaatcgtattgtgttgaatattgtcaaagcaacattcttttccctggtactttttccatttcccagggcaatgttctttgtgtttgaagcaactccagtgatacatgtagggagaatcacatatttattttacaaat

SEQ ID NO: 147540 - DNA, 453 bp, Homo sapiens
ctgctcaggtctggagtgccacttcccccctacctggtccctgatcacctgctggcccctctagaaaccttccctgaccaccctgggtcttgggtgttttgaggaggcaggaggaccagaagcacaggtgtcccatgtttctctctgggccaggaaggtggagggactagggactttggagaggaagaaacatgcctggggaaaggagttccattttaggcatgttgagattgaagtgcctctgggacatctaggtttaggaggatggtcaggattagaggtggagtaatagttgaatcaggtggaataatagtaatagcagatcacctttatcaagcacttgcatgagccaggtctggcttcctcaggtatggtaattctctttttctgcccctcgactgttgaaagtgcaaaatgtgcccagcactggcctagatccttagaggaaaatca

SEQ ID NO: 147541 - DNA, 398 bp, Homo sapiens
atatgtgattgcctgtggatgtaaacacaataataataataataatagaataataacaaaagggaactaatactagcagggttttcataccttaacagtactttgacaacaaatgttcatatttcatttgaaatttatgaaacctttgtgcctgtaatcccacgagtagtaacatggtaaatgaaagtagcaggcagtctagatcaataatattttgcttcatattggaagagcatttgaaagaagcagcttgcttcatctattccctgtgtttacaatcctggtattggaatagactggggcttctaagactggctgggaaatattcatagatgtgttattaatttatgggaaactgaaggacctacctcaaggtttaagtaggccatttagaaagt

SEQ ID NO: 147542 - DNA, 285 bp, Homo sapiens
cacctgtggttgttgcccatagaaaaggcaaatcagagcaacaaaaataagagcttcataatagtagctgacttcaacaaggaggtcaccttgaaactcagattatcatggaaacattcacattaaaaattctcaagtctatctatctcagtcattctcctgctaaaatgttatttcttgacccttataggggtctgtataaatttttccttgctggacctttttgattatgaaaattagaggagacaacatgttgtgatccaggagacgctcctttttttatga

SEQ ID NO: 147543 - DNA, 346 bp, Homo sapiens
gagacctattaccattccaacacctctgctgctggacctataaacaaaatgtattcctacttatccctagcgggaaatgaacataacatttcgggcaagaataagaagccaaatattgaggccgggtgcagtagctcatgcctgtgatcccagcactttgggaagccgaggtgtatggatcacctgaggtcaggaattcgagaccagcctggccaagatggtgaaaccccatctctactaaaaatacaaaaattagccgggcatggtggcacatgcctgtaaactcagctcctcaggaggctgaggcaggagaatcgcttgaacccgggaggtgggaggagaggaa

SEQ ID NO: 147544 - DNA, 466 bp, Homo sapiens
ctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggaggga

SEQ ID NO: 147545 - DNA, 325 bp, Homo sapiens
aaatgacatgatttatacaaagcacttctgtgagaattagtttggggcctggaaaccacaggtagagatgaacaggcctgtttctgcagagaagtagcagagggctgctccgccactggcccactgagtgatttcatgtccctgagtctcagtttccctatttggaaactgggtctcataatagcacctatcacaattaggattcagtgagatcttgtacacatgtattaatacagtgcacagaacagggctgggcaaacagtaagtgctcaatgcatggaaatgggtaatgtttgagcagagctcccagggtggttgcaggcca

SEQ ID NO: 147546 - DNA, 586 bp, Homo sapiens
gagtccccagtaagaacccgggacaccaagatctgaggagggtccctggctggcaacactccctgcgtgccgggaggagtgaagggagaggacagctgataactggtctccgtggagccttccgggccctcttcctggctgcttccagcgcgtccttctctgtgataagccgtgactgtgaacatggctgtgagtccttctagagaactcgcaagtatgccaaggtcttgggggccctactgacttgcagctggtgttggatggagccccacatggactgtccctccttgctgcgccatggcctccccaccgtgggtcacactggttttcgggggctaagcagcggttttccctccgcttcctcctggcttccccgctcccctgcctcctcccctcccccgtcgcagccccgtcaggctcacccagaactcttccagcagggccaccgcctcctcccagcttagcggctgacggctgcacacccaggcctgcgtgtcggctggcagcgcgctcagaaactgctccagcaccagcagctccagcatctgctccttggtgtgcacctcgggccgcagccggtcccggc

SEQ ID NO: 147547 - DNA, 269 bp, Homo sapiens
gggcgaattcctcctcctcctgggcgaattcctcctcctccttttgtaatccgaatcctcctaatctaggcaactaaaactctgctgtcaccataggttactttacatttgtagaattttatgtaaatgaaataatataatgtgtattcctcgtttgtctggcttcttcgagcataattattttgagagtcacctatattgtgtctatcagtagttgtttcttttttatagctgagaagtattccactgcatatgtatccaagaattgg

SEQ ID NO: 147548 - DNA, 546 bp, Homo sapiens
  misc_feature (515)..(515): n is a, c, g, or t
ctgctactgaatgacttctggctaaataataaaattaaatcagaggctggcatccacagccacacccttctgaccgtgcccaatctcggaagctaagcagggtcgggccttgctgggacttggaggggagaccacctgggaataccgggtgctgtaggctttggctgggcatggtggctcacacctgtaatcccagcactttgggaggccgaggtaggcagatcacctgaggtcaggagttcgagacaagcctggcaaacatggtgaaacacaccatgtctactaaagatacataatattagcccagcatggtggtgggtgctggtaatcccagctacttgggaggctgaggcaggagaatcacttgaatctgggaggcagagattgcagtgagccgagatcgcgccactgcactccagcctgggcgacagagcgagactccgtctccccgctgccaaagaagaaggaaaaactaatattgcacggtgttccctcatttgtgtaccaggtctgtntgctctacaacaagggggaagccctgtatgg

SEQ ID NO: 147549 - DNA, 394 bp, Homo sapiens
tacagagtctttgcaactcggcagtttcttgcaggttatcaaccacaccttgactcgtctttgtgtgtgtgtgtgtctgtgtgtcttgtgtatagttttctgtgattggaaaaccctctgcgtgatgacataggagaatctgttccattagtcttgtctcctaacaggataagttgaggcaatgtgaaggggaatgtgtgcccttagagaaactgaacataatacaagttgataggcctgcaaggctggaaatgagcagatccctctcttctctggcctagctgagcaacctgtcatgagctccaaggttatgcctagaagtgttctggactccttctgcatggaacaaaaactgtgatccctttatgggagcaactacagcccagcctggaat

SEQ ID NO: 147550 - DNA, 318 bp, Homo sapiens
tagctgggattacaggcacataccaccaggcccagctaatttttgtatttttagtacagacgggatttcagtatgttggccaggctgctttcgaactcctgacctcaagttatccactggccttggcctcctaaagtgctgagattacaggtgtgagccaccatgcccggcctggttatttggttattcttatttttatgtctatgtatgtatgttatgtatgtatgtatgtatgtatgtatgtatgtatgtaagagtctcgctgtgttgcccaggctagagtgcattggcaccatctcggctcactgcaacctccgc

SEQ ID NO: 147551 - DNA, 217 bp, Homo sapiens
gtggtttatggtctgagacttatttataaatacagttactagtttcaaattgaaatgaatctggcttccaaatggtgtgtagtgtacttaccccaacaatgctgccattgtaccccaaggtcttctttaggatttgaatatgttcattggtcataaatctttatcctttgatgttagaatcaatttttggaaccagctaaaagtcattaagtgccga

SEQ ID NO: 147552 - DNA, 170 bp, Homo sapiens
aatgaaatgcccatcctgaggtggggctatcttgaactcagatgccaggccctttgagaagctggagagagctccagacaatctactcagaaacatattgcacctcttcagggctttctcagagcctcggacgcctgtctggagacaatgggttaagaacccctgcccta

SEQ ID NO: 147553 - DNA, 207 bp, Homo sapiens
gcaggctgggtgggctccctgaggaggcaccgtcttacttcttgaagctcgctggcggctggatgttgccctgggcatcgagtgggggtgctcttgcctcactcctcaacttgagcttctccacctccttcaactccttcactgtcctgaaaatcacctgcttcttccttttcatgtccacaaacgtgggataacagtggatgaagg

SEQ ID NO: 147554 - DNA, 252 bp, Homo sapiens
ccccagttctctcccccttgtcatccactcaaggcaagtcttggagaagggaaactgagttactgacacaggttggggcagccaccggatctctcagagtggctacatttctccatctggctcacagctggcaacacgtggatccaaggcagggtggagcgaggtgcttccaagaggtaaagctgctgagatgagcccctctctgtgccagctgctggcggggcaggagcaggacgagagaagcctgtttgt

SEQ ID NO: 147555 - DNA, 525 bp, Homo sapiens
ggttgaagctgtagttagccatgattgcaccactgcactccagcctgggcaacagagtgagactctgtctcaaaacataaaaaaggacaccatgagaaatcacccaaataggagagagagtagcagaccagggaaaatccctactggtgtgactggggcaaggagttcaagcagggaagaagagagaaggagctgaggcaccaccagcctgggcaacatgttaaaaccccgtctctacaaaaaatacaaaaattagctgggcatggtggcacacacccatagtcccagctacttgggaggctgaggggggagaatcacttaagcccaggaggcagaggttgcagtgagccaatattgcaccgctgcactccagcctgggcgacagagtgagatcctgttacagaaatgggcttgtccttcttttcaccaaactgaaaagaagcctttgatgttggcagactattaagaattaatgcagttcccacagcaagccatttattctccaccagagtgtagggcagtgcc

SEQ ID NO: 147556 - DNA, 467 bp, Homo sapiens
tccctgcctctccgtcatccctccttagtctccttgtctggcttatccttgtccttcttcacttagcaattcaatgtcagagttcctcaaggctaagttctgggcccttcatctacagattcctcagagaggtctatcctagccaccatgtcttttttttttttggatatggagtctcgctctgttgcccagggtggagtacaatggtgcaatctcggctaactgcaacctctgcttcctgggttcaagccattctcctgcctcagcctcccaagtagctgggattatttataaatgcccaccaccacgcctcgctagttgttgttattttagtagagacagggtttcaccatgttggccaggctggtctcgaattcctgacctcaggcgatccacccgcctcagcctcccagagtactgggattacaggcgtgacctaccgcgcccggccaccatgtcttgagtag

SEQ ID NO: 147557 - DNA, 543 bp, Homo sapiens
ttttttatagatgggttcagcataccatagctcatctataactctaagctgagttaataaagtctaaatgccatatctttaatatgaagtttatatttagctcagtattaagttattatgaatacttagataatttaattgacttttaaagtttttctcttattttactgtgtgttatggttcatcttcccacgtaattttttggtggagatgctcggaaggagagaagagtcagagttgtctgtctgaataacatatttgatgtttccccctcacttctggggccttcactgataattaatcttttctaaagctgttaaagtagttgcattctgctatggttttccttagaaacttcaggcagtatattatagaggtggcttagttttttcttttttggcagtaatcaaaaggcgaggcacagcatagcactaaacattcacctattacaaagcaaaccaaaaatggattgtataatggcattggagcagtattggttgtgtcaggatgacacagatgtctcttaatgccttagaaatgcta

SEQ ID NO: 147558 - DNA, 358 bp, Homo sapiens
tggttttgatactatgctatagataagatgttagatgttaacactggagaagttggggtaaggataaacaaagtttccctgtacatttatttgcaatctcctgtgaattcctaattacttcaaaacaaaatgaaatttaaaaaaaagctttttttgagcagtgagggttaggagtagagaaacagtactggggctgtgataatttaggaatatctggcaaaaacaaagacagaaactctgagggccctgccctcaacctcatagaattaccatggataaatctttgacaaagatgagttcactccaaacttaaaagaacatatgatgatttccaatttcatccatgtccctacaaagg

SEQ ID NO: 147559 - DNA, 200 bp, Homo sapiens
tccacccgtggaacttctgttctactgcagtggcctcaggcagaaaaggaggacctggctgcccgctctcccttattctgtcttcagtgcctgaatgtctgacccagtaggtgtggttggaggtgagggaatgagttggttcacgcaatggtccacacacctctggttcctctccatttttttttttttttttttttttt

SEQ ID NO: 147560 - DNA, 154 bp, Homo sapiens
ctatgaaataataagacttaggtttatagcaacagaataatatagtacagcactagtctgccttggttttctaatagtcctgccaccatctcagccagagagttttctttccaccataagatcaaaacagtaatcccatcatctgattcttagt

SEQ ID NO: 147561 - DNA, 545 bp, Homo sapiens
gccagatgcacaggtcacaggggactgaatctcatcaccccacaaacataccattcaggttttgccaagaatgacactgtaaatgtaacaaagcttccgtgcttgttagtgaacaccaactcagctcctctcctgtattcagaaatcaggatgagatgaaaacaacaagcaggccaggcacggtggctcacgcctgtaatcccaccactttgggaggacgaggcatgtggatcacctgaggtcgggagtttgagaccaccctgatcaaaacagagaaaccccatcactactaaacatacaaaattagccgggcatggtggcaaatgcctgtaataccagctactcaggagctgaggcaggagaattgcttgaacccgggaggtggaggctgcagtgagccgagatcacaccactgcgctctagcctggacaacaagagtgaaactctgtctcaaaagaaaaaaaatttaaaataaaagaacaaggaaacaaaagtaacaaggcttgacaccagatgagcctgaatctaagcaagaaaagcccaga

SEQ ID NO: 147562 - DNA, 409 bp, Homo sapiens
atggaagttacatgagtttttatcttctcaattataattgctctgtgaacttccactttgataattatggacccagtttctgctaccagatctacacctcttttgactgccttacttggctggaaggatggtcttgtaactgctgatgttggttttacctactgatattgtcattctttctcaaatgtaaagtgtttttattttattgttcttgttgttgttttataatttctattataatttcagggatatatgtgcaggtttgttacgtgggtgaacttgtgtcatgggggtttgttgtacagattatttcatcacccaggtattaagctagtatgcattagttatttttcctgatcctctccttcctccccacctccatcctctgaaaggccctagtgtgaattgt

SEQ ID NO: 147563 - DNA, 420 bp, Homo sapiens
cgctgtgcgcgctgcgatcctcggggtaagaaggggatgatagcacggatcaggaagggccccactcccagcagcacctgagagacttttcagaatttctctttacaccaaaaggcaaagcaggagatggagacaaaatgaggaaaatgggctcaaggccagctccatgccccctacaattctcttccccagaatctgcaagacttaggaagagtaagttctatcctgaaattataacattctaaaatggtacttttacaatctgctttttcattttcaaagcactgtcacagaaaccacttctttgggtctttgcaacaccactgggaggcaggagtaacagatgccatcatccccattttacacaagagggaaagctcggggtgtgtgcaatgctgcacaatgttgtgagtgcatcag

SEQ ID NO: 147564 - DNA, 554 bp, Homo sapiens
atttgagcatatattattctaatgtgtataagctcactttgtctcttaatcttttttagtttcttcttcccctcgtgagatatagcctgaatttctttataagtttttgtttttgttttaatttcccagaatgaatgacagtgagctctttttttcttggacttgtcaaagctttttctcacttgaatgactagttagtctcctggtcattatcgcagtgtgttgcagacattagccacagaagtttctagatccccaactctcttgtgcaactatagcctgggctagggaaaagtttgctccatgaaattttcctaattgtttctttcaagtttcttcaagaagcttatgttctggtgggagacatataaatattttaaagtttaaattaactgacctaatggtggaactattcaggacttccatattcatcctacagttattggcttttaatttctttaggcaattttgttaaatgttataggccacttgtgttgtccatgagcagatatagtatcacttacattctggagggacagagaggtatgagttta

SEQ ID NO: 147565 - DNA, 391 bp, Homo sapiens
gcggccgcctactactactaaattcgcggccgcgtcgacatctgttaaaaaatctacataaaatctacagtaagcataattactaggtaaatactgaaagctttcccttggaagtcaaaaatgcctgctcttaccacttccatgcaacactgtactagagattctagccagttcagtagggcaagaaaaaaatatataaagataaggattggaaagaacttcacaaaattattattattggcagatgatatactactatgtaattaaagaaattcaaaaatcaacagatatgtcattcaaattattaagaactacatcaaaacaaaatttttaagtaaaaaaactaagaataacagctaagaaagatgctgtcgacgggccgcggtcgacg

SEQ ID NO: 147566 - DNA, 639 bp, Homo sapiens
tatcctcaaaataaggagaataaaactccagacaaataaaattgatctcacattttgttgtgttttcattttcatgtagttcaagatattttaaatttctcttgagatttttttttaacccatgtgttatttagaagtataaagcgttgagctcaacgctttatacttccttgcccaaacagtggcaccagaggattaaattataaaccacttagagagcacaaaggaggtggttactatttgggcaaggagggataaaggagagatatgagccaagcctattttagggagggaagtttttgaactggtgcgtgaatagtaagtagcagttcagctggtggaagagagagggtagatttgagagaagtttaggagaatgacaagtcaggatttggcaatttactaggcgaggtagtctgtaggaattgaggggaagaccagtttccagcttggcctactggttgggtttggtttaatggctcttactgagatagagaatacaggaggagatcgtttagggagaaagttttatttaccttttgaacatacaaattttggagtaactgggatatttagttggaagtgtctaataggaaattagatatacagaactgaagtataaagcgttgaggggtaccg

SEQ ID NO: 147567 - DNA, 916 bp, Homo sapiens
tcaacgctttattacttcgattatagggatttcacatcattcactatttactaatcgaagtagaaggcaaaatgatatgctgaaagcagagatggaggcttaatgagaaaagtgtatgggttgggaagagagtaccataaaagttactgcacagctgtgaagtctcaggtaaagttcttttgcatggtttcttcatggtctagtattgtgaatatttcttccttctacagttctggtgctggggtcactttagaggggccaggtagacaaggtagacaagacacagtctaggcccttaagttcacaggttagtgtatgaggtagaagacatagaaataaattaagtatgttgagttaagggaagtaaaattgggagtcagtggaagacaaatcagaggaggcttcctagagaagtataaagcgttgagctcaacgctttatacttccttgcccaaacagtggcaccagaggattaaattataaaccacttagagagcacaaaggaggtggttactatttgggcaaggagggataaaggagagatatgagccaagcctattttagggagggaagtttttgaactggtgcgtgaatagtaagtagcagttcagctggtggaagagagagggtagatttgagagaagtttaggagaatgacaagtcaggatttggcaatttactaggcgaggtagtctgtaggaattgaggggaagaccagtttccagcttggcctactggttgggtttggtttaatggctcttactgagatagagaatacaggaggagatcgtttagggagaaagttttatttaccttttgaacatacaaattttggagtaactgggatatttagttggaagtgtctaataggaaattagatatacagaactgaagtataaagcgttgaggggtaccg

SEQ ID NO: 147568 - DNA, 483 bp, Homo sapiens
aaaattgaatcaaaccctggtggaataataataatagtaaatcaaacaaagaaagggttggagtttggtataaatatgcaaattctaatatgcatatttagaactctgttatactaaagacctatttcttctcccactgacacagttgtccatgtcagtgtaagtaaattatgttttcatatttttattggttgaaccactaacaaactggtatgctacaaatatagctttttagaggaggaagtttgcttccttgggagaaaaatgaattgaaacgggacggttgtgttgcagatagctaaaagctctacagaactgttctatctaattattatgatgaccaatgaggatataactatttagcatatgagctagagaagatattgtcaagagaagtcatgaaggtatagatgtgcagaggatgggaggaatagcaaaaagcttgggatacaatgggtttctctgcatcatctgggtaccgag

SEQ ID NO: 147569 - DNA, 311 bp, Homo sapiens
cagagatcatctatgttcttcttagtagttgcattgaatttttttttgtagatttgtcatgattgtattataccttactctattgatggggcattttatttaggaaaacagaaactgtcctatgagtttcaacagagataatttattgtaagaaattaactggtgtttgaaaactgaaaaagtgaaaaggagatcctgagataacagagataactataggaagcagttttcacctaggtctggaggaacaaagagtagagattaggggttatcagaacctagaaacttagagaataggccccgtggatctg

SEQ ID NO: 147570 - DNA, 1582 bp, Homo sapiens
tagctgggactacaggcacatgctgccacacccagctaatttttatatttttaatagagacagggtttcaccatgttggccaggctggtctcaaactcctgacctcacgtgatctccctgcctcagcctcccaaagtgctgggattacaggtgtgagccaccacacctggcccacaaggaaattttagaattaaaaaatacaaccaaaatgaaaaactcaatggattcaatgtcagaatagagaagatagaggaaagcatcagtgaacttgaagatagaacaatagaacttacccaatctgaacaaccaagagaaaacagacttaaaaaaaatagatagaatctgactcctcaacccctttggccatggcaggcaccttttggactgggctgccactgcttgggcagagtaaaaggtgccaggaggagcatgggggtggaagtcctgtcagccaaaaaataaaagtttacctcagagctgcaaaaaaaaaaaagaaaaagaaaaaagaaagaaagaaagaaagaaaagaaagaaagaaagaaagaaagaaaagaaagaaagaaagaaagaaagaaaatagatagagtctcagggacctataggattattacaaaagatctaacactcctgtcatggagagagaggagaggggagatgggcttaaaaagtacttgaagaaataatggctgaaaactattcaaatttagcgaaagacataaatctccagattaaagaaagtgagcgccaaacaggataaagccaaagaaatccatatcaggacacataataatcaaacttctgaaagttaaagacaaacatagaattgagaaagagatgacaatctcttatgtataagagaaaaacaggatctctcatcagatactacaaaggccagaaagaagtggcacatttttcaagagctgaaagaaaagaactgtcaaaccaaaattcaatatccagcaaaagtatacttcagaaatggaggggagatcaagacattctcagatgaaggaacacttagagaatctgtcaccaacataactactctaaaagaatggctaaaggaagttcttaaaatgtaaaggaaatgataaaataaggaatcttggactatcagaaagggagaaaaaacaactgaaagaaggaaaatgtgggtaaatgcgatagactttaatgcttctggagttttttataaatgctgattgtatatcattgtctaaagtggttctgaaatatataaaggaaatacttaaggtaattataaatgagggaggataaagggacttaatagtaggtaaggtttctacacttcactcaaactggcaaaatgtcaataccagtacactgtgataagctatgtatgtatagaataagaaacactttatcaacaagagcacaggaaaaataaaacagaaatgaaccaggtgtagtggctcatgcctgtaataatagctacttgggaggctaaagtggaaggattgcttgaggccaggagtttgagaccattctgggcaacatagcaagaccccatctctaaaaaaacaaaacaaaacaaaacaaaaaaccaagaagaaagataaag

SEQ ID NO: 147571 - DNA, 122 bp, Homo sapiens
ttctgaggtcccggaagatcctggtggtgatctcagatggggcccctcagatgtcagcctttttcctcttgataccagtgagacatctagcccagccagagctttttcagatcaggttttgt

SEQ ID NO: 147572 - DNA, 525 bp, Homo sapiens
catgttggccaggctggtctcgaactcctgacctcaggtgatccacccgcttcagcctcccaaagtgctgggattacaggcataagccaccacgcccgacctcacctggtttttcttaagtgcctttaactaaaaatactgaatatgccagagtggtgtattttgggatgccatgttcttaactcgttcataagtaaagttcatgaaagcatataaatatatttaaataataataaacacactgagagaaatgacacaaaaaataattttgaattttctcatgtcattgttactaaagctgagaaaccagatattacataattaacataaagcggtattggaaacaaatgtggagacaagtcttttagattactggcattacatgctgctgactctcgcatcttcatgaaatctgttcctctttgccttctgtgacactggaagcttctgatttaccttcagtctctctgattacatcttctgaattccacttacaggtgcccttttttttttttgcccaacctt

SEQ ID NO: 147573 - DNA, 421 bp, Homo sapiens
cacagcaggtacctaatatgtgcgtgtgtcacggcactgttttaaccagccagggtgcattgattgaatagtgcaggagcagctcacaaagtcagaatccctgggtacaaatttgagttctgggaccccagcagagcacttcccctcgctcctccctcctgtggagctcagtgtcaccgtctgtagaatgtgcctaacagtccctgattccattctacctggtccttgtggcactcctcgagaagccatcaggacagctgtgaccttctgtgacatgaggataaggaccctgtgttgcctcccaccactccagacacccacaagcaggaaggtttagcaaaataggtaagagccagccacctgggttcaaatactggctctgacatctgctacctatgtggccctggacaggtgactcacc

SEQ ID NO: 147574 - DNA, 615 bp, Homo sapiens
gagaggtcccagctagaatcacacagttctgtactcagccatgtaacccttggacatttggccaaggtccctcaaatgcaaaggtgcaaacttgagttaataaatttcttccacacaccctgacatagatcattcatttacttttaaacaaatgtttattttctttcttcctcttttaaattacaagagaaaaacattcccgtagtatatgtagttggaggtgaagctggggcctcctgagttgagatatgactggccatggacttaggtacatttccttgcccctgcctgccccacctgtaaacatccagttgcacctcgaattgacttgggggatgcaaaacctttccaaggaaggcactcagtcacatatgattcagaaatatgagagcatgtctagcaaactgtgggaaaggatcaagaaggaagagacgagaaactgggatcagccacaaggcccgagggtggttccaggaagagcaaactttccctggacactgtcccagttcactcagtatgagttggctctggccaagcttcggtttgattacactgaacaagcaggctcacaagtctctgtaacttgttggggcaagaaggtgtgcctgacacaga

SEQ ID NO: 147575 - DNA, 676 bp, Homo sapiens
gttactgtgtctgttgagaaagctggaagtacaagatccaggtgtccacaaggatacacgccctctgaagcctctgggggaggatacttccttgcctctttcggcttctggtggctccagacactccttggcttgtagcaacgtcactccagtccctttctccctttcacggggccttctccgtgcctctgagtcctctcctcttctttttttagtttttgagacagagtctcactctgtcgccaagctggagtgcagtggcatggtcttgactcactgcaacctcagcctcctgggttcaagtgactcctgcctcagcctcccgagtagctgggactacaggcgtgcgccaccacacccagctaatttttgtagttttagtagagatggggtttcactgtgttggccaggatgctctcgatctcttgacgtcgtgatccgcccacttcggcctcccaacctgtcctcttcttataagagaaccaaccgttgaatttaaggcccaccctaaatccaggaagacgtcatctcaagattcttaactaatcccatctgcgaagatgcttttccaaataagttttccattctgagattccagatggatgtgaattttttgtggacaccattgaacacactctggctgtttactccatctgccagctgggatactcacagg

SEQ ID NO: 147576 - DNA, 477 bp, Homo sapiens
tacctaaacggtgttgaagaaaaccacaatgtcatcccaaaacatgcctcttcgatataaaaacaacaacaaatttgagctgaagacaagaggcagcaaatgaaggaaaagctctctctatcctccccctcttccgcccaaagacaggatataaattctttactggggataactttagacttaccagaccagttaaggtaccaggggaatctgcaaacaattcttactccattagtttccgaatatgtatctaccttcccaatttcctgccctttgaagcctaaaactgctctcctgtgtcctgtcacttctctgcaaatctacagttctttgttgaagatggtatacaaatgtagttctaagccaccatttcaagttacttctcattaaggtttatcccttgtgatgtgtactctgtccaagaataaacttttttcttgttatcctttcatttgttaaaggggtcactccgaacta

SEQ ID NO: 147577 - DNA, 460 bp, Homo sapiens
catgtgtttaacatcgaaggtgtcgaagtggcctgcttctccccaaacccaacaagtctaattcagtctctagctcagagtactgtaaggtcctttcaggctcattatacacagagctgtatggaaacgatcgttgacactgtggaagagaaaaagtctggaaagattacaccactgaagatgcattgttgtcatataaaaagctgtgaaagccatcaagcccaaaatttgtgctggagaaaactttgtctggatgttgtgcatgacttcacaggatttatgaaagaggcaaccaaggaaatcatgaaagagattgtggatttgacataaaaggtggagtgggggttgaagggttttaaggtacggatcttagaggaatccaagagcggatagacaccacacccgaggaattaacagaggatgacttgatgtagataaatgcttctgaattggtgccaga

SEQ ID NO: 147578 - DNA, 535 bp, Homo sapiens
aacatttccttgccccattcactacactatggtgtccaaggccctcataacatgctagttcatgggcaagccctccctcaatccatcctaaccttatgctactccagacacaccctttctccagaccctagacaacctgccactcctaaacacacttgctctttcttgattatgttcataccattcctctcatccaaagcaccttccactccacggggccctgccttccacattactacattcctaaagggtatggctttatttatttctctaatcctcccagcaacttacaccatacttttatcctcccagcaacttacaccacactttttatttcttaaatgtgctttgctgtcaaacagacagcaaaatgatacaatgagtccacaagagagcaactgtttggcaagcatttcccctctatataggagacaatgctggaccccatacaataaaattacttgggcctgataaacacggtgtcacctttcagcctacagcacagcattcgggatgtgccagtggtgcaggagct

SEQ ID NO: 147579 - DNA, 207 bp, Homo sapiens
tagtagttaatatttaaatagagagacgttaatcgtattaaattaatgtttgccggctcgcgtaccacgtttattaatatttactagcttcacagagctgctcagaggaataattaataatgaacgatgggtaaatctacttgcagacacaaagcatggtggacacggaggcagggtcttggcaaggcacctggtaacccatgtgca

SEQ ID NO: 147580 - DNA, 280 bp, Homo sapiens
cgggcgctgggtgaggtcccaccgtggtgcgcttggctgtgccagcagtctgctgcactccatcctcccacaatggccccattgttcccagcagccaggcagtttggaggaggttcctcggccacccctacccccctaaataggggacagattaaccccttggaggactgaggccaggtgagggcccacagggagctgccttgcccatctctgcctgttctgggaacccaggcttgggaagttaccttctacccatgtgaacccagcaccacaccacctc

SEQ ID NO: 147581 - DNA, 356 bp, Homo sapiens
aggagaatggtttgagcccgggaggcagagccttgcagtgagcctagattgcatcactgcactccagcctgggtcgacggagcgagactccatctcacggtgctttattatgggtaaagaagagaggcagaacgtggttggtttagcgaggaaaggttcaatttgggtctcattgattgacagcagtagttaacttgcactgaggactcactctctaattgttttaccgtatgaactcatttaattacagcagtaggtgctgttaactcccctgttctgcagatgtgaacaccaagtaactcacccagacttaagcagccaatctcccaaccaggattggggtccagacagcctga

SEQ ID NO: 147582 - DNA, 375 bp, Homo sapiens
catagaaaaaaaccatataattgtctctgtaagtattcagaacaaaacttagtatatgaatcatacagtcagatgagctaattataaacttcataattacattaatatgcagatatatttctagtctagcagctagatggaccttgctaaccactttgtcacaacctgttgttctagggtgggtgaccgccatcttggatactcaccaagggccacaaagcccctttgcaatatgtccatttcgtggaacactgatgcctaaaaagccatctgtgctcaacagcttacttgtcctgtctgtattctaagctcatccctttttacttcttactcaatagaaacccagaactgtagcagtcagctatcactatgtaa

SEQ ID NO: 147583 - DNA, 111 bp, Homo sapiens
agtaaagaatttgatgaatacaaatgtaaccacaaaggttgaagggtctacttcaagttggatatcttcaaactctaatgagccaaatcagcaaatcttttttaaaaaagt

SEQ ID NO: 147584 - DNA, 524 bp, Homo sapiens
gaatcagctcgttacctctacccgggtgctggggtaagaggggtggcgggagccccatcacgcagccttttgtgggccatggtaagggtcggttttcttctcactgcaattgggcagtcgctggtagttttcaacagcgaagtgatgtgatctaatttggattttaaaaatattccactgctgtaggggaatggattataatgacagcaggcaaaccagtttaagaggctgctacagtgctccaggaaagggctgatgggaaccggactaagccagtgttccaggaaagggctgatggggaactggactaagctggtgatggacgatagaaaaaagtgtccatcggatttggggcacagttaggaggcagagccaggaggctttgctgagagagtgagaacgagggtgagggaatgaaaggagtgaagggacagtcactttctggtctgagcaactgcacggctgatgttgcccttaactgagatggggcaccctcgtgtagtggcaagggcacaggctccgta

SEQ ID NO: 147585 - DNA, 415 bp, Homo sapiens
ggtggctccctagacacaactctcaaatgacgtgagcttggagtcatgcacatcatgagagctatggctcactctttcctctcaccttgcatgctgtgctcaccagagaaatggatggatttgtggatggatcacccaattaattaattaatggatcagactctatcaccttcctctcccacctgtgagtcagtccagacattccagaattttatagctccagcaccatgccccagagaaaaacaaaaaacaacctcctgggccttgaaccatcagccacttttcaaagaaagtcaagactccgtcaacatttttttcttccctcccaaaattaaaatgtgcctccagtataacttgttatcaaaaatagaagcattttatctatctttattgcagaacagagattacatggaga

SEQ ID NO: 147586 - DNA, 805 bp, Homo sapiens
ggtcagaggaaacccaatccacattggaacaaggcttcttaagacatggatgtaatttggtggatcccaccgggctgggattacaggtgtgagccactgcgcccggccaaacatggatcatttcttcgtgttacaaacattccaattatactttagttatttttatgtgtacaataaattacaaagatagtccctgttggtgtcagaatgaagtctacttcttactgaaacatcagacacaatggttagcaatttacaagagtatcttatttcatcattaaaaacactgttaaagagaaaatatattgttaattttattaataaaagaaaccaactattttagcaattaaataataaccagaatgcaacttttaacatcacaatgccattcatatatagagtaatggacttccagatccaaccaggatgagaaaaacctgaaactatatttttcctctatcttaaacaactatgaaaatagtcaagatagacaaaagaatgattttcagacctacagcaggctgcgcaaaacaatgatccctggaaaaagggaaacaaacaaggtgactgctgattgccctaatcttgaaccttaggctggtccaggttcttgactttgctggcaaaaaacattttgagagtccaaagtagagtaggggaaaaagcttattgcaaagcaaaatatactctgataggtgggtcaaacaagctgctgaagatgaaaacaccactctggcatggggaaattctttttcctttatgggaagcttatatgattattcataagaaggtgatgatgggcatt

SEQ ID NO: 147587 - DNA, 276 bp, Homo sapiens
ggcatggagccaggctagaatcgcagctccatcattcccatctgggtgatcctgggtcacatttccacgttagcatttccatgcctcaaacattctcaccttctgtgaggatcactgaatatgacagaggtaaaacacctggcatggttagtaagttaagaaggtgagggaaggagtagagctgaccaggaaacctggaatgcagctcctctgagtcagaggaaaacctagatctttcactccctctcctgccccaagtcccgctgaatgtgattg

SEQ ID NO: 147588 - DNA, 391 bp, Homo sapiens
gaacgcagcaggactatagaggagcccctgccagttgtagtagtgatgtactgggtgtatgagctggctcactaccttctacagggctggggttgcagaggtctcaggaagcttgtctcattctccagtgctgtacccttttgtcagcggctttgtattgggttgtgtagtttgaccttcaggcctataggtggcactattgtcagtagggtgcagatatctctgatatattgatttcctttcttttggataaatgtccactggtaggattgcttaatcgtatggtagttctctttgtagttttttgaggaatctccatactgtactccatagaggttgtgctagtctacattcccaccaacagtgcatgagttcctgtttctctaccttc

SEQ ID NO: 147589 - DNA, 266 bp, Homo sapiens
tgaagccaacctctgtgcctccttgctctgtggatgtcctcttgccccgttctgatactttcctctggttttgtccaattagaggtgtaggattccattccatgccattgttttaaacttcagctctggctttctgtcaggagccctcacttggggaacaggagaaaaaggatttgcctgggtagcagtgctgctgccgatggcagagagaggagatggggcttcctggcttcttttggctcctgggtcctctcctgtggctgagt

SEQ ID NO: 147590 - DNA, 358 bp, Homo sapiens
ctgcaaagagcctcgctgagcatgcactctctccccaccgggagggatgaaagcattccacggtgggagaaggcctagaaggcatcgtgcagtgacaccggagggtccctgagccaaacatgctgcagccaacagccaatgtggagaaaacccaaagagataccagcgtgcagagagaaaggcccacagggtgccagaacatgcccggtcaggtgggaagatccagaaggaccccagcttctgacaagcagaaccaacagaaccacgaccagaggtgccatctcagcatctgcacctgaccctcctccctggctccaaggccaacatcccttagaatgcactgggccaggtgtggtgg

SEQ ID NO: 147591 - DNA, 285 bp, Homo sapiens
tgtctttccagtgtccagagcttgttgagttgaaccaatccagcaggtggtttgcactgcggtggaccctggggttgcatgcttggtctctggtgtcagagagacctgagtttgagtcctgactccatcacttacttgctgtgtgaccccgggcaagttccccccgcctccgttacctgctggggaaacagcagcgcctacggcacagggttgtgtggagggtgcaagagaagtggccgtgaccatccttctaaatgggacaggctgtattccatggtcatgatg

SEQ ID NO: 147592 - DNA, 450 bp, Homo sapiens
caatctccaattccagagtaggtaaggataaggcagtaagtgtagatagagtacaccgacaacagatggcagcacttgaacatcaagccccgatgataagccctccttttcacatccatgttctgctgtgacttgcagatttgcataacctcaatccaggtgggcaaaagattatgtctacatactacagtaatgagaagggacaacatgacatgaaactcgtctgagacacagatgagtctatgacttgttgaagttgtaaaggtaatagatacgaagctgggttctgcaatctcgaaaatgggggtacccacaaaccattagagcactggaaacatataaacacttaaaatgtcactcagctgcacccacacaatgtagctggaagttgattttttaaagaaatgaaatttatactcaagtgtggttcatataaattagagttacaag

SEQ ID NO: 147593 - DNA, 292 bp, Homo sapiens
agggtcaagtacttcccctggcttaacttcctgagtagctggtactataggtgtgtgccgccacacctggctaaatttaaaattttttggagagatgaggccttgctatgttgcccaggctcgaactcctggcctcaagctatcctttgtttttgcctcccagagttctgggattacaggcatgagccactgtgcccggcctctgcctagttttaacagttgctaagaggaggatgttgaagtagatgtcttcttggtgggttaatccttttgtcattaagcagttgttatg

SEQ ID NO: 147594 - DNA, 398 bp, Homo sapiens
tagcctcctgaggacctgggatataggcctgcaccaccatgcctagctaatttttgtattttttgtagagacggagttttgctatgttgcccaggctggtctcaaaactcctgggttcaagcgatctttccgccttccaaagtgctggaactacaggtgtgagccaccatgtccggccagggcacatttttaataggcgtgaacaacaacatgctcacaagttaagtaaaatatttcatttaggtttaaaataatggtttaggagagcttttttatttttttttcagttgtttcctaagtgatctctttttatattatgaatttatgtgtgactactgtttactccaaagtaatacaatgtgcaaaacattgataactgatttctacataaaggtcag

SEQ ID NO: 147595 - DNA, 289 bp, Homo sapiens
gagtggaagtttatttaaaaggctttagaacaggataaaaaaggaaaggaaagtatgcttggaagagacccaaccaggcactgaggtcaagcgctctgtttaacagtaatctttataggctggcccctttctcatgattcttcccttagggtgggctgcccgcatgcctggtacccccctcacccgttggaggtgagcatgcgcagcgtgtttaagaagttgtacccatgcccatctgagactttcttccctattctggtggagtaaccctggaaagtcatactccgcc

SEQ ID NO: 147596 - DNA, 797 bp, Homo sapiens
gccatgcagccatgggcctgaggttgtggtggggcatgggggcagaggcaggcagtggggggccacaggaggggctggctggcaccgagggatgggagaggaagggacccgcctgcaggtcccttcctgaggccggcactgacttggtcactctctggctgccctgaccccaggcagagcagcgactttcctgttttagagctgagcagacagagcccctgactgcaggccaaggtgcctgccagctgctcctggagggccatagcctctctgtgcttgctggaaggtcccaggcaccgtgcaggtgacagtggccggcctcaggttccagcagagccagcatcgggcccagccacttcccttgtgctttgtgaccctatggtcacttggcacaggatcccgggtcaaatgctgcggttgcggcatttgccccaccacttacccctgggggcagcggagaaacttaatcaattgctaaacaacaaaaataatctggccgcctgccagctgggaagccactgtggccaggctgtttatggccttgggatctgcgcagtggacagtggcctgcaccgtgaccccgttcatcctgcgtgccccaggcccaggaggtggctcaagccctctgcctcctgtaagggcacctgagaaggaggccctggagctgggagcagagctgggggtgggcgtccgggcagcagaggccgattctcagctttccctggatctcagctttccccggatctcagctttctgctacccgtgtgaaaagaagccaggagaacacagctatcctg

SEQ ID NO: 147597 - DNA, 359 bp, Homo sapiens
gttcatcttttcttggctgcattcattttccctctttactgctgtagtttattgctctttgctgactcctttatttttattttccagacttgcctgaaatgcatcttgattctggcatctttagatgtttaaagccctgcactttgttactaatgatttccctcattttgcagaattccattcagttgcagttctatttggcaagaccctgcttttcttctttcttaaatcattacattttaatattcttctcttcctgctcttttatagaaatttgtatttcattttttaggttgtaataatggaccttcaacgccctacagtttgacttcttatcatacttacttgttttcagaatc

SEQ ID NO: 147598 - DNA, 237 bp, Homo sapiens
atcgtaatactaaattacattttctttctcaaacacttttttgctttagagctcttgcatatgttgtgctctctacctagagtccttgtcttcttcccctccccttttttttttttttttttttttttttttcccggaaaaaaaattttttttttttttcgggggggggggaagggggcctttttttgttaaaaaaaaccttcaacttcggggtttttcaaaaatttgggcccccgg

SEQ ID NO: 147599 - DNA, 349 bp, Homo sapiens
ctccatgttggtcaggctgatctcgaactcccgacctcaggttgcagtgagcagagatcgcgccactgaattccagcctgggcgatagagcgagtctgtctcagaatgaaatgatgtgacatgacatgacatgatgaaatgaataatgaaatgccgggtgtggtggcacactccagcctgggcgatagagcaagtctctgtctcgaaatgaaatggaatgaaatgaagagaataaatgaaataaatgaaatgaaataataaaatgaataatgaaatgccaggtgaaatgaaatgaaatgatgaaatgaataatgaaatgccgggtgcagtggtgcactccagcctgggc

SEQ ID NO: 147600 - DNA, 285 bp, Homo sapiens
aagtgttttcttggctgggtgaatgaatgcataaataaacaaatgaaggcacagtggttaggatattccagaaactcaaggtgagtctgtgagtggcgtgaaatctggctatggaccaatctgcccattggtaccctgagccaaatgccttgctagatttgtctttttttctttttgagagaaagtttccttcgaccaggctggagagcagtggcgcaatctcagctacctaagcctcccgggttcaagcaattctcctgtctcagcctcccaagtagctgggac

SEQ ID NO: 147601 - DNA, 607 bp, Homo sapiens
tcccaggaaattatacagaaccattactttatacttcaaatagcaatgaaatacacaattacaaatctggtatagatctataatttactgtttcaatatatcattttcactgttagttttagaagctatggaaaagcaaaagaaagcatgaactagaactagtgctccttctattttcacaaacatctattaacaatagaaaaaaactataaggatgggataaaacaaacagaagcaccaataagcttttgaagtacctttaaactgcaaaacagaatacagctgttgatcaggagacattcataactttcctgagcatagtttccatagtgtgacatgtacagacaccagattatggagggctatacagaacagatggtggggaaaggaaagcagtactgatcccttacataaggcatttactaatgaaatagttgctgggcactaaggactagtaaagggcatatatatatatttttaaatgatggtgacaatctaggcatttttatagtcagatgggaacagttacagaaagatattgtggcaagagagtactaaggagcaagtaatgactggaaataaggcatattatgaagaggttagcctg

SEQ ID NO: 147602 - DNA, 478 bp, Homo sapiens
gctcggaccgaaattaagagaaagaaggaaggcatacagaattaagggaagtgaagaacccggcacacccaagacaggaaacaggcatctggaaaatccgtcttgagcaccctctcagaaacaaacaggtaaacttaacaccaggttttggatgtacacatcaaagtcttaggaaaagaaagctttttggctgaacttaagattagtcacatgcctgccccttgtccctagcaaggcactgagaggactgatctgaccaagaagcctcctctgagttccatggagggagctagggcaggcagagccccttggggttccacccagacttctcaaagtgaggcaagagggaagttcccagcaggaaatccaagcactgtaagaagggggaataatctctgggctgccaaatatgaatgaatgagtgaaagaacaaataagacaaaggttcactgcactcttctactattttaaaataatg

SEQ ID NO: 147603 - DNA, 363 bp, Homo sapiens
tgaggatcccgctcccggggtaagcggctccacccgacggggtggaactgtaaatgcaaaacaaaacaaaaacatatattcatgcagaacaggtgcccagcacattgagaagcttctcccagcttttctaactgcaaattgaaataaggaagaccaactccctgcccaggacaccctgaagatgcgaagtggccagaagctgctagaaaacagatgtcttctgctaaagggcttccaaccaaagaactatttcttatctagggtcagcattccttgggatttcctttataagttggtcttttggcaccacctacccccccacccccaccccgtcgggtggagcgggtacctctagatcgtcac

SEQ ID NO: 147604 - DNA, 709 bp, Homo sapiens
  misc_feature (371)..(371): n is a, c, g, or t
gcggggctccgacatgcccgggcagctaatttcagcgcacaacccgcaagagtaagacgccacgcagcctctgaaagaatcgggccccaagaaagcgcgctcgtgttatcgctcccaggaaggcgcgcgtcgtgcagcagcaatagctcaagaagaacctagaagtcggaatccggaagaagatcgaacatgacgtggtgatgaaagccagcaagcagcctgcccaagaagctggcactgctgaaggccccagccaagaagaaaggggcagctgccgccacctcctccaagacaccttcctgaggacgctggccccagtgcaggccaacatcgcaccccgtcgggtggagcgctccacccgacgggtggancgctccacccgacggggtggaactgtaaatgcaaaacaaaacaaaaacatatattcatgcagaacaggtgcccagcacattgagaagcttctcccagcttttctaactgcaaattgaaataaggaagaccaactccctgcccaggacaccctgaagatgcgaagtggccagaagctgctagaaaacagatgtcttctgctaaagggcttccaaccaaagaactatttcttatctagggtcagcattccttgggatttcctttataagttggtcttttggcaccacctacccccccacccccaccccgtcgggtggagcgggtacctctagatcgtcac

SEQ ID NO: 147605 - DNA, 680 bp, Homo sapiens
tctttgcctgtacattctcgatggtgtcactgggctccacctcgagggtgatggtcttaccagtcagggtcttcacgaagatctgcatcccacctctgagacggagcaccaggtgcagggtggactctttctggatgttgtagtcagacagggtgcgtccatcttccagctgtttcccagcaaagatcaacctctgctggtcaggagggatgcctcccttgtcttggatctttgccttgacattctcaatggtgtcactcggctccacctcgagagtgatggtcttaccagtcagggtcttcacgaagatctgcatcccaccccgtcgggtggagcaccccgtgctccacccgacggggtggaactgtaaatgcaaaacaaaacaaaaacatatattcatgcagaacaggtgcccagcacattgagaagcttctcccagcttttctaactgcaaattgaaataaggaagaccaactccctgcccaggacaccctgaagatgcgaagtggccagaagctgctagaaaacagatgtcttctgctaaagggcttccaaccaaagaactatttcttatctagggtcagcattccttgggatttcctttataagttggtcttttggcaccacctacccccccacccccaccccgtcgggtggagcgggtacctctagatcgtcac

SEQ ID NO: 147606 - DNA, 184 bp, Homo sapiens
gtacaattgcttctggtgtacttggcattttgagttacagagaatcaagaaatatgattctcacagatgaatggttacaaatggtaattttttttttaatcagctcaccttatcataggaacagatacagcaggagaagctttatttaagagacacaaacaaatatatttaccaacaagccatc

SEQ ID NO: 147607 - DNA, 506 bp, Homo sapiens
cagactacatgaggcagggcagtttcagggatgtggattcagcccccgccccggctgggcttgcctctgattttcttggcttttgctttatgatttcaagacaggtttagatcgtcagatctttgttgtctgccgcaaaagggacatttccgcccagtgtcgtgtgtgtgcgcgcaaacctcccctaggagcccacagtacccttgacattacgacattatgtctttgtggaatcgtgacactggcccctgcccaggcctgtcgctagcagagcaggtgaaaggactgtggttgtctagaccagtggagatccctgggacccctgcacccagcccggcatgttggcgtcatctctgagtcatttcttctcttttattacatgcaattgattcacatttttagcaaaattcctctttcttgataacgtcccagctcttggtactccacaggacttctctttagaacgcaaaaggggctcatctgcccatcccaccattcagcggttg

SEQ ID NO: 147608 - DNA, 811 bp, Homo sapiens
tgttaccagtgtttcggtataaaatttgagaactaaatacaacaatgtattaaataaatttctaattttattagcctcacaattactcccgttagcaatgaaatgtggtgaaaccaatctctgaaaactatctaaaggtttctcactatgacaaagtatcattaatagttaatccagcccctcaacagaacaaagcctcttttaccctgactctgtcaagtagacagtagaagtaacacaagttcttagataactgtgagctgttaccaaactcaaggtgaaacccaatgctgtgttcagcaggaggccaagttttaaagcttttcctgcattattcttaatatatgaatatcatttattttactgataaaatacataaattttacagattatatcatagagtaatattcagaaaaaataagtatttttataatcttaagagacagttttttcataccagatattaacagacaactgaaactacttggttcactgatattgggatgtacaaagtcaaaaattaagctgagcgcagtggctcacgcctgtaccccagtactttgggaggctgaagtgggcagattgcttcaggtcagaagttcgaaaccagcctggataatatggtgaaactccatctctactaaaaatacaaaaattagccgggtgtggtggtgcacacctgtcatcccagctactggagaggctgaggcacaagaatcgcttgaacctgggaggcagaggttgcagtgagagcgaagactgagatcacaccactgcatgccatcctgggcgacagagtgagactgtcttc

SEQ ID NO: 147609 - DNA, 566 bp, Homo sapiens
actgatgccgatccttgaggtgagagatttcagtttgttctgtttgttgaatatatccccagtaacttgcacatgacaggtactcaatagttctttgctgaattaacagatgaatgactaaataaaggacatccaacaacagtatattacatagccattgaaaataatgcagtagatgtccatatacaattacctaaaaggatgcccatgctacaataattgaaaaaaaaaatgcaagcaaaataacatgattgttttaatgtgtgagaacaatgtttatatagatgtatctgctcatacttggggaaaaaaacggagaaaggtgcataaattttttttttttcgttttttgagacagggtctcgctctttccccaggatggagtacatggctcactgcagcctcaccctcaggcagactcaagcaatcctcttgcctcaacctcccaagtagctaggaccacatgcgcatgccaccacacctggctaatttgtgtagtttttgtagagacaagatttcctcatgctgctcaggctggtctcaaactcctgagttcaagtgatcct

SEQ ID NO: 147610 - DNA, 249 bp, Homo sapiens
tcttgattgtagcatgaagtagatttgtgccgaaaagaatgtccgtttgtgatcaagccaaagatccagagacccaatactacacaagaaggagaggaaatggaaactgatatggatgttgcagatgtggctatggaaagcagtccaggctcatccatctctatggagcacaggctggatgttgaattaagggcatcaggttccagcagcagcactaacatctcttctggccccagccctggtcccagt

SEQ ID NO: 147611 - DNA, 594 bp, Homo sapiens
tcttgattgtagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggtaagttg

SEQ ID NO: 147612 - DNA, 283 bp, Homo sapiens
tcttgattgtagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatcgttctctgcctacctcactgaaacacatcaccccccggacttgggaacctctga

SEQ ID NO: 147613 - DNA, 430 bp, Homo sapiens
ggcaaggtagtttgggatcctggagctctgaaggacgggggaagtccttattcttaaagaagagttagggctatttctggctcccaagagatattgggggtggatgccgggataaggaggacttgcagccagctggagcctgagctctgcggggtggagttccagagggtcccccaggcgggaggactcgggattatgcgccccccctacacacacacacctcaagggagctaggtcttcttgggctgggcactcccttccgcccgccccattgcgaggatggaagattggggtgaccaggggtggccagggtagatccccggcgggacaggcttccctcccccgggagcaggaagcagagccccgcccagcagacctgttactggaagtccgagggctgggtcgcccctcccgtccccacttcctccag

SEQ ID NO: 147614 - DNA, 415 bp, Homo sapiens
gaaatcgtggctcacatcatccagaaaatcttgctcagtggctctgagactgtggatgtcctaaaggaggcctacatgcttctcatgaaaattcaacggctacatccagccaatgccaagacagtggagtgggactggaaactgctcacctatgtcatggaggaagaggggagttcccctacacaggcctcttgcctactgccatgtaagacgtgactttgctcctcatccgccttggcctcccaaagtgctgggattataggtgtgagccactgcacccggccaatacatagttttttttgttttgtttttttgagaaggagttttgctctttttgcccaggcctgagtgcagtgagccaagatggtgccactgcactccaccctgggcgatagagcgagactctgtctcaaaa

SEQ ID NO: 147615 - DNA, 393 bp, Homo sapiens
ctctgtcacctaggctggagtgcagtggcatgatcttggctcactgcagcctctgcctcctgggttcaagcaattctcctgcctcagcctctcaagtaactggaattacaggtgcgtaccagtaattttttgtatttttagtagagaaggggtttcaccatattgcccagtctgctctctaactccaatttcaggcgatccacccgcttcggcctcccaaagtgctgggattacaggcatgagccacggcgctcagccacggctgggtcttaactgctagtgaggagctctccgccagcccactgttgggtgtgggttgtcaggagcacaggagactcccaccctccagggtggctggctacactgccacttggagctcacacgtgtagcccc

SEQ ID NO: 147616 - DNA, 145 bp, Homo sapiens
aagtcttaatttatttagattttcccagtttttaacaaaagttatttttctatctcagcatcccattcagatcactacattatattcaattgtcatgtctccttaagatattctttgccatgatagtttctaagtctggccttgt

SEQ ID NO: 147617 - DNA, 158 bp, Homo sapiens
tgagttgtcaaaagccagttacgcaaatggcattgaccttcctagctgtcttctcatgcagcatgtcctggtaaagctgtcgagtggcaaatgagaatccttttctggtctcagtgatggagatgttttcattttcacccacacccttaatttttact

SEQ ID NO: 147618 - DNA, 358 bp, Homo sapiens
caggccagctgaggcccaaaaagtgtaagtgacaggactcctaaggtgtttagacgtagagggagagtgagcaaaaccaaaaaccaaacacgaaaccaaacctttcaaacttgggtgagaattggtcctttcacataagattctttggcaaagtatacaccaccccacctatacaaaaactgagactttattttgaaacaccaagtcaaatgtattgcctgcttgatcagacatcagtaatttcacatttgcttttcttagatttctatcccatttgcttccaatagatctgaggcagctcatgcttcagactctgtgagaggccagaagcccacctgtgcgtggagagatgatcaca

SEQ ID NO: 147619 - DNA, 275 bp, Homo sapiens
atatataaagtccactggatctgttcatatttttgttatgaatatatcttctcctattattacacaaacattataaaactaataaaattctacataagagttcatcataatctcactactcaacgaagttttcacttactcattttctcctccaattctgatcaatgttcacaacatttttacaatgattgtaactgatgccaacatgacagtttgtattcttttttgccctcagcacattcagtattttccatgtgatcagagtgcttatattt

SEQ ID NO: 147620 - DNA, 140 bp, Homo sapiens
tgatccttccacaaggtctggtgcagacatttccccgctgggagactctccacagtacctcatgatcttatcatctctgactgtggcatttgtggataatgttttacttgctaagggttggaactgtctcctcctgggtg

SEQ ID NO: 147621 - DNA, 147 bp, Homo sapiens
gaaagaatgacaggtttttactggcaccttctgagaccaattcagttgccttcacaaggacttttaaacaatcggtatatcagggactgtgaggcccaatttccatttttgagtttttttggggggcaattgtaactatttataagg

SEQ ID NO: 147622 - DNA, 445 bp, Homo sapiens
gctgcttgaatcaggtagcattgtgaacttgtgtcaagccagtggagaactatagagcctgatgtggctggactgtaacagtgaaaggtatttgatctgtgagattacaaagggactttcaagaccagagagacagcagaaaaggaataggtactcctgttatggaagaagaaactgtacctgtcagggatttagcacaaagactgggtggtgctgagtaggctgcagaggtcaagacagggcaggcagtacctactctcattgctcaccatgtgtgagttcaggcaacataaaaaacattggtaaggggattacttgaatgaaagcaaaaatatatttttactggtcatttgggtttatattatttgaaatagtgtaatggtaggatttttcaagttttataagaaaaataggaccattaccctaagttcagagccagggggta

SEQ ID NO: 147623 - DNA, 295 bp, Homo sapiens
tctagaggatccggcacagcagacgtaccaccctgtacatctttggctgcttgaccgaagcaaatgcctattgcttttggcttttttatgtttgttgctgttagagaactcagcagaaacctccagataaacgctttagttgtccaggtaggaaaccaaagtggaccctgggcagttttatttggagacctcttctgcttttgtgattgtgtgtgtgctggtggtactggaatacaggtctctgggttggagagcttgtgttccggatgctggcaatttgatgtgaatgtgctag

SEQ ID NO: 147624 - DNA, 742 bp, Homo sapiens
cctggcctccagcttctgtctgcttattcctgggatgttgttaagagcaccactcagcccctcagcccctaagcagcctcttccagtgttagccagtgccccaggaaagatgtatcatctttcttgctgcccttgaagagtggtgtccagtgaatctttcaaagaatgatactgagcttcattgttgatgaacaaaaatgcaaatctcacccagagcatgcaggaacatgctataatcactacactcctagaatgtgatctctttcaatattgactgcatccatgccttccacacacttgcaccagttgggaggatggagatgtcatctgggcagagggagaagagcagtaccattcagaggtctgtccctcttaagatatattctctctgtcaacctagaccatagttgttcaacataatacttacacatttgaaaaaagaagattgttttattggagtgccttaagatgttttcaacatatggattttacagcagggcagttcaagaggcatgaggaatgtttcttttctctatttgttggagcactggagtgtgagctgaagcagcctaatcctgacttgcagaaatggagaggacatgacttaccggaattgttcatggaattggtttggctaattctcattgattctgccatttctccagaagccattactacagctgttgaaacaggggtagagaaaaatgacaggtgctaagtggtatctaggaggttaataatg

SEQ ID NO: 147625 - DNA, 179 bp, Homo sapiens
ccaagatcgccccactgcactccagtatgggcgaccgaacgagactccgtctcaaaaagaaaaacaaagtgtatgtatacatatacacacacacacaacgctcataagtgtaatcctttatgactattgattatagttctctcccattgctgagttgctactatttatacaactcctat

SEQ ID NO: 147626 - DNA, 109 bp, Homo sapiens
tggttacactcttgttttctttttcctttaaagcagctttaggtttacagacaaattgcgagaaaggtatagagatttcccatataccccttgctcacacacatgaata

SEQ ID NO: 147627 - DNA, 390 bp, Homo sapiens
gagttgggctagcagacaggtggaggggtacataagcagtgatccattttgggcagggtcattttggcctgtgtagctttatgccaaccagaagtgaactgaattagcaaacaccaagttttctggactcgtaatgcttagagttgcatcttctcatctatggcacatgcatctcccttagatgaggttctgattgtgtgaccctcccagtcctagagagcctggaacaattgctctctccaaactgcagagctcatgaaatcagtcgcatgaaggcagatcagaagggaacatacaagtcatcaaatctgcaccagcaattctcctttcaatgtttgcatttcctcactcccattggactcattctgaggttccccattcatgcttgaa

SEQ ID NO: 147628 - DNA, 757 bp, Homo sapiens
agactagagagagtcatcttggaaaagaggtgtgtgctctgaggctggctcttttatttgaaccgacagcttttagtaccaagagctggagctgtgattctcaaactcagagaggagaagaatcactcagtgagctgattaaaaataccgactcacagtcacctccagccccgtctaacggatttagcagatagaaataagacccagtaatctgcgttttaaagaaatgatacagttggtccatggaccagatattgagaagcattgcacagatggtcagtgactcaggagggctcgatttacgatctatccactttacgatgggtttttggagacgttagccccatcgtaattccaggggcatgggtgatccagcttacattgccgggtaagggctaggttttactcccccctcaacggcgcctactgtcttaacagggtccactttgctaaacaccgagttggaaaagcagcttcctctctttcccaatctctgatggtgctgcttccaggtgtaacttctacctgccctctgccttaagggtccctagaacccaggatggctccagagaaagtaagcttgtcatcgacccgtcacttcccaggtggttaacgtccacaccctgcccccagcggcgggggagccgggcctacgggctaaaggacggtgttgtaagaagctggacgagcccggttccagaaaccaaacagcagttgttatcatgccttttaaatcacgcgtagaggtttcagtttc

SEQ ID NO: 147629 - DNA, 309 bp, Homo sapiens
tcagatatgcccccaaaaaagggggggggaggggcacctctaaataagtttgtgaagaagtaggagatggtagtgtaagaaaatgcagatgcacccaaatgttacttcctggggagattattctgtcccattccctacccaatggcttacttatttaatatcctctgctataaactccccaagtatccccaagctataaactccttgaggctaggtagtgtccatctccactgttgtatcctaatacagaattcagtacatgtctgttgaatgaataatgagtgatgtaatcttcataggaggagagaa

SEQ ID NO: 147630 - DNA, 643 bp, Homo sapiens
gtgttgccgtggtgatctagaggatcccggcgctagtccaatgtaaacatttctaagtcccaagatggagtaattagagagatgtttctgcatggaattctataaattgtcacacctgtttagttgaacaatgaatgaaaatatgcagacttgaacagaattcaagaaattattaaaagacttacactttaccagcagaaattacttaatataggaaaaacatcagtcatttttcagggagtcatcaagggatttttaaatcactaaaaatgacaaataagaagcggaaaattatcacaattatataagcagtattactgcgatgtacagaacatctgtcaccagtgatagccattcaacattctacaaggggagccaattgacgcattcaatattacaaggctaaaagcagttattactttttttcacttttaaaacaaaacgcaatcatgtaattttcagttagtataaaaattgaatgcaccctgagtcaaaaataagcaggtatcatattttccatatggccatttgtagcaaatcatacatttcatttttgagaaatggtatatttttcaaagtatttttctgtgtgttaataaaacatggagagaaagctgtgattctttctttctatacatggcaa

SEQ ID NO: 147631 - DNA, 238 bp, Homo sapiens
ccccaggcgcacttctggtgaaagactctggagggcagcaagtcctcagttattcagcatttcagtcccagccccaaaaggcattcaggggaaactccagggtctgagtggctgtgcaggtgacaccaccctcaaccacagcagcttctttgggtctgtctcctgttgggtcggctgaaactacctttggagaaaaggagttttactttttaaaaatgagagaagtgcgcctggtgtg

SEQ ID NO: 147632 - DNA, 234 bp, Homo sapiens
gctagtagcaaccaccctacgggtcacaggcaagttttcgatgttgaataaagaattatatagagtcaatatgaaaaggacaaaatttaatgtgccactaatggtgcctagtttatgttgatgtgcaggagaattcatttacttaatcatttccgttttactcagtgcctcccaccagtattacagtcacagtaagtcatgaaagaataaaccacagcctaaattattcatata

SEQ ID NO: 147633 - DNA, 397 bp, Homo sapiens
gcccctttcccaggtcaaaccatagagcagaggctttggaggtggagctgtcggcttcactactatgggaccttgtatttaatctcaatctcaatttcttaatgtacggggtagggtcactaataatctatttcacactgttgtctgtcctaagcatcgatgaggaaaaaatatacacacatacatacacacacataaaatgtatatatatgtgtatacttttttcctcattgatgcttaggacaacagtgtgtatgtgtgcatatatatgtgtgtgtatatatatatacactttatatgcgtatgtatatatgtacatacgtatatgtatgtatatgtaggaaacctctgaaacactctggggacataataattgctcagaaaatggtgtggaatc

SEQ ID NO: 147634 - DNA, 485 bp, Homo sapiens
gtcatctgggggctggaagtaagtgagaaacttctccttctggatgagatgtagaagctaacagcagtccaacaatcccaaccagaactagaaaagccatctaaaatgcaggatacagaaggcatctgtttgaagggtctgggattctgaaaatgaaaacaaaaaatttggaagaagtgatttgacctctacagccacttttaccctggggacctgtgcccattctgggcaaaagaaggatgcaaggatccagactttatacacatagaaagctgatgctgaaggagaaagaaaccagcaaaacatttggaggaaacttggagaacctcaggcacaccaccagttttcccactggggatattttcctcaagagaaaactacaaaagcctactcaagtaattggtaacacagactggcccactctccattccttcttcccctctccatgaaaaaatttaaaataaagagctagttaagttgccaga

SEQ ID NO: 147635 - DNA, 283 bp, Homo sapiens
agctggggccagaatgagaggggaagacagctcacttacagagagctaaggtgggagagagccctgtgttcttggatgcagcaggctggagtggagtttccatttccctgagctgggaggtagcagaagagtagatcttgttttaaatgccacagactattactgttcttactcagttttagtagactttcttgaataactatattttttatcttgctgtatacagaaaaatagcattttggagactttactgttttttaaaaaatagttttcagcagtctta

SEQ ID NO: 147636 - DNA, 353 bp, Homo sapiens
aaaaaaaaaagaaaagaaaagtagcacaggacctggtaaaggaaacaaagctaaataataaatataaaaatgaagtcgagattgaggtacacaaatctgcttttatatcatttcagcgagcaaggttttaaaactgccatttatagtagcatgaaatacgttggaataaatgcaataaaagattggttcaggacctctgtaccgaaaactgtagaatattgcaagggaaaccaaggccggcctgagcggtagctgagctctgccgtgtgtgtggaggggaacacacgacattgtacagacagcccttctctccaggctcgtctgcagattccatgtgatcccagttggagtca

SEQ ID NO: 147637 - DNA, 162 bp, Homo sapiens
ttctattctgactactcttcaactctaggtcttttggatacttcctcagtcaagcaccttgcacttactttgttcaaaaccatcctcgttatctgtctccccaaattcgtttttctgttttctgcttccttttaagctttataatacacatttgaaaaatac

SEQ ID NO: 147638 - DNA, 435 bp, Homo sapiens
gagaggtggtcacatttttccagttctttatatgtttagaaatgtatctgatacatggtgagcgttctgtgtagagactgtagtctgttttctccaaagagcaggaatggatttgtttcagcaggcagttaacttggtgccactcacactgcagacactcaccagcagatggcagaagctccaatcccagctcagttcttgtggcctcagctacaggctgcctcgagtccccccaggcttgcgtgtgcagaggccagcctgagacttgggggagagtggatcatgaagttcagggcttgcatctttgcatctctgcccctccatcccgattccccttcctttcccctgggagtggttgtctctgggctccatcctctggtggtcagattctaccagaatcttaggcaccctcactgtgccttcctgctgtagctg

SEQ ID NO: 147639 - DNA, 880 bp, Homo sapiens
tcagaaggctgtaaatagcaacagaagtagccaggaacatggtagagaaatcagtgggaagacctagaatcctctctctgtgacctctagataagtgttcgccttctctgaacctcaatgtcctcgtctgaaaacaaaggctgctcagtgagatgacttggaccaagcttcctcctggctttgaggatctgattctaatgctgattgagtggtaggagttgggcatctctgtttagtgctgttttattaagagaagaaagaaccctgaacccttaacttggcccctgccctccccactctgagaccatttcatgctatacctagatatctccttggccagagaccacagcagggggaagagatggaccatctgagcaaaaaatgaacatcaccaagcaaaaccaagatttgcctccatcccctaaatactgaccataaacaaggatgtttaactttgaaagactcagtgaccatccttcaaagggctaagctggtagcaaagagaagacataggagggaaatagagccaagataaattacaagttgcctcagatacttatgtcagtggtcatgtgaggagaaaagacttcatcctataatccttaatcctgtagaagagagaatgttttctatagttcctgggaatagagaagctctgttacctgaggcattcaagcagaagtatggctcctatatgaccaaattgacacagatagtgtagtggagaaaccagctctgtatgcagggtggtctcagcgtccctttaatttgctccaagggcctgctgcatgcccccagtggggaaaaaggcaggcgccctcctccgagggctgagttaggacatggtggtgtgaagtcagctccttggactctcctgggc

SEQ ID NO: 147640 - DNA, 274 bp, Homo sapiens
ccctttccaggtctctttttcctgatccaggagagatttaactacaagtcaccttttaaagtcccataggagacatttaccatctattctctctgaagcctgcttcctggaggcctcatccacataacgagaatctccgcttatcttaactcaaacatttttttatgctgacatcaactcttcagtcagaaaacctttcagtctgcctaggatctgtgaggtcctcaccctacttcttcaagatgttctgggccaaaccaatatataccttaca

SEQ ID NO: 147641 - DNA, 340 bp, Homo sapiens
tctccttttccttcgtattattttctcattcattctattttttatgtctttcctgtcaggtgatctgcgtcatctggtgcttgaacaagtttctttgtcatctggtcccaggctttttattcatctgaagattaatgaagagtagccctaaagaaaactttgtagaggaaagttgaaccattactttatctgattttttttggcaactatctatgaatctataattatttgagagtaaaagttttatgaaaatattggtaaaactggggtcccatcctttggtttacaacagtattacattacatgaggttttaaactgtaagggaaaggcgggtaatgg

SEQ ID NO: 147642 - DNA, 827 bp, Homo sapiens
tggtaatgagctttgaataccctactccaaaacagcaaaaactgggtgaagactaataacctaaatgggaaaattgaaactacacaaaaatccagcggcagttctaatccttggaagtaaaggattttggagatccctgccctccaacaccacaagaaaattttgtctcaaaaaaaaagagttcatagtgttggtaatgagctaacccagctaggggaaggcagcagatgatataaaaatgtaattggaccagtggttattataaagcactgacaacctctctgatttccctgtatcttgcaagtttccttttattctttttctccaggtcaaggcatgcagctagtgggaagaaaatgcatcttgaataagttaaaggatgactggtgttctggattaagaattgaaatttatgtttactttctacccccatgagccagttatccaaacattgccccatcagtgatgctggatggtgtatgagtccataggaaggtgtcattaaacattaaataactattgcataccaggcatggaggccctgtttagtgggggagtcagacaggtccggcagcaccttcaggaagaggcataagtggggtaccatggctggatcagagaaagtcttgtaaagaagacgatgcctaagttaagatttgaaagatcagttgaattaagcagtggtaagtctgggagaggcaggtagagtgtagggccaaagcaggcatggatgaggaggccgagagacaaatacacagcattgggagggctacaagtatttccttctggctgaaggggagagggttggcagggttgagtggaaagag

SEQ ID NO: 147643 - DNA, 382 bp, Homo sapiens
tatcacattctaaccgttgtccattgtatggtgttatttgtctcagatcgaaaacctggtatacgaggcactcatattaaattatcgtcatcattgctttctgcttaataaaaagagaggccttcttaactatcagaggaaacacagtcctatgctgatacacaagaaacacacaaagcgattcagaaaagttgaaatcgacttacggacacacagaaagcatgccaagaatgcatttgtaaaacctgaaggtggaattcagggccaaaagcatcaagtcagacaaataatggtattacattattccaaaagacacagctcacaataaggcattaaacagttatgaatatctatgcactaaaacatagcatcgacattaatg

SEQ ID NO: 147644 - DNA, 509 bp, Homo sapiens
gtaggtgtattgctagtgataggaacttgcttgctgctcccctgtgtattacccttgttttttcaaatgataagaggttttgtagctactttggttcatcagaaaacttcaacacacgtgtgttatataaatcagtatcgctctatctcacaaatagactcaaaaagtaaagatgagagtgagaactcccactaaaaagtgaaaatgctcaaaggggggaaatatggtatgagaccaccacttctcctgttgtccttcccagtttctccccaacctccccttttccctagtttgtaagacagcaaaaaagggagaaagcaaaaagttggaaaaaacagaagtaaaataaatagctagacgaccttggcgccaccacctggccctggtggttaaaataacaataatattaacccctgaccaaaactacctgtgttatctgtaaattccagacactgtatgagaaagcactgtaaaaactttttgttctgttagctgatgtttgtagcccc

SEQ ID NO: 147645 - DNA, 301 bp, Homo sapiens
gcacccgctactcccacgaagcccccaaggggaagggtcaccctctccagctgacagaagtcaagggagaattaagtccctgtgcaagaccacacagtggcaagtgccaggtctctgggcaagtccagatcttttcccttcaaagtctgcactgtcaacatatgttgcctgtaggttgcttcgaatgctcatcaatacctcgtcatgtgcagaaaatctctccctactctacgggcatacaaactgaccccagcagcactttaaacacggaagcatgtcaggcctttaaagtgaagtgaat

SEQ ID NO: 147646 - DNA, 172 bp, Homo sapiens
aatcttccctatgttactgacttacgccatgtattcagactaattgatcaccttaatggcacaagaactgacagctacagacaccaacccctcctccatcccatctctctgtggctttgccacagaaaatctccatgttctattctattccacatcttgttgcttttgtgtt

SEQ ID NO: 147647 - DNA, 343 bp, Homo sapiens
gtcctcttcccatggtgtagtgagagcactcaggaccacctaggcctttcctagaaaactgaacccacaccttcccagtgctgccccaccctggtcccccaccccctgcaggacaaaccactcctcccttgttttggggccaggagtcagatctgcccctgagagcagcaggggcccctttgtcctttgacgtcatacccacaccgctcctggagacagccaccccttcatgccagccccaggaaggcttgtaggtggggcgagccagggtgagagtgtagccctgttcctcggccagggcagatgtttcaccatttttaatggagcaattatgagtcagagg

SEQ ID NO: 147648 - DNA, 911 bp, Homo sapiens
ccttgctgctcactgagcttgttgggattgggcctgggctggcctggaggccacagagagggagccctctcagctggacacttgcctccatggcaagtgctgagaagtggggaagacccttgctggaggggcccttgctggagggtcttgctggaggggccctcaggcacccctggagaatacccaggttcctcagaccttaagccagtccgtgggcttgtgcatgcctcagtgagaggacccaggacagtgcatggcagactcttcctaagaaaggtgtaggagtgtgctgatacccatttccatggccgtaataatcccaaccacttgtgctgagttttctcagggccggggcctgcactgagtgagttccatgtatcatctgatttcatcctgacagccatcctgggagccaggcaccaatattatccccatcagacacatcaagaagctaactccaaggggtctgatgactgcccaagcaatggaggaggcagtggagctgggattcacagccagggctttctaagtccaccccacaccttaacaaacattcattacaggaggaaaataaaggacttttgtctccaatctttgtgacatggtttggctctgtgttcctacccaaatctcatcttgaattgtactccgataattcccgtgtatggtgggagggacctggtgggagatggttggatggtgggggagcagggggtggtttcccccatgttgttctcgtggtagtgaataagtctcacaagatctgatggtttgataaggggaaacctgtttcacttggctctcattctctcttgccactgccatgtgagacgtgcctttcaccttccgccatgattgtgaggcctccccagccacatgaaactgtaacaataaacctctttcttttgtaa

SEQ ID NO: 147649 - DNA, 237 bp, Homo sapiens
ctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgtt

SEQ ID NO: 147650 - DNA, 509 bp, Homo sapiens
tcggccgccgggattccttcggccgcgggattccttcggccgccgggattccttcggcctgcgggattcctagatatccacaaagtttgctccatcacctcctgaggtctcttcaaatctcatgttcactcagtttagaatttgcaacccctgatacacacacggacacacacacacacacacacacacacacacatcacatatatggtggttatttgttcagtgtctgtccctcccaaccccccgattagaatgccagctccatgagggcagaacttatacctgattcaccgcggcctcccccatgcctagaaccgcgcctggcacctcgcagatactcaaggaatccttgctgagttctcagtgtgactcaggccaaggtggggacagtccagggcttctcaggaaactccccagctcctcccagcccacacagtcagggggtctggcagctcacagggaaggaaggagtgggacagaaggaagttggcgcttgcagagatcccctg

SEQ ID NO: 147651 - DNA, 876 bp, Homo sapiens
ctgtttcaaccatatcctttcaaaccagatcagtgaggtcatgaccagaaaacaagccctgccagcctcctacctcaaatctaattaattataattttcttccttatgacaacccacacaaaagacagagataagaaaaacaaggacttcctgggaggctgtggatcaattaccaatggacacccagaagcaaattcacaagactcacaattcaaagaaccaattttttacaattttttttttcctgtcagttgaatttgggaaggaaggaacacgcaaaaatttttaccttcttctttcaattggacactatggacggaaatccaggagagctgaccttggaactgcagacactgcagataaaacagagccagaatgctttgctgccagctggacctttgacccaaaccccagtgtgactgtctccggtgctcactcaactgcagtgcatcaatgaaggaaaaaagaactgagcattggcaaaaagctgaggatgacaagcttaggggatgaaaggctgccttttcccccccttctgagcgtttctgacagctcccagctgggagaaaccaacatgacgaaaagacaaagaatactggagaagagagagggtgggcagagccacaacctcatcctcccagtggttcctcttgagtttgatttgacaagatgccttcccacccaggtaaccccgtgggaacgtgccagtacctcaccgcacgacctcactgagtcctcacaacaaatccaggctgcagatttttttccccacttggagatgacaaattgaaatgcaggaaggttaaagagtttgcctgaggttgcttagataataaaagaatctggattagaacccagacctacccagctaaaaaa

SEQ ID NO: 147652 - DNA, 897 bp, Homo sapiens
ctgtttcaaccatatcctttcaaaccagatcagtgaggtcatgaccagaaaacaagccctgccagcctcctacctcaaatctaattaattataattttcttccttatgacaacccacacaaaagacagagataagaaaaacaaggacttcctgggaggctgtggatcaattaccaatggacacccagaagcaaattcacaagactcacaattcaaagaaccaattttttacaattttttttttcctgtcagttgaatttgggaaggaaggaacacgcaaaaatttttaccttcttctttcaattggacactatggacggaaatccaggagagctgaccttgccttcttccctctacatacaggaactgcagacactgcagataaaacagagccagaatgctttgctgccagctggacctttgacccaaaccccagtgtgactgtctccggtgctcactcaactgcagtgcatcaatgaaggaaaaaagaactgagcattggcaaaaagctgaggatgacaagcttaggggatgaaaggctgccttttcccccccttctgagcgtttctgacagctcccagctgggagaaaccaacatgacgaaaagacaaagaatactggagaagagagagggtgggcagagccacaacctcatcctcccagtggttcctcttgagtttgatttgacaagatgccttcccacccaggtaaccccgtgggaacgtgccagtacctcaccgcacgacctcactgagtcctcacaacaaatccaggctgcagatttttttccccacttggagatgacaaattgaaatgcaggaaggttaaagagtttgcctgaggttgcttagataataaaagaatctggattagaacccagacctacccagctaaaaaa

SEQ ID NO: 147653 - DNA, 311 bp, Homo sapiens
aaggagacctgggaacaccagccttcttccctctacatacaggaactgcagacactgcagataaaacagagccagaatgctttgctgccagctggacctttgacccaaaccccagtgtgactgtctccggtgctcactcaactgcagtgcatcaatgaaggtaactttctgtccagatcatggagtctacatgaaaagaaatcaatgcaatcctatttttttttttttttactgctttctctctctcaattcttggattaaagaaaaacagcagaccctgatggtgcccagctcagaccccctctgaagcc

SEQ ID NO: 147654 - DNA, 137 bp, Homo sapiens
cactttagaccatggtggtgaggcttgtgggaactcaagttcttaccactgggattgatgagaacttagctgatgctccttccttgggtgggtgatcagctaagtttggactggttttcctttctgttataacaaca

SEQ ID NO: 147655 - DNA, 360 bp, Homo sapiens
ggaataaaactcattaggaagcccagaaagctgtaccatattagatgttattttcaaaaattatacatttagtaattcacctcttttcttacttctcagctttatttgttcataattcatctactaagcatgtacttactacaccaagatgcattgaaatttcgattgagatccgtcccaaaacatgtgccattattatggggtgaacgggatttcctccaaagacgatcctgtagcagaggaacatacggatgttgctgttctaaggtttcataaatcacagtgttagtgatgataggtggtccttgaacatgaaaaatgtttcctaggattatctggaagaacttccctttaacatta

SEQ ID NO: 147656 - DNA, 231 bp, Homo sapiens
tcacgccatgtccacaacagtgtataactcctgctttacaggtgtgtgtgtgggggggtgagtgtgtgtgagtttgtaggggtaggtgagtgtgggtttgtggggtgtgtagggggtgtgtgtgggcttgtaggggtaggcgagtgtgggtttgtggggtgtgtaggggcgagtgtgagagtgtaggtatgtgggtgtgagtgtggatgtgtgtaggcggtgagtgtgaaa

SEQ ID NO: 147657 - DNA, 338 bp, Homo sapiens
tgaaggagtcaaattcaggcaaatatctgggaatcagggaccacatagaatcagatcaaactggggctgtgggtagaagacatgtgagcagtgaggactgcagaagctatgaaagaactagagatacaaagttctgaaactatcttcgccttaggaacagactttctcttctagctgtagcaaaagccagtaatggtttcccaggcaacatccagtctggcataacctggaagctcatgtgcttctgcaatgcggtatcatcttttgatgggcaaattttgacataattttccagacttttaaccaatccaggaatggaagcttagaatgttctattg

SEQ ID NO: 147658 - DNA, 451 bp, Homo sapiens
aggcactcaccccactgctaagcaactctgttgaaaagctgatcaaaatgcttccctctggaagccctaacttggtagacttacaaaactactctcttgcataataaagagcaggttcttctattctctcacctccggattccttacactattcaatacgactagtgtagtcaaggaacatgtgggtgtctgccaagtgctaggcactgggggtacagtggtaaacaaggagagaaaggagaggcagataattacaagatgatgaggaatgaaggcagtgactcgtagagaggatgaagatgatagggggaggcctctctcagaacgggatggccgtggcgagccctggagaatgggagagtcaggtgtccaaaaggcattctagacaggaggaagggcaggcagaaagactcagggaacacacctgagcctccagtacagaaaggaggca

SEQ ID NO: 147659 - DNA, 789 bp, Homo sapiens
actagataagaggaagcaaactttagccagactcttcttgcctcaccaactaagagaaacaaagaccaaggtatcacattctgccattagctgctacctctcccttccccattttcagacagattgagcccactttttgtgtcctcctctgctcttaagctgtttctcatcgtgggtgctcagcaacttgtctgctctcactctagtttctatttgcttccctgaaattagcctttaactatgcccagacaagccagagccttgcctaaacttctaattcctctgtgcttcttagtgtatcctttctgcctgcttgcctgcctgccttcctgcctgcttgcctgccttactgaccctttgccccacctctgatattatcatttcctgtgtttttctgattacttacctaaacctctgccaaagagctcgatctgtacaagagctgtcttttgctttgccctttggatctggtatttatgactcctgcccttctgcctggctacacgcttctgctagacatacataggtaccacctctgttatctgggtgcttactggccctccccctttcctatatccttgtctccacactaccctaccacttagagtcctggcccaactgaccatgcacttccgatatagcaggtagtcacccaaagctcagggagatttcatatcccattaagctttcctacctaagttgagactactacttttttctccaatgttttattttaaaaatttcaaacctacagaaaagttacaaaaatagaacaataagcaaccatga

SEQ ID NO: 147660 - DNA, 363 bp, Homo sapiens
gacagaatggcatatttaaaatgtaaagggaaaattcgcttctaatgtagaccaatgacagtttcattacaatgatggtgtttgtttttatatttttgactaaaaagctggagaaatgttgcaactgagttttattttacttattactaatttttgttaaaattccagagaagatagaaatagtctgtgtttttcgtgccgtaatttgaagtgcctgtggattttaaatgatactcattttcaaagtattaacatattaatgtaatatactgatattgtgattataactatattttgctctcattttgtcatatcctacaaaatccttaatacagaatttcttatctgggtaactggttacat

SEQ ID NO: 147661 - DNA, 686 bp, Homo sapiens
gtgtgggttccctttgtggaggtctgcagtaaggggaagtcagggcatgtagaggtgaggtttttcgggcacatgtacggtggcttaagatgctgcttcatacaacatatgtctcattagcatcttaaatctccacctgtgggcatgatttttagtactaaaataaggaaaagttcatgatgaggtgaaagttaagcctagctaggcacgtagggcctcagaaaggtccttagttctctaaagcaaggggttaattaatttgtggttaatagcttcttgggcctttgatgctgactggctgggagttacagcttgagtaaagggcttttgttcttttttctccaaaccacatcacaacaggaaagcagccagcttgcccatctcatgcttgcctgtctcatttccactcctttctctcaccttgcatgtttccgtgaagggagagaaagcaagtacatggagtcatccagcggagttttctcacttacagactatgtaattaagccatttagactccacacaaaagttgctctgtttaaaaaatctttttgaaagaaaagaaaaaaaaggaaaccaacagcaaatacactatagaagatactctttacccccatccagttatctgtcactttacccttatccagttatctgtcattattttctgagtcataaattgactaacccct

SEQ ID NO: 147662 - DNA, 322 bp, Homo sapiens
aaatcttgagggtaggaatatacaaaagaagtgacagataagtttatgtgggattgtgttgctgtctttgttaggccatccttgatagctgttgtccaatgaataaacagttgtgaagtatacctctaaagcatgattaaaatataggtgtatggaaacatcaaatgagcaactatagaaaagcaagtatttgcctataagaacaaatgttttcaggtatctgacattcttagttttaggtactagcagtagttttattctttatttgaaacaaaacgttaatatctttaaaataaatattttattagtgtatgtgttatct

SEQ ID NO: 147663 - DNA, 747 bp, Homo sapiens
ggacggcgtgggtgacccacgcgtcggtaagtatgtgtgtgtaaaaatagcttagattttgaaacttggtttataagattaaataattagtaaatttggccaggcacagctgcacgcctgtaatcccagcactttgggaggccgaggcggatggatcacctgaggtcaggagttcgagaccaggctggccaatgtggtgagaccccgtctctactaaaaatacagaaaaaattagttgggcgtgatggtgcatgcttgtaatcacaggtactcaggagggctctgagcaggcaggagaattgcttgaacccgggagacagaagttgcagtgaattgagatcatgccactgctctccagcctgggtgatagagtgagactgtttcaaaaacaaaacaaaacaaaattaaataattagtaaatttgcagtgatgagggattaccccaggccttttttcctgtggtttgtttttatttttactttaatatttacttttattgagacagagtcttactttgttacccaggttggagtactgtggtgtgatcttggctctctgaagccttgacctcccaaggcacatgcttgtagagaaaatagagtcatagggtctccctatgttgctcaagctggtctcaaactcctggcctcaagcaatcctctcacctcagcctcccaaagtgctgggattataggcgtaagccaccatgcccagtttatatattgctattttataacctagtttttt

SEQ ID NO: 147664 - DNA, 475 bp, Homo sapiens
ctaacggaactggccaaatcaccccctagaaaatcccaaattctctgataaacatcaacaggcttagcagccagcaatctccaccacaatccttccccatgcctggcttcagcataaacgtgcaaactcttcaaactgagtttacacagccattccatccaagacttcctccacaaagggcaagaaacagatagtgcaaggcatctcacagggtcaccaccaaaacagaacatacatgacatcattcctgctcaaagcaaaattacatccaagaacgacaaaggaagtgcttgatattacatctctgaatcaccttcagcaccaaagatagtaaaagatgacaacatggggaagaggaagactttctccctgttgatcatccacacaaaagtgtacttccccgccacctactgactccacatgcccggtcagttacacctgaaatcttttttttttttttttttttttttttgag

SEQ ID NO: 147665 - DNA, 201 bp, Homo sapiens
ctatacagcaaaagagtacatttaaaaaatacttttaacaataccactataggtacgtaggtgtgtttgtaaatatatatgtagatgcaacacatttcacccaaggatataagcaatgtgattatttaattcatgaataagttgtagatgatatgactcatattaaagcctaacctaataaaatattcaaccacagtggaa

SEQ ID NO: 147666 - DNA, 204 bp, Homo sapiens
ggtattaatgctccaaggccaccacaaatcagttgaaacagaatctctggaggtggagcctacatatctgtagagccactgaactagtaaggcaattcaggaatcagaaatacttatccctagaaagttaaattggtgaacctaggccagccatggcagctcacgcctataatcagagcactttgggaggctgaggcaggcaga

SEQ ID NO: 147667 - DNA, 583 bp, Homo sapiens
  misc_feature (1)..(1): n is a, c, g, or t
ntccggccgcagagctccaccgctgaggccaacgaggccaatatctttatgcatattttaataataatgaaagttaggaaagtaacttctttaacagaatacagatgtgacattagtaattaggattccaaataccacatattggagttaagaaaaaaggagttccctttcaattaaactgattgcttaaatttgtgtatttacatattttcttagtgacatccaaaataattttaaactatttataattttctcattttgttagttgttatttacattattactaagatgaacatgcatatacaatttcttcttttttctccctctggccccataaaaacccaattttcttagccattagcattgatgagaggattctaaactagattttctctgtaggattgggtacaacgtaggcacctaacagaatgaactattttatgaatagtagaaataagttataagtagtatgagaattatattacttcttctgcatttctaatatccatcacatcttcagttttagtggtagtgtcttagttcccatcttcattttctctgcttttcatcaatccatccctgt

SEQ ID NO: 147668 - DNA, 317 bp, Homo sapiens
tcgctatgctgcccaggctattctctaactcctgtgctcaagcgatcctcctgccttggcctcccaaaatgctggtattacaggtgtgagccactgcacctggcctgctctcagcttaaaagtcacttcttcaaggagggcttccctgacatgccaccctcaatcaaacctaggctgcattagcacttttctggcagtgggtacgtgtccttcttagcgcttgtcacgatgtgagtcatgatttgtttagtgtttttcctgcttgtgtaagctccaggaaggcaaggcctatgtctgttgctctccaggctcttaaa

SEQ ID NO: 147669 - DNA, 236 bp, Homo sapiens
tattggagaaaaatcctgtcatgcttctgccaggggaaggggaaaagaactatttaaaaatacaccagaacactctgttcttctgaacgtggtctgctcttaggaggaactgcttagccagagcctaaacttcaggggttttaccaacgcctaactgacctggaagaagggaaatacccaattctaagtaaactaggaatagagggaaatttcctcaacttgataaagaatatctg

SEQ ID NO: 147670 - DNA, 111 bp, Homo sapiens
cctccatgactgtcacaccctactcagaataaaatccagaccccttccatgtcccatggccccacacaacttgccccacttgactgccctaatcatgccccgtgctccctg

SEQ ID NO: 147671 - DNA, 361 bp, Homo sapiens
tttaaatagacgttttattgaaatataaacagaaacgtttccaaattggaagcatatcactttctgatttttcataacataaataggaatgcgcctctagacctggctataaagcaagctggagactggcagctctcccgacttgtctttgtgcctgtcccagccacgactctacgaagggtaaacatcttcagtggctttggaaagtgtcacttggcgatgctcagctgtgtcccagacttccctgtgtgtgtccagttaaggtgagccaccagctttccttgcaagataccaaagcaggatgcagtgagaggtgcccatctccatggctggccctgtggaccccaagtgccagcattag

SEQ ID NO: 147672 - DNA, 869 bp, Homo sapiens
tactctcggggatttgcactaaatctcctctgtccttgcgaagccgaggcgaaaaagatagagaaacagcacaaagtaacccgcactcctaattgtccagagcactgcaagctcatcagaagaaaggaggaggaagggagaagagcatactccagcatacaaccaaaagctttgtccaaacatccaagagagcaacaaggctttgttggcaatcaatcaatgaaataacataggaaatgtacatgaaaggaaagtatcttgggcacccaagatcactaaggaaaactcaagctggaaactgcttagggcaaacctctcccattctattcaaagtgacttctcggctcactgagatagatgcatatctgatttgcctcctttggaaaagctaatcagaaactcaaaagaacgcaagcatttgtgtatcaccaatctgtgacctgaaagctccctccccacttccagtcttcctgcctttgcttcaagttgtcccgcctttccagaacgaaccaacgtacttcttgcatatattgattgatgtctcatgtctccctaaatgtacaaaaccaagctgtgccctgaccaccttgggcgcatgtcaacacgacttcctgaggctgtgtcacgggtgcgtcctcaaccttggcaaaataacctttctaaattaactgagacgtgtctcaaattttcgaggttcacatatattttctgtggatataaacagcataatgaataaactatctgaaactgttctgctgtgctaagttaacaaaaaattttaaaaaacaaggccttaaaaaagtcaatgtaacagtcttcttaccactttggataaaacaatgaagccacatttgtgcatattataggtt

SEQ ID NO: 147673 - DNA, 255 bp, Homo sapiens
ctacccttccccaatatgcacatggttgagcacatacactcattgcaagtaatagtaattccattttggaacatccctttgattttagccataactatcagatgatttctttggtatctagtattattctatattttgcttttatttatttgcaaaaattgagtattatttcatgtgagctgaatgtgtgaatttttgtcttttaaaaatattgatgtcctgaaccattttcttactctatttggagctttcatt

SEQ ID NO: 147674 - DNA, 324 bp, Homo sapiens
aactggatcccttccttacaccttatacaaaaattaattcaagatggattaaagacttaaatgttagacctaaaaccatgaaaaccctagaagaaaacctaggcagtaccattcaggacataggtatgggcaaggacttcatgactaaaactgatttcttttttatcacatcgtggtcagagacctatttgacgtactttcagttttgttttttttaattttaagactttttgtggcctaatagatgctctgttcttgaggatgttatatatgctgaggagaagaatgtgtatattctgcagccgttagatgaaatgttctgta

SEQ ID NO: 147675 - DNA, 228 bp, Homo sapiens
ccagtcctgtgctggcacatggccctggagttacagaggacagttctgcctacccagtgagaacatcccagcttctagtgctgctgagttcctggaaggaggagcatctgattggcccaacttgggtgtgcatttccctcccactccagtctgtctctgtgaacatggaagcagagtgccttagaaagtggacccgaagaagtatcctccaactggagagaagagcca

SEQ ID NO: 147676 - DNA, 691 bp, Homo sapiens
aactcactcattaatgtggggagggaaccaagccattcatgagggatccaagaccctaacaccttcaatcaggccccacctccaacattggggatcacatttcaacatacttggaggggacaaaacatccaaaccctatcaccttctgttcacagttttctgagtattttaatctgaattttaaatgccattaaaattttatttagattacattgaaacttaattacacatggctagtggtattggtttatgcatttttagatcccttcaagttatcttcctgttctacctttttcttgggttttgtaattagtctccttcttgaaagattattttggtactggttgttagtaattcctggatttcctttaaagatataagaaatactggggaggggacaagatggacaactagaaatagctgcaatcagaggcttccaacaagaagaacgaaaacggtgagtgaatcctgcaccggcaactgaggtattcaccttctctcaatgggactgactaggtggttggcatgacccatggagagtgaggaaaagcagggtggagcgacagcccacctgggagctgcaaagggcaaggggagctcccaccccaagccaagggaggtggtgagtgattgttctaccctgtccaggaaatcatgctttttccaaggatctgtgcaacctgtgattcag

SEQ ID NO: 147677 - DNA, 711 bp, Homo sapiens
gtctcagcctcctgagtagctgggactacaggcgtgtgctcccatgcccagctaattttgtatttttagtagaggcggggtttcaccatgttgcccagggtggtctggaactcctgagctcaggcagtctgcctgcctctgcatcccaaagtgctaggactataggcgtgagccaccatgcccagccgtgcgtgaagatttttaagaatttcagtgactaaactttaagaaggaatgaagcccacgcaggaactctgtatgactttcaacccgaggggctctggcctgggcttcccagtgactgccggcatcgggacatccactgctgtggccttggccccgtttcccgtgctgtgccccccacttgctgcagatgccctgaggaaagggtggccaaacaaggggaggagctgtgagcacagatggggcctgccggtcaacagggcgggtagagccagcctggtgctgagcttgcagcttggctgggggagacgcctagagccccagtaccacacagaccctccaggactgccgggggtcagtgagcaggaccctctgaggtgtcagacctgccccacatgtgaggggaggacagcacaggtgggacgcatgcaggctgagctgcatcgggcggtgaggctgggaggttgcagtgagctaagattgtgctactgtaccgcagcctgcgtgacagagtgaaactgtgtctca

SEQ ID NO: 147678 - DNA, 329 bp, Homo sapiens
cactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatct

SEQ ID NO: 147679 - DNA, 804 bp, Homo sapiens
ctgaaagggtttttgcattttttttggttgggagacataacagcatgtttatatgtcgatgagaaaaagtccagcagagagaggcaaagtaggaattgcatgaaagagagggaaaagttgttagagttactatctttgagtaggccagagaggatgtgattaatccagatgatattagaaacacggagagttcacatagagggaaagcaggaaacagtggccccagtgctaggagggcagatatcaaagtaggagcttgtggaagctctattctaactgcttctgtcttctcagtgaaaaacgaggcaaagtaataagctgagagcaggatgagagcaaaggtgttgggattattagagaggcaagctgaactaatcataagcaccaatttaaaaaattcgttttgttcataggttatacccagggatggatcatcagtgagtatcttctgagtacaggatttacccagcattaagtcatcatttttaatgtcaataatacatagtttggtttgctttccaaagaccacatgtacaacacacatcaactaaaaacctagattttgtctttacttatcaaaatgaacatgtctttccccatatagaatgcttttaaatagaaattatcatctaattgattgttgccatataacaagtcaagatacagtactagttcttttgctaggtaagtttctacctgtttctgacacactctcatctaccaagataaccacatcctcaacaagaggcttttactgtacctgattttaaagttagggggaagaggttgttttaagcgtagaaa

SEQ ID NO: 147680 - DNA, 184 bp, Homo sapiens
ctacgagttgaggggagtgaggcctgcctgtagacctcttgattgccctgctctgcaatagaatttgctagacttccacgctgtttgactctgtctctctgctttttggttctcaggctgaaattgtccatcctagaccttcacaacctataggacaccctccaacaccacttccctgcacagc

SEQ ID NO: 147681 - DNA, 165 bp, Homo sapiens
ttcaaccgaaagagtgaagaaacagactctactgagctgctttctccacagaaacaagagtgcagtacagccaagccaggatggaagtgaatacatatggagagggggagagggtggctagctgttcaccaagacttttttgttgttgtttattttttttttttt

SEQ ID NO: 147682 - DNA, 414 bp, Homo sapiens
aaggaccgggggaaaggcaggcatggccagggtgccagatgcagggagggctccagcgagctgaaggcggaggtacggctgttgggcttggcaaaaagagggtcaggggagccccagaagagtgaggtcagtgagtccatagggaggtggaagccagactgcctggcagggagggcatgcaggcgacatgctgcccagggtgtggctcactgtgcccctgcccgctgctgccgtccaccccaccctctcccgaagcaccacatcctcccggccctagcgtctccctgctgaggatgcctacacaccctcccgcccaggcctctccagcaagccacagactcgtgtatctcatcctcttcccctaggtggccccagggcaccctagatcccactggtctataacaaacgggccct

SEQ ID NO: 147683 - DNA, 405 bp, Homo sapiens
  misc_feature (4)..(4): n is a, c, g, or t
cggncattcgcccgggtcctgacctggcccccatgcgagcccgtccgcccctcgcgtgggagttccgccgaggcccgccctcgctccaagccccgccctggccgcccccccggagccggagccccgtggaaaacgccacttcctcgacggaattggcctgccgtctcgccgcgccgcccgtcggagcctgcacccagggccttttctgttcctaggagactcgctgaattttgggacgcgtcccgctgacgataactccttttcccctgctattgtcctcccgcgacggtgcgaagcccaaacgaagacgccatcggcctcggcggggattttccccagacgctggacccggcctccggttgctgcgggctccttgtgcgcctgcgcagtcgagaagggggccca

SEQ ID NO: 147684 - DNA, 330 bp, Homo sapiens
cgttcgacatctcaaagagagaacaaccgtgttccctctccaccccacagttcagtgtgcccagcttggaaactcacatctttttggggattagttaattgattggagatatgaactgtatctagtggaggcatgtctttatcttctagagaaaaatctttagatggtttatcccttttaactttggttataaaagtattaaaaaagaatacacaaaagatctgaaaaagaaacaaaatcatctgtaatcctatcacacagagttaaccactgttaacttttaaagcatatcttttcaaacttttttttctatgaaaatatggagattcg

SEQ ID NO: 147685 - DNA, 776 bp, Homo sapiens
caagaaaatagatgaacccacgggcagggtcgagcaactctggatgggaggaatgaacaactctggacaccacctttatgaactgtaacactgtaacactcacctggaaggtctgcagtttcagtcctgaggccagcgagaccaggaacccaccggaaggaacgaacaactccagatgtgccgcctttaagagctgtaacactcaccgttaaggcctgcagcttcactcctgaagtcagcgagaccatgagcccaccagaaagaagaaaccccggacacatctgaaaatatgaaggaacagactccagacacaccatctttaagaactgtaacactcaccgcgaaggtccgcggcatcattcttgaagtcagcaagaccaagaacccaccaattccggacacaatcacaaaattaaacctcctcaaatagagattgacagtaaatgtaatctgtatttctgttcatgccatcattggtagtgaattatttaaatatataaaacattctcaaataactcataacaggacaattacctatctaatttttgctctttataaaatgaaatgtaatctccgtctaataatttaaattgtttttacaatctggtctaacaggaatgtttcttattcttccatatgttcttaacagacttactttgtttttactttttgtcatctttataaaatcacaaatctctacattatgtatttatgcaaaacatacacttctcttggattgtcaaaacgaactctctcccttaaaaacattgtaatat

SEQ ID NO: 147686 - DNA, 884 bp, Homo sapiens
  misc_feature (27)..(28): n is a, c, g, or t
  misc_feature (56)..(56): n is a, c, g, or t
  misc_feature (65)..(65): n is a, c, g, or t
  misc_feature (70)..(70): n is a, c, g, or t
  misc_feature (72)..(72): n is a, c, g, or t
aaaagaaaattaacaataaaaaaaaannaaaaaaattttattgtaacgactctctnattaccacngctanangcccatccggaatcacacttttcacctgcagaaactcatcaggctcgtctccaccaatgatggtaaatccaaagcccatgttgctcttttttagggtggtgctgaggaatgttcccttcaactgggatgcatcccgggtgaagagtggtttttctacattggccaatataagttaaaaaagaaaaaggcatgttcaagtcaagttctcagacaagagaaagccagcccctgagcagcgacaatcccaggggtaaatgtggggggtcttatacagcaaatgcaagcaggtggtgactgcaagaggagcaaaactattagaacttcctacacacgaagagcagtcccaagcatccagggaaagatgaaaaagctgtttggtttggagacagactttttgtcaaatcagtttccactcattaagttagccttcttgtgcttaaaaaaggctgtgtcaacaggctgccagagccttctaagaaagaggacaaggagcccaaatcatccagacaacatctggatctgttcctgttgttattgtgaaagattccaggtaggaggtatgtgtcagtggccgatcctaaactaagccttgaagaaataagggtagagaaatgaaatggacatggacttgtgattttttttttaagtgaataagagcacaatatttcagcatgtgcaatatcacaaacagagaaacagtggaatgtgatcacatactcaaaggtccagattgcttagaaagagtacctgtatgtggaactgacttttgtttacactgctctattgtgagatactataaagataaccagata

SEQ ID NO: 147687 - DNA, 703 bp, Homo sapiens
gccatatttcagttggtgaaaagtgaagcagaggaaggtgggggttgtgagagccgggagggggtcccccactctgtggcacagttagcttggggaagtcagcagtgggaacatgaggagatcaagctgtggggcctgagcagggccagcagcaaagggggtcccagccagaggcaaggtgtgtgctgggcatgtgtgggtgtgtgctgggcatgtgtgggtgtgtgctgggcatgtgtgggtgtgtgctgggtatgtgctaggcatgtgctgggcatgtgcaggcgtgtgctgggcatgtgctgggcatgtgatgggtatgtgcaggcgtgtgcaggtgtgtgctgggtatgtgctgggcatgtgctggtcatgtgtgggcatgtgctggtcatgtgtaggtgtgtgcaggcatgtgcaggtatgtgctgggcatgtgccgggcatgtgcgggtgtgtgctgggtatgtgccgggcatgtgaaggcatgtgtaggctgtgctccctgagctctggcaacaagaaagcagctgtgtttgggtgcagggagtgagggggacagtgtgcgttatcctgacacacataggggccccttctgcatcctcccaactcacatttagtccccagatattcacagcctgtgtggctgctgatcccagcccttccagatgccactggtgaggaagacagggatgggggaagg

SEQ ID NO: 147688 - DNA, 223 bp, Homo sapiens
tattcctggccctcatcttactgggtgtcccagcaacaatctcccctcctcaactctctgaccttgctcctccaacacttagcatctcagtgtctcctcagacctctccaactgctcctctcaggcagcctctgcccctgactccccatcctctatctgttcatctctgcatgcatgtgcagtggcacaatcacagctcgctgcagcctcgatctacctccca

SEQ ID NO: 147689 - DNA, 334 bp, Homo sapiens
tcaagtttttccctatatgtttgcatatatggttttcatattgttatacactttcatgatcagatactccatagtagatgggttggctgatatgaaaggattttttgttttgttttattcctttaatatgtgtcatcaacagtttaaaacttacagggatttttaatactcatttagtgccagttgtctttgaaacaatatttttatcaaagattgttgtgacagagaagaatatcttcatggttttgttttggtcttcacttgggtaacaagttactggtatttggagaacaggagagactattttcctcagatttcgaaatggcaaagcata

SEQ ID NO: 147690 - DNA, 130 bp, Homo sapiens
cccacatcctcaaatgagggtggctgcctctcctatgtgtgcccataaaaacccttatttctatctaagcactcagtaaacagcactgacattgttttctctgtatctgtgtcaccagatagtgatccca

SEQ ID NO: 147691 - DNA, 121 bp, Homo sapiens
gcctcgagtgctcctccactccagcttggtgttgaaccagccttctcttcctgagtgcgtgaatcgggttctttcaggttctgagaaacagatgtgttgagagctcctcttcaggggaggg

SEQ ID NO: 147692 - DNA, 195 bp, Homo sapiens
caaatagaaagtttttcatttaaagaaataaaggcaagatggcagtttcccttagtttaaaaggtaatataagacctaagaataaaagcagctcactaactggttaatacagtctacttacataataaaatgcttccaattgtatgttaaaaaatgaagaagctctttatgtgctgatacaaaattgctaagcca

SEQ ID NO: 147693 - DNA, 307 bp, Homo sapiens
ccaccacatccaacatggctccttgtttccccagcccttttccctgtccttttgcagaatgtgaaacacaccatcgcatgcaatcagtgtgcatgtttacctgtggatttcccatgttcctactggaatgtgagcaccgtaaggactgatatttcatgggtctctctctgttgcatttccaggacctagaataacacccagtgcataggaggtgctctatttgtagaatgtagagtgtttgtagaatgcaagtgtgctctcacagcacgactgttcacgccatcacggtgctctcttgctctattct

SEQ ID NO: 147694 - DNA, 335 bp, Homo sapiens
gcaaaagtagtgtttccctcagaaaaatcaaagtatgatcaaaacaaacatttagaatacacataatttggcctttcaaggcagccgttattaacaccttggtgtacatcttttcacaatagagtgggacatttcaatttaagattttcagaatggaacagttccaagccgtggccatggaaataggtggctgggaatgagtggaggtcaaggtcattattgttgaagaggtcagggaactgtgagactaagttattgcttaggctagttatctgcttggatatggatgtcagtcaagatgatgacagcatttggcatacagaggaaaactgtga

SEQ ID NO: 147695 - DNA, 416 bp, Homo sapiens
acagttggataaatgagtttggaagtaaggagaaagatctggcaatagatataattttggattttatagtggtgttttgatagcaattgttgctatcgccaaaataattcatcaacgagctccctgacagctccctgacctttctttttaaagaaacagggttggccgggtgcggtggcccatgcctgtaatcccggcattttggaaggcagttcacctgaggtcaggagtttgagaccagcctgaccaacatggagaaaccccatcactactaaaaatacaaaattagctgggtgtggtggtgtttgcctgtaatcccagctactctggaggctgaggcagcagaactgcttgagcccagcagccagaggttgcagtgagccgagatcacaccattacactccagcctgggcaac

SEQ ID NO: 147696 - DNA, 359 bp, Homo sapiens
tagacacagcagaatgtcttttcaacgtccatcttttaccagctgttcatgttgatgcttgttgaggactgggctctggacttcctgtccttgtgctattctcaatgacttgagtttcccctagatttgtcttttgcttttcatttgataaatcacatttctaagtggtaggtttcgtaatgcctggtaataagataggctttttaattagaagtttgttttcattaccaatttaatatttgtattaagagtgtcagaaaagtataacatttaaaaccataagccctaaagtaaggctgcctgggcttaaattccagattccccacttactaactagggcatgatcttgtgatgttgta

SEQ ID NO: 147697 - DNA, 248 bp, Homo sapiens
tctattgtgattttatgggtctgttggaagagagtctctgcttgggaaagcagaggtggacaatggacttgctatcttcagcccctcagagccttcccaaaggctaaccaccttggggaaactgaggctgtatatggaggagttagatgctatatgctgtattcagaaagacggcttgctaatagcagctgttgcaggggttgagagaagatattaaccttgagcttggagaccccaacaaggctagt

SEQ ID NO: 147698 - DNA, 369 bp, Homo sapiens
tataaagtggcaataaacttggctgaattatcctcatgacagaggacgttgtgggaaaaataattaaaaagcaatgaagcaatgcactgaccaggcatggtggctcatgcttataatcccagcactttaggaggctgaggcagaagaattgcttgagccaggagttcaagaccagcctgagcaatatagtgagactttgtctctacaaaaacaaacaatcaaatgatagatagatgatagatagatagactacatatatatggtatatatgtacacatgaatatatagacaaaaatattttattaatattttgcttagatatttctgttatatatatacatacacacatacacacacacacacacatat

SEQ ID NO: 147699 - DNA, 100 bp, Homo sapiens
ggggaagcatcttcagtagtgattctaaatgtgacttagaaaactgcccatggtctgtgaggctgacagtgtcattgcctccgctctttataggacgggg

SEQ ID NO: 147700 - DNA, 221 bp, Homo sapiens
ttctgattattgcatttgattagattaaaagagggcactgcactattgggacttgatactgaaaagagatgttgcagaacacagaatatctttgtgtgttttggtacaggtagcaggttatgtttaggctaagcaccctactctatgactttgctaagattatctactgcttatttcttaaataaatttgactctcagtgactttcctttccaatctattc

SEQ ID NO: 147701 - DNA, 193 bp, Homo sapiens
tcactcactgaacatgatatgatgttctattcctagcctttcttcaacacatggattcattctgcaaagcaggagagagaggaggcaggtcaggtcttcactagaaagcctcacctgacaccagaagctgtagagaaacccagtttctagaaggctgtcattgtccacaggtctggggagaactctttttttc

SEQ ID NO: 147702 - DNA, 328 bp, Homo sapiens
gatagccctatcctgacttcagtctttccttgcattgctttgtacttttaccacctgattattcattcctaatcaatatggtttggtttggtctgtattttgagtgtacattaagagaattggagtataaatatactttcatgttgggctgttaaaactcaacattggttttttgttttgtttttttgagatggagtttcactcttgtcgcccaggctggaatgcaatggcacaatctaggctcactgcaacctctgcctcccaggttcaagcgattctcctgcctcagcctgccgggtagctgggattacaggcgtgcgccaccacg

SEQ ID NO: 147703 - DNA, 473 bp, Homo sapiens
tcaatatcctttaaaacaattccaaactaactcgctgtgcctttcacagaaattttccacaagaaatatgatttataagctgggcgcggtggctcacacctgtaatccctgcactttgggaggcagaggttgcagtgagcccagatcgtgccactgcactctggcctagtgacagagcaagactccatctcaaaaaagtaaataaatttttaaaaaaataaacaaataacttgataatttcaggttgtgatgggtgctgtaagaaagacaagacagtaatgtgatagagtgacggattggggcagcagaggtgggcagtgacttcagattaagggttcagggtaggcctcagaggaggcgacacttgagatgagacttgagggagccaaccgctgagatcaagaaggtaggaagaaagagcaagtccagaagtcctgaggctggaacaaccttgagtgtttcaggaacaaagg

SEQ ID NO: 147704 - DNA, 313 bp, Homo sapiens
actgagcatttatctagaatctagagctcttagctgctgtgctgtctaaacactgttggaatttcagaatgaatcagagactgctgacttgtcttcctataaaaaatttaaaatccaaaatcaagactggcctttgtgttgctgggccatgttgtttttgttcatttattcacctgcatacaccgtggggcacatggtcccatcctttaacgctttcctatgaattagctgtgtgagacccacagtagctttgtaagagagtttgagcccagtctaagcagacaagtgactggctctcccactggctgtttgc

SEQ ID NO: 147705 - DNA, 390 bp, Homo sapiens
ccagagcgtcggaatttatgtgcaatggtagaatgttaacttcaccataggaaactcttaattcattactgtgaattatgagaagtcgtgattctagttactgacatctcactttgagatgtgaccacactatttatgttcagccagttccagggtgggaacaggtgattaaacacaatgaaagaaatcaagactttgtaattattcatgcacgaaaggtttacctcacctgggtcacagcacttgttgtgcgcccattgaatatcttagacatcttagagagcttttcgtctcagttaaatgattgattattagcgctataaaatatattttaaatttgcttttggttttggcttctctaggctctgctattatacttgttctttaaaa

SEQ ID NO: 147706 - DNA, 481 bp, Homo sapiens
tcttttaaaatgatgagggggaaccttcagacagtgtcctgattagggtgggtggagaggggggtttcccagaaagtcaggcagggcagggcagaagccctctgggttaactgtgtgcttttgatatgaaggcaggtaagactggacaggtgggggtgttagtgaggggatggactagggtgtgctgaagaactccacttgggctctgcacaccagggaaaatgaccacaaaacatcccatcttcactgctcagagaaggctagatctgctgtgagctaggaagccatgtgggggcagctgatgagtcatcaaatgggagaaatctgagagccatgtgttccacaggcctctggtccttgttcaggcagcagggcactgtgagatgtggctccttggccctttccagccaccaccttgattgcctgctacaaggaaagagactgaagcccaagaatggggtcttgctcaccataggatgat

SEQ ID NO: 147707 - DNA, 748 bp, Homo sapiens
gatattgaataaacagaagaaccccaaactagttggtacattttggttcaatgtaataattattttttactttttatttttttaaagagacagggtctccactctttcacctggactggagtatggtggcatgatcatagctcactgcaacctcgaactcctgggctcaagtgatccttctgccttggcctctcaaagtactgggatttaccagcattagccaccatgcccaaccaaacataagaattttctaccaacactgtcagaaagtggaattagggttctgcagtgatcatgagtttcttaataatgagggatattcaaggagaggctagatgacttagtggctttgctatagaggagatggaatgccagatgtaactctttctgacctgtaatcccagcttgcaaactaaataacatcagtggtactcagctttccttgtgtgtctacaccatccatatactcgcatcagcaatgtgtagcaattttgtgctggggtgtattagagaatagtatactttttgttctctttgagtattcatggactggactttctttatgtcccttttagtttaacagttccaattttcttggcatcctttctgatgttgtcgtagggccttatttcaagagcatgctggtctgtaggatctggctgctcctccactgaaagcccccagaatgctttgttacattgtcaggaatttctgtatttcttttatcttgtagctttctctatcatat

SEQ ID NO: 147708 - DNA, 456 bp, Homo sapiens
ggttaaaggttagtagagatagatagagatccgtgagcacataaatagtatggctgtaggcgagagaggagatggaatgccagatgtaactctttctgacctgtaatcccagcttgcaaactaaataacatcagtggtactcagctttccttgtgtgtctacaccatccatatactcgcatcagcaatgtgtagcaattttgtgctggggtgtattagagaatagtatactttttgttctctttgagtattcatggactggactttctttatgtcccttttagtttaacagttccaattttcttggcatcctttctgatgttgtcgtagggccttatttcaagagcatgctggtctgtaggatctggctgctcctccactgaaagcccccagaatgctttgttacattgtcaggaatttctgtatttcttttatcttgtagctttctctatcatat

SEQ ID NO: 147709 - DNA, 344 bp, Homo sapiens
aactgtgactttaaatgaaacgacatataacaaaaccaattttaccacaggctaattgatagaaacaagagttcagttcctgtgtcatatttctgtcacaaagacatcactaaacctctatttaagagacaccaaattgtctcttaagtaaagactcaaaacacttttaatattaaatgttgaaatgaaatgtgtagctttacacatacagttaaagattaacaaagcaagtatgaaagcttccccaatttttggtaaagcagtaagtgacagtggctgttgttgtagcggctgtgggttaaatcaaggaataagagttcacaaagtaaaaattgtaaggagca

SEQ ID NO: 147710 - DNA, 817 bp, Homo sapiens
ctgtaagcgtaaagcttggaagaacaaataggaagtactttcctctgatatgttctaggaagaaatgtttctctttctagggcaggaaacactaaaataaaaagcttctggtcagagtgttgatacctgacctcaaactggccctcaatcactgtttggcagacctagcatgaattcccactgctgccaagaatggcagggtaaacagatcagctgaatgtttcacatcacgtgttcacctttcaaaaataatttcagttcaagatcatagagctttatagctcacacaagattttaactttctaaataactgtaaactttaaaaaatgttttcgcttgcaaaaacagaaggatataataaaatgtagagtgatttggagtttccaagtattttcacatcccttatccaatttaattttcttgataacccaaaaagagcattatcattaaacccatttgatggacaaataaagtctgctgggatcaacttgctggggatcctggactgtaagtcattcttctgaatcttagtgtggtgctctaccaggcaacactgttccgagtaatgcaattctcttcttttccttatttagtcaaagtgtaattgaattaaatactggagaaagtataaaaatttaaagctacataaagttaattttagaaaaaaaggttagatgatatactgaagtatcctattgaaaagcctggctcttggaaacccatttagtagaagaaaatataacacttagaaaagcagaactctcttccttgaaaatatatttaacaaattcttcctatgtaatgaaactgttagggc

SEQ ID NO: 147711 - DNA, 493 bp, Homo sapiens
aagggtgtggcgggtgcaatgctttggccagtggcaggagctccttggggctggagccctggacaccagtgctcccccaggtctctgaggttcccagaaaggcctttgccatggctcccagggtgctattaatgaggggcagtggtatccctggccagggagcttgtttccaggatcctctaatgcgggcgcaggtggctcatgaccatctctgagggctggtttctcttaatgcaccggttaggagcaatgggcaccttaaaggggcaggcaggcagaggtcgggggtctgggccttgctgctcctggcatcatgtcctaagacccatgttctgagtgtccaggtccctcctctgtccccgttcatccttcctctgagctgtgcacctgtcccacctgacagtatgtcccacttgaaggcagctcaggggtcctgagccttcctacggggctgctgtgctgggaccttcatacgcacacacacgcgcacacg

SEQ ID NO: 147712 - DNA, 170 bp, Homo sapiens
tcacacacttgcccactaggagaagatgaaaactcttccacgcccagctgctgctgtcctgctggtccactgagctttcctggtgattttgcgaggtcatggggccatcacatgctgtgttgcttccttttacttctcttgtacagatggtgatttcaaattggtcttgg

SEQ ID NO: 147713 - DNA, 129 bp, Homo sapiens
agagatttgtttctgtgaaggatgctgtgaaaagtatgagaaccaggtgtcttctctttacaaaatggtgctgatgtataaggcaatgaaaatattttgatgatttttttaaaagaacacataaagtaa

SEQ ID NO: 147714 - DNA, 133 bp, Homo sapiens
gaggccaactaagcctgatttgactccccatggtctttgttgtgatttttaaaatcagattaaacttacttcctcagcagctggttcctacaggctttggggagataaaagtgtcagcatgtttctgcagcca

SEQ ID NO: 147715 - DNA, 329 bp, Homo sapiens
cacaatagggcttgtgctcctatgagaatgggaggcctctgctgatttgacagggggcggagctcaggctgtaatgcttgcttgcccgctgctcacctcctgctgtgcggcccagttcctaacaggccacagaccggtactggtccacagcctgggggctgggcacccctgctctatatgtaccctggaatgaattctttttttatcccaagatagaggaatgtcttctgattggcttgcatgtttttttttcctaatgaggctgtatgtacctcatttcccaacatgctcatttgtctgacgtggcttttgtgaactcagagctcctt

SEQ ID NO: 147716 - DNA, 367 bp, Homo sapiens
gagcccacagaaaaaagcaaatagacgcagaaacgggcacgtgcagtagttctggccacacatgttccctaggtatccacagaatggcatgggtattgtatattcataaagatggagatcagtcatggaggccaaggacaagtaggtgcactggttgaactacagtagagaatggcatggaagtggtgagcaatggacctgggcctgtttctcaagtgtgtatttgatttctttacaattccccggagaagttgtcatgggaggccagccgcctgctggcaaggaagatggttgattcttctgatcaatggaggccctgcagagtcctgtagtcactgtggcctggcatccatggtgcacccaatgc

SEQ ID NO: 147717 - DNA, 271 bp, Homo sapiens
gtttcattatacagttgtttcattactcatcatttttctcttgtatactaataggccatgtggtgagctggggtgaaaagcaggtgcttcgaattatacatcacaatcacctttttcactcatttattaaattgtaaaacccgcaattcattttgcaccaacctaataatttctttttttttttttttttttttttggggagagggggtttaattttgccccagggggggggggcggggggggaatttggtttaattgaagcccttgcctc

SEQ ID NO: 147718 - DNA, 378 bp, Homo sapiens
gctcccggggatgctggagatgttttacttctgatctaagtgttggttccatgggtttgttcacctgtcaagagttactaggttcagtacttacaatgtgtgctttcttctctggctatgtctgagctaacacagaggattaatttttaaaaaatacacaaatctgtctggtcgtggtggctcatgcctgtaatcccagcactttgggaggccaaggtgggcagactgcctgaggtcaggagttggagaccagcctggctaacatcgtgaaaccccgtctctactaaaaatacaaagattagctgggcgtggtggtgggcacctgtaatcccagctacttgggaggctaaggcagggatatcacttcaacccaggagt

SEQ ID NO: 147719 - DNA, 256 bp, Homo sapiens
ttattcagggtacgctgtagagatgagaaaggacctgaccaaggacatggttccgtctcagaggcaattgggcaagaccagtcaaaagtacaaatgtgcgtgggcacagtgggtcacgcctgtaatcccaacactttgagaggccaaggctgaggctctgcagacaccccaaataggcacccccaaatacaaggtctgactgcaaaggccatgccctcactaggttgctgttacatgtgtttagaaggtgcattca

SEQ ID NO: 147720 - DNA, 317 bp, Homo sapiens
ccacccttcccctccgatcccaccacccttcccttccgatccccgtcatccttcccctctgatcccccacccttcccctcctgtcctccccagccctcccttcctatcaccctcacccttcccctcccgttctccccacccttcccctcctgtctccaccagccctcccttcctatcacccccacccttctcctcccttccctcaccccaaacccctgggtcctccaccccaatctctgacaaccgccccaagtccctcttccttccccacgaagtcattcataagtcaccatctcatctcattttgagtttgtttt

SEQ ID NO: 147721 - DNA, 103 bp, Homo sapiens
atatttaagacagccttaactctaaataccacttttcaccaattgccgcaaaaccgtttgctagcgtccttcctccagattaacctgatcaggagagaaaaca

SEQ ID NO: 147722 - DNA, 246 bp, Homo sapiens
gctggcctgggctgtgtgcttgcctgacgtgggcccagtgggctgcaggcctttgtggaagaaggctcaccagcaccttcccacagcatcctcctaccctggcaggcactcttgtcttaatctcaccgtggaccctgacctgaactttcagccctgctctgaggcttttctgaaatccctgctctacacgctgaggccagagccctaaggggtttgatgcttttctgtcttccagcacaaatccta

SEQ ID NO: 147723 - DNA, 239 bp, Homo sapiens
ggccttctccaagagaacatgcacacagtaggcgtgcagtcacccgggagatggtgtgcaatgacaggcacacagtaggtgtgcggtaacacgggagatgtaggtgcccagtgacaggcgcacagtaggtgtgcagtcacccgggagatgtcggtgtccagtgacaggcgcacagtaggtgtgcaattccctgagagatgtgaaccagtccagggccccgcgtgggagctgaaggggag

SEQ ID NO: 147724 - DNA, 380 bp, Homo sapiens
cttggttcgagtgcagagattcctccacagattgcagtcggccttggaggtcgcagagttcaccccgtgccaggtgaatttgattaatgtcactaatctccctgttgctctgaagtttggtctcactccttgaaagagaggatgggagatgattacttcctggacaatttggaaactccagtgtgtctgactcggtggggttgtttgccgtctgctcctgacacccaggggcagatttcgatgcactgttagttttgagtgacaccagattctggtgattgttacttgatgaaggacagtctgaggctcttcctgggtgggctggctggctgtgggagccttgtgagggggaactgtgagtccgtggagatgaaggaaca

SEQ ID NO: 147725 - DNA, 238 bp, Homo sapiens
gtgaatgcttcctgctcgttggctttgctgctggctggtatatgagtagcactggctgatgtaacaaacgtacaccaacgttccagtggcttcctacaagagttctattcttcctcatgaaaaatttcagactacattcctggttgtcaggaagctcccctccacatgatgactcagggactcattttgttcctcatggctctgccctgtcttgtgcatgttgttggtgaagttgata

SEQ ID NO: 147726 - DNA, 169 bp, Homo sapiens
ggaccacaggcacacaccaccacacctagcttatcattgtatcttttggagagatggggtttcactgtgtggcccatcccctgggctcaagcaatcctcttgccttggcctcccaaaactgggagctgtgattacggacgtgagccattgcaccccgctgcttgtgcag

SEQ ID NO: 147727 - DNA, 474 bp, Homo sapiens
tgcaactgaggggaagattagattattagcagctgctgctaccatttattgagcacatactatatgccatatcttatttcatttaacctatacttcagctctgtgaggtaggtagttattttcattttataggaaggaaaccaagtattggttgttccataggtaagtggcagaaccaggattcaaacccagattatttctgactccaaaactagactctttttacttgtgctgcatcccctactgtaatgtgtttcttgatctaaagttttatatttttctaagaaatttacctttatattattaactttcagaatttaaaaaatatatacattttgttttctgctaatagtacttactgttctgtcagagtatatttcttgtgcattttctatactcataaaaagcatttctgtgacattcacatttcttcactgtgtattaaatccatttttagcaccgatttgtttgatg

SEQ ID NO: 147728 - DNA, 453 bp, Homo sapiens
tagggatgttcattttctgttttatagggatatgctttgttttttagtttaataagcatgtattttttgtcttaactatcacaggttaggggctccagaaagcagaatttgagacacaacttaatgtgcagaatgttaagtagtgctcttctgttcaactcctgtggaagggaagaagcaagatttggcagggagaagttgagctgtggtacactgtgaacaacaggagctgactccacagggagctctggagctaacgtggacttttagagttgccctgctttgagcagaaatggctggaccatttatacctttgtctccgttggttactggatgagggattgtcttgggaagcacatgaccttgggcaaggtagctctgcagaggtaatgtctacaggagctgacagtactcccagcaagttctttcttgaagggagagctgggtgacaca

SEQ ID NO: 147729 - DNA, 195 bp, Homo sapiens
ctttcctgtgcgcaccatatgagccctcacagatgtttaccttagggcccttcactggcaacacaaagccttattaggatccgaggagaagacagccatccacgaaccaggaacagaacccaaccagacaccagatctgccagcaccttgatgttaagcttccagcctccaaaaataaatgtgtgttgtttatcc

SEQ ID NO: 147730 - DNA, 226 bp, Homo sapiens
ggctgggtgaaagcagcctttcttgctgtgtttgtgaggagtcagagtgagtcccccatgacctttggctgtgcaaggaatggcagccccacccctgcttccatcctccccacagtgtggccatttgcttagtcataaatcaggtggtgctgactctaatcacgtcagcaactgtgtgctgctgggcaggtgcaggtgtgctggggactttggtggggtgttgggc

SEQ ID NO: 147731 - DNA, 280 bp, Homo sapiens
cgcccctttacactcaggggtactggtccatctatgccatgctgagagctgctgccatgaaaagacccctggatctcaccccctccagcagctacctcttctctttctagagaaaccacctagaaggacttcctacacacaccagccccacctcctctttcctgttgtctcttaggcccaaggcccaccacagtgccctttgccccccacagtcacccctgccagggcaccggcggccagcacttgctccaccaacccttcctccagaagagcttttttg

SEQ ID NO: 147732 - DNA, 243 bp, Homo sapiens
attcacttcacagcattgttaccgtgggccaggatggggcccaagttcagttccatggaggccccttccctcttctcatgacaagtcaagactttgtttttgtacaaagcaaaggatgggccgggcgtagtgcctcatgcctgtaaccccaacgctttgggaggctgaggtgggcggatcacttgaggtcaggagttggagaccagcctagccaacatggcgaaaccccatctctaccaaaaa

SEQ ID NO: 147733 - DNA, 246 bp, Homo sapiens
acactgtgaagaataaaactttcttttatttaagggctgtattgaaaataatcagttatttttatgtaatttgaaagtaagattactctgtagtttgcagaggtgctgttcagactcctagattgaagatattaaccctgtgccctcttgcaggttctcacctttgttacctcctgagcagtggagggctggaggcctgggtaggagtgcctggtgccctcttagaagatttgatgtgtgcgtgtg

SEQ ID NO: 147734 - DNA, 242 bp, Homo sapiens
ttccatgcttcttagataatccatggatgataacatcaaaattattgggaagggtttgatttatcttctcctacctttctgttttcctctccagatgctttctgtgtttgtgtcctccaatttgagtgagggttgggagtgaaaatgtttggagttactaactaccattaatcacctttcttacacttagaatgactgtttcgtctttggtctcttacattgagtggaaaagtgttctccag

SEQ ID NO: 147735 - DNA, 207 bp, Homo sapiens
gtttacttgctctgtggctatagataaggttcttaaattctgtttcctactctgtaaattaaagactaatcctgcctgaatagatattgtttgaattcattgaggtaacatatgtaaaactcctatatcagggaggctggtatacagatacatgaaaaaattgcaataataatatgtatcagcacagaaacctatgtttcaactcaa

SEQ ID NO: 147736 - DNA, 504 bp, Homo sapiens
gcagtggaggtgtcaggatgaactcgggttgggaatagtttatatgtagatctgacacagtaatgaagtaaatatgagtgtggaagaaattaaaaaggcaagaatacatctgaggtttttacctgagaaattggaaagacagaatcatctttcctggaagggggagcctgcaggagaagcagtttcacgggggaattgggagtctgttctgaataagtcaggatgggatacctagcaagcatccaaatgaggagacgtccagggggattctggatgcaccgtcctgggactcaggagagagagacccaggatggaggtatagatctgggagttgtcagcatataactagtatttaaagccatgaggctagatgagatcaccaaggaagtccacataaataaagaagaaaagatattcagacagtgaggtaatgttcaggcacattataatcctcctcatgcccaccagatggccagagcccctttatatggatgtagggagcca

SEQ ID NO: 147737 - DNA, 487 bp, Homo sapiens
tttttataattatatttgtttttaatatctggcagacataaattctataccagagttaaaagtgatttatccgcatcattatagtattctgtatttatctgtatatatacctttatctacaagctttgcgctttcatatgcttttgtgttgctatgtcatgcccttttcatttcaactttaaaggctttcctgtatcatttcttgtaagtctagtggtcatgaacaccctacacttttatttatctacgaacatctatttctcttttgtttctgaaagacaatttttttccttttttttttttttttttgggtggggaggactgagtctcactctgtcacccaggctggagtgcaatggcgcaatcttggctcactgcaacctccacctcccaggttcaagcgattctcctgcctcagcctcccaagtagctgagattataggcgtcccctgccatgctgggctaatttttgtatttttaatatagg

SEQ ID NO: 147738 - DNA, 375 bp, Homo sapiens
gagtgaattgagcattgtattactgctctcatttttgtcttaagttgtcacaactaacagggaggctgagtactctgtccactgggagctggtggttccattgagggttgtgtgtgcctgctggtttgagttcctctgtccaacatcagaattgtttgtattcagatatgcaacaagatgggacttctcagtttcacaacgtaaggaagattgacaccaaactgagtttggggcttcctttgtacagttgaccattgaacaacaagggtttgaactgtgcaggttcactaatacatggattttcttctgcctctgccgcccctgagacagccagaccaacccctcctcctacttttcctcagcctactcaacatg

SEQ ID NO: 147739 - DNA, 106 bp, Homo sapiens
gctcctctataccgctgcttggtttcctgctcatctgtcaatgtggaaggccagaccccctgagaggaaagcaaaatctcggagtcttgctcttgttagcagctgt

SEQ ID NO: 147740 - DNA, 515 bp, Homo sapiens
gaggtctgtagtgcttggagagatattactggcttattaaaaattatatggaaagaaggcaggcggccaagtctgattgtcctcatagactgtaagcagctcccattagtcctggcaccagaacagctaaggcttttcacacgcttgtgggtgaggtacaaagtgtatacaacagattactgtatgcgaaaagaggagcggggtcttggtagaaacacatgggggctcccggtcaatgaactggcaatgacatttaccagcaggtggccttcaagaagccttgttacccaggtgaatcacctgagtcaaccagtggacaccatggtggacaaagtgctgagacccagatcaaagtccctgctttgctacatatgagctatgttatctttggccactcaccttgtttgagccactatttctttacctgaaaaatgggcatcatgatgtaagcacgacagagctaacaggagaagtcagtaatgtctgtgaataaagcatatgaaggctttatcatc

SEQ ID NO: 147741 - DNA, 337 bp, Homo sapiens
tcttaaaaagcacagctggtcatgtcactccctttgggataggagggagacaaagaacatcagaaaatcttcagtagttcccatcatacttagattaaaatctggagttttccttatggcctacaaggtcctgtaagatctagaacctggcacctgtcttctcctccagcctcagacaccactttctttcttgtgtggtgtggtgtgctctgcctcagccataccagccctcgggatgttcttcaaaccaccaagcttgattctgcctttggacctttgtccttgcttcttcctctgcagatggcatcacggctcagcctctctctcctttcaggtc

SEQ ID NO: 147742 - DNA, 364 bp, Homo sapiens
gctctccaaagcaattacaatggtaacatcaaagatgactgatcacagatcaccataacagatgtaataatttttttaagtgtgaaatactacgagaattaccagtatgtgacagagacacaaagtgagcacgtgctgttagaaattaggtgtgctgtgctttcaaacattggtaccttagaaattctagttttaacatctacctctccaatcctatttaccagtttatagtggccagtattttagttctaatttgttttaacccgtccccaaattagtttttttcccctcacagttattatttatttagacttacgaagtttatccatttcttttctcaccattacttgatcctactcattcc

SEQ ID NO: 147743 - DNA, 116 bp, Homo sapiens
tagtgtggtgtccccacctgatgtgttcagacagggtagagcactggttctcagcaagaggcgattttgccccccaacccctacaggacacttagcaatgtctggagacatttttg

SEQ ID NO: 147744 - DNA, 692 bp, Homo sapiens
gagataataactttatggcctctccttaaataggcaggagagaccatcatcttcacagtcctacaagactgagattctgaaaagaaaaatatcaggagctgaagcacttcttttccattttggttgtgtttagacgagactaatctctagacgttcgatgttgctgctgtcagctgttgctgccaggctgtgtgctttgcttcattgtctcatgcctcctccctggccaggtgcacctgctagggcttgggttgtttgctaacagacagtccatccctcgttctgaaataaccctgggttgcctggtttccctgatccaactgtgggtagcttgccctgtccccatccatcgtcactccggccctttgctccttcggctccctgggctcctggcagcctgcctgacactttgttttctttccctctgcttccatctgccccttgtggttcctggctccatcttattgcctgacctctcacttgatacctgtcttagccctcactcccctcactgttcacatatgctctgatcacacatatgctgtgatctattctttaaaataagaatcctcccattcttattttaaattcttgttatttttattttatttatttatttttgttattattattttgacatggagtctcgccactgcactccagcctggcaacagagcaagactctgtctcca

SEQ ID NO: 147745 - DNA, 183 bp, Homo sapiens
tgctgggattacaggcatgagccaccacgcccaaccccacactgctaaatctaaaggttattctatatctcatttttctcaaattcacagcagcattcagttgacttatcatttcttattaaagcattttttttttcttggaggcttttctcctatcttacttgaaacttctacattttcttt

SEQ ID NO: 147746 - DNA, 420 bp, Homo sapiens
gcctcccaggttccagtgattctcctgcctcagcctcccgagtagctgggattacaggcgcccaccactacgtccggctaatttttgtatttttgatagagacagggtttcaccatgttgaccaggctggtctcgaactcctgtcctcaggtgattcacccacctcagcctcccagagtgctgagatgacaggcatgagccaccgtgcttggctgcttttcttttctttcagttgcaagtgctttcttgcacatgctgttctctctgtgccaaattccctggactccttcccctaaagcccatttgtttagcctcagatcaaacatcactttcttggagaagcccttcccccattctggattaagctgtccagctttatgctgttacagcagcttaactttttatcacagcacttctctc

SEQ ID NO: 147747 - DNA, 286 bp, Homo sapiens
cccagaggaatcattttactgtgaggcaaactgtcagtcaggtacacagaaacagtgctggagaatggatgacacgtggtgagcattgaagagttaggtcaagaagagatctcaagaaactaaaagtaacaaaggcttcccctaaaccagcctttcttatagttttcagccaagttcagcttcaaactactctaataggagagactaactttagggtaggtcctaggaacatacccttggctgaagccatcttttcctggaaagttgctgcctcacagctttcaaa

SEQ ID NO: 147748 - DNA, 274 bp, Homo sapiens
gagccccttgagggcagggatgttgtgggatcccagagccttcctggtgtggagctaggttcctgggagatattcactaaccaggctgcctgggaataaccctgtccaagcaacagagcccagccctagcctcagggagaaggggtggcctcccagcacccttagccccagctgaggactttgtacacacagccagggttgctggctgatacactggccgtgagtgacctcagtccccctcaaggctaccaaagggccagctggcatcgtgcag

SEQ ID NO: 147749 - DNA, 426 bp, Homo sapiens
cactgaacaggggatgggattgtgtgtgttagaggggctgctttggtgggtagccagagaagcctcttttgaggaggagatggtcatatggcagaggcaggactgaggagaaagtgagggccacacaggatttgggccagaaagccgcaggcagaggagcagctggtgcagggtgggaacagggtgacctggcctttgggcgaattggggatggtgggtgactggccgccttgtttctgttttcatcgccttgttactgctttttctaaatggttcctcccacacagacatcttttacttgcagcttctgctatggaaggttttgtccactgctgacaggctgtggggagttccatccttgagtatgtttggggctttattttcagtctgtgtttttgaaacttgagccctgacttcctcttgttc

SEQ ID NO: 147750 - DNA, 306 bp, Homo sapiens
ctattaagtccaattggtcaagtgtttactttaagttcagaatttctttcgaagcctgtattagtttagttttatgtcttagtttaatgttgctattgtaatagactaccacagactttatagcttagaacaacatgaatttattctactgttctgcagctcagaagtctaaaatgggtctgcagggctgtgtttcttctggaggctcaaggggagactgcttcctgactcatgccctgtcctccatctgcaaagtacatcactctgacccctgcttgcgtcatatctcctgtgactctgactcct

SEQ ID NO: 147751 - DNA, 371 bp, Homo sapiens
tatctggcatgtaacaaatatttgttgaataattaatggaatcatttactattgggggtttctgatagagaatactagttgatttgtgatactgtaaaacactttcagagactttaagagtgccgtgactaactcttagagtctgaactaaaagttgtgttaataaatatctggttctttcattttatttgaagttaaacagcataaagcagtgtgaggaaaacaatagttgcactgctgagttaaagagggtcggtggggagagcttaaaggagtctgattctaatcacaaaagattgtgaagtatttgtcctgactcctattttgagcttggctgtgggctaatgtgcaagccttccctggacacagag

SEQ ID NO: 147752 - DNA, 134 bp, Homo sapiens
ttaaaaacattagatgggcaataactcacagcatctgttcacatcttaaccacaaaaatgacaaacgacttgagataaatggacaaagcaagtcttacaagagttattcacagatttttttttttttttttttg

SEQ ID NO: 147753 - DNA, 460 bp, Homo sapiens
agttcgacggagactctccagtctccgtctgagggtagaagcctggctaccagtgtcttaggaaacagctggaagaattactatgtagacatagaaatgaatgaatcaccaagtagacattcattgaaccttttaacctttaaccttctgctggggtgagggagagccagagtgaagaggaagctctttataaagactttcaaccaatcttgtttctggttctatcctgaccctccagcttcagaagtaactggatgcatccagttttgagcattacaagatttctgcagcatgaatcagctggcttcttatggttctctacccagcctgattttctgcagtccctaggtttgttaccagctgacctttgctttctaaaatcttgatttcattatttgtctactgttgcttcctctctaactctctgtgtgtgtgtatgtgtgcacacacagagagtctt

SEQ ID NO: 147754 - DNA, 236 bp, Homo sapiens
tcttcctgctataccctacactttgcccatgggagctgagccccagcgagggagggaggcacagaggaagccccttcggcgggaagcaggtgttgtgaggccgtgaggagtcctatgtcccaaggcgggagggaggcaactggagcttttcaactcgaagggctgagcaggtggcccctctgcagctgctttctctgcctccatagcactgatacaactcccggccacccctccac

SEQ ID NO: 147755 - DNA, 547 bp, Homo sapiens
cagctactcgggagtctgaggcaggagaattgcttgaacctgggaggcagaggttgcggtgagctgagatcgagccattgcactccagcctgggcaacaagagcgaaactgtctcaaaaaaataataaataatagccttgcttatgctaatatgattaatttacatttcttagtacagttttgtagttaaagtaaactcctcatgataggctgtgagaagataatcttggattcagaagtttgtctaaaaattcatggaggatgaacttcctttgtgctggtaagagctggctgtagggcagttgtttccaagttgttcctctggccagtagtatcggtaccacctggtaatttgttagaaagagattcttatccctactacaaatgtgctgaataagaaactgggtcttgggcccagcagtttgtttaacacgtccttcagctgattttgatgcgtggtaaagttttagaccattactatggggtattataataaaagagacccctttcttgatttctagtgaatggcgtttgggacagtaattga

SEQ ID NO: 147756 - DNA, 1112 bp, Homo sapiens
tgttttgatatgtttagatacacaaataattaccatgtgttagaattgcctaagtattcagtacaggaacatgctctacaggtttgtagactgctatgtaccatatagcctagctatgtagtaggctatatacatctaggtttgtgtaagtatactatatgattatacagtgacacaattttcagaacctactcttgtcattaagcaatgcatgaccatattttttattactcaaaacattgcttactataaacaatgtctgcattttgctctcttcatatatcctatagatctctcaagtatgtgaagaagttcatcctttttctttttttaaacaattaaacagacttcttaattaattttcagaatactgtgacagtcccatttggacttgaatgaggtgggtttaaagtaagtaccgtaaatcctcacttaacattgttgataggttcttggaaattgtaactttaagtgagatgacgtatgaggaaatcagttctaccataggctaattgatatgagtaagttgagttcctacagcatatctctgatcacaaaaatacccccagacttctagataaagactaaaaacaaatgtgagttatagatacatttaagaaagattaataaaaacaaataagataatgatttatgcagttattccaattcagggttgtgggtggctgaaatctatcccatcagctcagtagcaaagtggggaccaaccctgacaggttgctattccattgcagggtgcattgcaaccacacacacacccatagtcgttcagactgagatcatttagacaagctaagtaacctaacatacacatctttgggatgtgggaggaaattgaagtgcccagagaaaacccacacagacttggggagaatgtgcagactctacacagaacagtaaccccaactgggaataatttttttttccttctcagtgttttaacgaaacaatgtcgaacaaaagatgttatttgaggatctgctgtgtaaaaggaatcttgtgtagagatataataaacctctgaaatttttaactctagggatgtttttcaaaatcaatttatagcagtttatgaaaacatgcaaaaaaaaaaa

SEQ ID NO: 147757 - DNA, 364 bp, Homo sapiens
tcatctaaatccaactcaaatgacctcaaatggccatttctctccttcccccactgaacttctgtcagagcactgggccaacagagagtctgtcacacaaaataaagccttagttttctttacccaataaccaggtcatatcctctccctaaacattatacaagcttgcctttcaacaggatagtgtttgattttgacacatttgagcttgacgttcttttctcatagaagtatcagtacgatgcctccgtggtgaaaatgcagtcgaagaatgatttttcagcccgtgtggaaggtgagtgggatgggaagagaggggtgatggatcggccagctggaaggcagtgtcagcaattcagacatg

SEQ ID NO: 147758 - DNA, 994 bp, Homo sapiens
gtatgatttttttaaaaaaacctcagtaaactaagaatagaaggaaactccctgagtctgataaatgaacatctatgaaaaacctacactagacgttgtacttttgatggcgaaatattgagcattttatccctaaaatcaagaacaaggatgacacccattctcactcttctgtccaacattatactcaaagtcccagccactgcaataaggtaagaaaaaaggcaaattgaagtcacaaggattagaaaggaagaagtaaactgtatttatttgtagatgacatgattatttatgcagagggtcctaagaaagctacagagaattgctagaactattaagtgaatttagcaagatttcagatatcaaggctaaggtgcaaagtttatcgttatatagtagcagcaaactatcggaacatgaaatcagaaattacattctatttgtaataacaaaaagtaaaatcttagtaattatcttaacaaaagatatacaagacctgttcactgaaaactataaacactgctgagataaattgaagaagatgcggagggatgaagagagacagcatgtccgtgatgaaaagactcaatcctgttaaaacatcggctctgccagtcaaaatcgcagcaggcttttttgtaggaattgacacaatgagtctaaaatggaaacacatgtgacctggaattgccaaagcaattaatcaaagtggagctgatacgtgccctgatttcaaagtttctattctacttacagcttcagtaatccagtcagccgcagtgtccctgaagaatagacacacaggtgagtggaacagaatagaaagactggaaatagaccccacctctatagtccattgattttcaatgaagatgtcaacgtaattccacatggaaagaaaagtctttttagcaactgtttatacataaggaaagaaatgacgcttgacctgcatttcaccatacacaaaggtgactcagaatgcaaaagc

SEQ ID NO: 147759 - DNA, 598 bp, Homo sapiens
cagcgtgcgcctgtagtcccagctacttgggaggctgaggcagagaactgcttgaacccgggaggtgaagggtgcagtgagccgagattataccactggacttccagcctgggtgacagagcaagactctgtctccaaatatatatatatgaacgtaaatattaaatcttggggggtgtctgttggatcattttgaataaaagtaaattaatagttgaaaaatgttgctattagagaaccatagaagtagatgaaaaaatctgggagcctggaggagctgtgcaggaatgatcccagccagcagctgctacccaggtttgaggccacctgtgggaatggaagactgtggaatctttatggtgcgacgtagatatgttggtgccttgtgcatagctgattcaagaggccacaagatgatttcatggacagtgaaaagagcctcctaagcctttttagaattattcactcagtgttttgtgtcgtttctacttaattgtatatgcctagtcaacagtcaaactaatcattaaatttattaaaagtaactaacataacctataactatacttcaaatatgtataatagtttcatagtcttc

SEQ ID NO: 147760 - DNA, 555 bp, Homo sapiens
cagcgtgcgcctgtagtcccagctacttgggaggctgaggcagagaactgcttgaacccgggaggtgaagggtgcagtgagccgagattataccactggacttccagcctgggtgacagagcaagactctgtctccaaatatatatatatgaacgtaaatattaaatcttggggggtgtctgttggatcattttgaataaaagtaaattaatagttgaaaaatgttgctattagagaaccatagaagtagatgaaaaaatctgggagcccaggtttgaggccacctgtgggaatggaagactgtggaatctttatggtgcgacgtagatatgttggtgccttgtgcatagctgattcaagaggccacaagatgatttcatggacagtgaaaagagcctcctaagcctttttagaattattcactcagtgttttgtgtcgtttctacttaattgtatatgcctagtcaacagtcaaactaatcattaaatttattaaaagtaactaacataacctataactatacttcaaatatgtataatagtttcatagtcttc

SEQ ID NO: 147761 - DNA, 271 bp, Homo sapiens
tccagggcccattccctgcttcctctcatgccattgccttctcttcctaaccaagcacgccccatcataggtcagtgaagaccccgatgtcaatctctcctctctccccattcactcaccctttagaggggtcatctcaggcccaggatgatgtttctttctctcataatcgcatggctcccttgaagaagactgagcacaaagcaggtattccaaaaagcttgaggaaagtaccggggtgaaatgtgctggagtgagactaaatgagatg

SEQ ID NO: 147762 - DNA, 402 bp, Homo sapiens
caggcttcctttgctcaatattatgtaggtaggatccattacattgctgcaggtagctgttaatcattcattctcatggctgcctggtattcaactattcaaatatttcacagcttattcactcattctattgttggtggacatttgtgttgtttccagtttgggattactatacgtcagtgttgctatgaacaatctcatgtgtctctttatgtaaacatttatgtagggcatatacataggagtggaattgttgtgtcttgggttatcatgtgttcagctttagcagactctgcaaaacagtgtccaaagtggttccacctgcaggcactgcatggctgccctgggtgccccatctcacctccaacacttgctattgaaacttctaaaaggggatcctct

SEQ ID NO: 147763 - DNA, 605 bp, Homo sapiens
tgtttccttctttttaattttttggaaagatttgaggataattgttgttagttcatgtatcaatgtttggtagaatttactagtgaagccatggttccagatttttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgattggtttgttgagtatccgttcgttacaataataaatttcacttgccatatatatcaactttatatgctataaattacttggataccttccag

SEQ ID NO: 147764 - DNA, 539 bp, Homo sapiens
tgtttccttctttttaattttttggaaagatttgaggataattgttgttagttcatgtatcaatgtttggtagaatttactagtgaagccatggttccagatttttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgactttgctcttcgttgatatcccctcct

SEQ ID NO: 147765 - DNA, 484 bp, Homo sapiens
aggatcctttcacttcagaatattcaaatggaaaaggttcatattaggaatagctcctccaacaaaagaaattgctgtttctaagcactgatagcatgagaccaaaactcaatagcaattctccactaaagaaaattttttaaaaataaagcactaacacaatgagcacttatccattccatttccaaaaacaacttaccttctgcaccttccttttgcagatttgaaatccagattctcacacaatcactggccatctcttctgtttcattcaacagcatacacaccagagtgtctcttactattatatacatcagtagaggccgggcgaggtggctcatgcctgtaatctcagcactttgggaggccaaggtgggtggatcacctgaggtcaggagtttgagaccaacctgaccaacatggtgaaaccccatctctactaaaaatacaaaattagccaggcgtggtggcacatgcctgtaat

SEQ ID NO: 147766 - DNA, 323 bp, Homo sapiens
ggtcgcaaaatgactgaggaggaggggcttactacttggaagaaagctatgaccgtgtgatgaatcacctgagagacataattcagtccactattgtgtcaaactaggaagtgcctaaaacactgaagaaaggaaggggaacataaggggttaggtacaaatcattttcatttccagaagtgcctctaaattaaggtaaatttgggacttttttctccttttgttagaagacagttattttttaaagagccctgacttgcacagaatttttatcctgaaccaattcagtcctgtttctttcagggatggagagagggaaggat

SEQ ID NO: 147767 - DNA, 478 bp, Homo sapiens
agtggcataatggctctgtgcctcagtttcctcatgttaaaatggagacaataaaaatacctacttatcagggcttttgagggggggttcttttgtcactttcttagaatctagtgatgatgacagtgaacctgaccaatacctaattcattcttctgttcagctgcacatgtccacagggaaaagaaatggttttcattaagataaaggtgaaaaatatatttgtaaatagattaatacttctgaagcagtggaaatagcacatctattgtgtttttcatttctttatttgaagaccatttaaaattattttgatactatgctggctgaactataatttttggaaatgctctttattttaaatttaattttaatcagtgttaatttttgtgtatttttttacagtaaagaaatgttctttttttcccattgaaactccatctttgttaagaagcaacaatttcctgcactggcaatg

SEQ ID NO: 147768 - DNA, 1050 bp, Homo sapiens
ctgccatgtaaaagacatgcctttcaccttccaccatgattgtgaggcctccccaggaacctggaactcctatactcttcctgcattttcagtgacctcactgactggaaactgggcacctcgttccttctcacaagtgtcataatacaccatgaggtggttgggtcccatttccagaacaaccagagtgacgtctgaacaatgctctctaaacaagatcttcatgtctgctcccaaagagggttgctacattcttagcttccctcaatttaattcttttatgataaaaagaagggtgaacagaaaatgttcagagcaatcatcctctgaaaattcatataaatgacagcagaaatacaagaaggagattggatttcaatcctcttggaaacaattgatttggaagtggtctgtggtctaaagattttgacaaaattttaggagcaagtaaagatgatataaatatataaagagacagaacagaagggagatagccacatttcagaaaacatggagaaattatacaagtgattcttcccaggaaattcttcagaaatgtccaaagaaaaaattatggacttacaaatctgactgtgcgatgactgcaaaatcctcctttatcttcctctccctgacatgcatgcaaacacacacacacacacacacacacacacacaccctgagatttgcatcatttgtctttaggctaaaataagggaaaacatttcaaaatgatttaccgatttttttaaatgatgggcacagtaaccataattaagtcttccgtatttggcattggaatgaaggtaacgggatcaaacccttctatttacttctccttactcatccaaagatgcagtcaaccatcaacaaacacttccctagtatactgcccacaaagtcagctcgtaaattcagggaaaatagtttataagggtctcaaggctgtttaaaaacaccaacaccataagagagatggagtaggtggaaaaaatacacaaagaaagtgcaacgaacagaaacaactaaaataaacaaggaacattcagc

SEQ ID NO: 147769 - DNA, 340 bp, Homo sapiens
tctcagataccgatgctgaaagagaaacagcagcctgtccccaagtggcaggaaatagtccattttaatggcaatttcataagtggcagatgatttttattgtaattttctggtgagctgattaagtggaggcagagtcagttctgaggcgtcaatgtctttaacaattcggggagacggaggccacgctcagcaggaacactgagtccatggaaaacaggccctgggcccgctgatgtgcataattccacgtttgcccctcatgtaaccaggatggtaaattacaggtgtcagataatcacgctctggagtggctacttgaggatgcgatcgaccaatt

SEQ ID NO: 147770 - DNA, 186 bp, Homo sapiens
cgggatattttatgaattgagaaaagttgatactaaagtccatgtgatgaagtcagaatgtaggagtagctggggaagaattggaaaaatccccactaaacgttagaacacgctacaaaacctctacagttaaaaaagtatggtactggcacatgaataggcaaatagatgagtagaataagctgg

SEQ ID NO: 147771 - DNA, 165 bp, Homo sapiens
tataatgactagaaatatattggctcacagttctggaggttgggaagtttggtatcaatgtgccagcatctggcaagggccttcttaccatgtcatcacatggtgggaggtggatgtccattcttgccacttctcctgaaaattgtactggaggtcctagaaagt

SEQ ID NO: 147772 - DNA, 359 bp, Homo sapiens
aatccattttgctgccattgtatgggttggggaagcaatgctgttgctcattgtataatgaggccacagcacatgactgcttcaagaaaacctgggaggtcaggaagcattgtaattaaaatatcaacataacacaaggaaaggggcaagccacaatgaagctctcaatagcacatttttttctaagaaatgctgacatcccttaaggagaaagggattggccttggcaagcagcaagcgaagagctgctgatctgaagctctgcttggggaaggaaggatgggaggagacacatgaactctaaagaagctactttagcattttcctttgcccatcctggggccaggtcagaaaaccag

SEQ ID NO: 147773 - DNA, 262 bp, Homo sapiens
gtttcccatagtatggatagtgttgactgcaaccctgcactgtcatttaacgtaagctacagtctactcttaacagacttttgttattaataatttcctcttactaaagaataagaagaacctattccctttgtagaaaatgaggacaagtataaaagaagaaaatttaaaagtcatccataagcccactaaccagaggtagccgctactgtcacttcaagtattttgctcagatacatctctgtcctgcttattttcattt

SEQ ID NO: 147774 - DNA, 581 bp, Homo sapiens
tcgagctggtaccagttcgacggagactctctaaacaagaaaacttgtgctgacctcagggcctttgcacatgctgttcctgctgctggaaacactgttcccaggctctcggtaccgacaggatcccttcaggacttggtgtaaatgctacttcctcagcaaggccttccacactgcttcacctcagtttagtctgtctcctctcttttctcctcctggcacctaggacaatctctcattggtctgagaactccacaactccatctgtccgtctctcttttcaccactagagcctggcctggtgcctggcacacagtatagattatggaataaacaaataagcctgtgacatgggctggcaccactggcatacacacacacactctcatatacaccctcacacagttggcacagcacagaacagagtaacatcaaatcctgactgcctgggttcaaatctcacctttcccctaaacagcatttggtaagttacctgcaaattttaaagctgtgatattgtttggtttgtcaagttcttagtatggtgagggtgtatatgagagtctccgtcgaactgggga

SEQ ID NO: 147775 - DNA, 544 bp, Homo sapiens
catcgtgcaactcagcgaactgtggacatagctagtccctggtaggagtgaataactgatccgctgggctctcggtaccgacaggatcccttcaggacttggtgtaaatgctacttcctcagcaaggccttccacactgcttcacctcagtttagtctgtctcctctcttttctcctcctggcacctaggacaatctctcattggtctgagaactccacaactccatctgtccgtctctcttttcaccactagagcctggcctggtgcctggcacacagtatagattatggaataaacaaataagcctgtgacatgggctggcaccactggcatacacacacacactctcatatacaccctcacacagttggcacagcacagaacagagtaacatcaaatcctgactgcctgggttcaaatctcacctttcccctaaacagcatttggtaagttacctgcaaattttaaagctgtgatattgtttggtttgtcaagttcttagtatggtgagggtgtatatgagagtctccgtcgaactgggga

SEQ ID NO: 147776 - DNA, 308 bp, Homo sapiens
aggccggcccgcatcaggcgcacttctcagagaaacagcaagtcctgagccttttgtagtggtggtagacagaggccaggcagggaggttagtccaagcttcctgcagccttccctacccacaagctacctggtcctctagaaccataaccgcagtggcatctgcagttactttttttttttttttttttttcagttgaaccaatttcttaaggtttgctctaattctaacattatgatcatatgaattcaatatccatgatctatctgttctcttagaggctataaatcaattttttgtgctgtcat

SEQ ID NO: 147777 - DNA, 195 bp, Homo sapiens
agggcgctctcttgcagatgtaaaagtggaggaagagagaataatgcgcgctgggagaggataacaactcaggcaacgggagagagcagttggggaagaggctgagcccaccacttaacttctctggtaagaagaaagtgtgaggccaggcgtggtggctcatgcctgtaatcccagcactttgggaggccgacg

SEQ ID NO: 147778 - DNA, 396 bp, Homo sapiens
aaaagaaaacagaagcgaaactaaaggcttgtagcccggtgcctaggaaccagacccgaaaccaaggaaccagacctgcaaccaggcctgagcctgcctgacctaagcctggtagttaaagattgacccctgacctaaccagttatgttatctatagatttcagacattgtatagaaaagacattgtgaaacttcctggtctgttctgtttcactccgaccaccggtgcatgcagcctctgtcatgtaccccctgcttgctcaatcaatcacaaccctctcatgcagacccccttagagttgtgagcccttaaaagggacaggaattgctcactcggggagctcagcgcttgagagacaggagtcttgctgatgttcccggccgaataaacccctt

SEQ ID NO: 147779 - DNA, 388 bp, Homo sapiens
acgtagtttctatttgggaagatgaagaagtcgtggagatggatggtggtcataggtgcacagcaatgtgaatgtactcaataccaacgaattacacatttttaagtgcttagcatgataaattttatgttacgtatattttaccacaataaaaaagtatcattaaaaagcacgtgctttttgtagtctgctccataatttatagttgttttaatacaaaaatttattttctccaaatcttccagaaaaaaaatacatattatacacatcctgttgctgcaaactgcctcccccactattgtgagaagcgcagactagttcaatccacccttcttcctattttatatctgagaacctcagataggaaatgacttgcttgaggtcactc

SEQ ID NO: 147780 - DNA, 593 bp, Homo sapiens
aagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaa

SEQ ID NO: 147781 - DNA, 202 bp, Homo sapiens
gcacctttgacaactggctacgcgaccctgggagagtcacctcacctcttaaggatcggacttctcttccagaaggttacatcagcaggcccaagaagctctcactctccaagccccctggccattctaaacacaattctatgaaatgtaatcctgagtatgttcacaggaagacaggctctgagctgacagagtgacattc

SEQ ID NO: 147782 - DNA, 337 bp, Homo sapiens
cagtttctcacacatagaagtgtttgatatttgttaatagaagaaatcactgtttcaacaaacagcttttctatgaaccacaactcctactcacagcattattgaaacattaaagatccactcaagccacaagaatactatgagattggaatttttgctttttgcaaaagtgacctcatcaaaacgaggacggcaaaagatacagaaggtttctttcactttttaccgcagtatctatcccacagttgatattttcccaagtgttgcctgcagactttttccacatggaatttggtaccaagttctttgtacaaaaagtaggccagctgcttcacag

SEQ ID NO: 147783 - DNA, 886 bp, Homo sapiens
cgcacctccacacctggctcatgttttgtagagatgaggtctcactatgttgcccaggctggtctggatctcccaggctcaagcaatctgcctgccttagcctcccaaagtgctgggattacaggcgtgagccaccatgtctggcctgtgtattgttgacttccccataggactgagtttcttgaaggcaggcatttatcttacccgctttgtatccctagaacagtttctgaccagttgtgtagtagtaggcagtgtgtaaatgttttaaataaatgaacaaatgttaccttctattctcttttattctttttatgtgctatgctttgtctttctagttagaaactgaaatgtaagtcctttgagtacagagatcatgaattacgaaggtgtatatggtatatttgcttggttgtcttcatgggagcatttcaccatcctctgaatgtcgatttgtgctttctttttcccccaaaccaccttattgaggtatgactgacatactaaaagctttaggtatttaacatataccactcgatgtgtttggagattttctttaaaaaaaaaaaaaaaaaactatgtttagatattgttatggattttcaggttgggtcattaatgaagtttgacagttttaataagactgactttctttgtggtttataaacaggctccgaaagcagcttcaaaagtagagctccaaaatagttccataattattgtaattaatgcaagtcttccagaattcgggcagagttggagagtctctgaattaggagtcaaaagtcctggattcatttgtattgctgacatttgcttgagtgcatactgggtgccaagcgcaggaatgactgaaaattcaaaaactacagtatggaaaaaaaaa

SEQ ID NO: 147784 - DNA, 349 bp, Homo sapiens
agcaggctgtaggaagagtgtgcagaagctgcaggaagagtgggtcctgctcactgccgtctcttttttttgttgttatcttgcactccccatgccaggggacatgggaggtggagaatcctcgtgaagtgcgtggggacagttgaccatcctccactcctcccagtctacccccagagcctctctctctacaggtttgcctggctcttaatttgaggacccgtctctgcagaggccccttggtgataaactcagggtcacgagtcagttctcatagggatgttcactctccagactcacacccactggctgcccttgcagacctgctgggtgccacagaaccagggca

SEQ ID NO: 147785 - DNA, 277 bp, Homo sapiens
taaaagtattttttcagctgtgtcttctgaccttggaagggtcaagggcgaaaatatctgatacctaaatattcttaggagatctagaagtcttcataaaaagcttttaaaacagcgttattgatgcatattttacatagcataaagttcaccattttgaatgtgcaattcaacgaattttagtaaatttaccaagctttgcaaccatcaccataaatcagttttagaacattttcatcacctagtaagatctgtcatgctgatttacaatcaaacg

SEQ ID NO: 147786 - DNA, 397 bp, Homo sapiens
cctgattggatgcagggaccccaccgccatcactgggcctcagttggtcactcctgatcatgggctgaattctctcctgcttcagctgctcctcaggcgagagtgctgcccctgcacaccctactttgggcagtgctgggcatgctcagattcgcgcccgtccagttatggcccgtccagacttctccctctggcagggcgggcattcacctgtggcagggcactcgcctccttcctctgaatacccttccatttctgtggcaggtctgcacagacccagccctgacttcatttcaagttcctgttcctgcttatatccgtccatcatccatgcttgtttttgccatacagttcttgatttcctacctgacagccacacagccagcgtcctgtgctt

SEQ ID NO: 147787 - DNA, 755 bp, Homo sapiens
tgaggcaatcacagttacagaaaagctggaagaagagtacaaagaacttcctcctgaatcacttaagagtcagtcgccgactggacttccctgcacccagaacagtccatgtgtgtttcctagagaaaatggtgtcccctccagaaccagggtgtcattgagactggccatgaccgacagcccctcccacgtgggccccggtctcagcagtgcctctccctgtaggaaagtctgcgtccctatcccggctgcctgcagctgccacaccttgtccagctccttgggctggaaggttcctcagcctctcctgactcccgagccagccctgacacgtgggaggcagcaggccagctgtgcacaggacgtcctcattcccaattcagcactctggggtcattctaattttctcttgtggtcttggtaactccattctccgcctataagaaaccgggcctccatgcactttaagatatttatggagctgctcaacccctacctgctgtgacccgccctcagctccacctccccgcctgctcccagagctccccattctttagcgggtctctgttctccgactggctgagttcccgtgccgggccacctctccatgggacaccctccccttgatacccttcctgtaaatatattttacaggacagctgattttgagatggttttagatttgtggacaaggtgcaaaggcatccctgcggacttcctccccagtgcccccgcagccgtgcctgtgcggccgc

SEQ ID NO: 147788 - DNA, 489 bp, Homo sapiens
tggatcaagggtactctctgcataaatcactaaagctgggatatgaattcagtctcgcccatctctcaaaaggccttcctatgaataggcatgccctaattcatctccaccatgagaactggaaacaatggggaatgagtgtatgtgtgttcactgcacatagaagcgtggatgcaggtatttgaggaaatagaggacaataaatatcccacatttccaaagagctgctaagaaagaaagcataccctaaaaggggagaagtgatattaggctataaaagttcaaattacttctttagataaggaacaagtctgtggttctgaattggagaggctgtttatacagtgaagtgataatgaggtctaagaaaactgcccaactgggccacaactccaggtgtaccattcacactatagtctaagaagcaggggcctacaggatgacagctaggtgtagaaaccctgcgcatgtcaaaatgaaccacataga

SEQ ID NO: 147789 - DNA, 162 bp, Homo sapiens
tcaaaggcttcttgccttttcaatctttaattcctttgtctttcttcctgcagaattatgaggcctccattttttaactttatcacacttacatatatttattaatccgtgggtgagaaatcatgctgagcaaatgtatcccacctccatccatcctctcct

SEQ ID NO: 147790 - DNA, 600 bp, Homo sapiens
tgcatctctgcacttccaggaccagtcttaagtttggtcacaggccttggaagaacagtggtacccactgtgcttcgtggtggcgccaccagttgccagccaattagtaggtatacagttggcaattaataaatgtttgttgcatgaatttagggcttctctgtgtatccatgcatccaacaactaagtacctacaatagtctcataagagtttgcaaattttagaggagctgtaaaatcacttctaacactatattagcttaaaaagtagcaggatgtttatatacagacaccctctcactttcaaaggcaacagttgtgacgtccaggttttccatttctcttatatgaggttggacatggtgtttctgagggcgttaccagagcttgaaatggcttggtgggggtaagcagaagggctcaaaaccaacttttatcaaggtagatcatattagagattctaaataagacatgcctcattctcaggtatttctaaggagaaaagataactcaatctacaaataaaccaaacagctgtaggatgtttttccagagactatactggcaaggcagattaagactggacacaactcccaaata

SEQ ID NO: 147791 - DNA, 239 bp, Homo sapiens
tcttgactgtaactggactacagtccattcattcagggcacacatactcaccccaccaagtcacctattcccattgaaagttctacaaggccaatcaggatacagaaatatagcctagagacacataccaaggactctaagaaagtttgttagttttatctgtgataattaaacttattatcagctattaaaactattgattcttgattgtgtttaagaacaaagtaattactaatatc

SEQ ID NO: 147792 - DNA, 523 bp, Homo sapiens
ccattctctaaaattcaggatatactcagtctcatttcatatacttatcctacctagggataatctaaattccaggcagcttacttatccctctaaaattgaggagaaggccagcctggtctacagcaatcctccatcatctactgacctctatcaagatgcacattcctcaccaacctttgatggctggcactgacctctggtgtattgtctaccctttgatcaccaggttgatgccagtcatacactgtcttcatcataccaattatgccaggtgaagtcttccagcttactcaccattcctttttcacctctctcacttagactctaggcaactttgctgtgctttttcatgtaccatactggatgggcagaaatctgtgagagcttacccctctactgatatccttctattcaacaagcttctctgggggcgtgggttcacaccaggccaccccaagaaagcaaagcacaggtgttgttcagcccaaacttatcagaaacagagagaaagtgggtctat

SEQ ID NO: 147793 - DNA, 285 bp, Homo sapiens
aagagtatgtgataagctaagaggtcaagtatgaaaactccctgggaacccctcaattactttacatgaattttttttcatgaaatagtatttgttatttgcaaagataacttctcgctttatctatatgttacgtttttagctcttaatagtagaaaagggttagtgagagccctttgtctatccatttagtataaggcttgcataatgtatttaaagcattgttcttaaggtctgcatatagtaaatggcttttcaaactttttgtgaaaatctttctaattt

SEQ ID NO: 147794 - DNA, 412 bp, Homo sapiens
gaaaaaccagggtgttttcacactcacactcaagcatgatcccacttacacacacaggttttccccactcacacgtggtaatccggtctcacagagacacacacaagagcatccattgtcatttgtgctctggccaaggtccccaagaccctcctcctggccacacacacacacaggggtgcacaggtgaacacgccaccaacgcccacagctgcaaagattccagggcgcacagacacggtgggaggagagtgagaggaggggaagcagatggggccgggggactcaggagggaacggccccgccctgaccactgcccgtgtccacccctgcagggatcccaggtgccgtctacattgcctgtgcagggcctggctagagatcccttcccagtcctggagaaaacgtagaa

SEQ ID NO: 147795 - DNA, 308 bp, Homo sapiens
gagggactgagaataggtcctaaaacccagagtcactgaagggcctcacccccacccagcacgatccgggttgcctctcagggagcgatgtggggaaccatgagtggagggcctaactgggtgagactggaaggggagagaccttaactaaactagagatggcacagagcccgcagctgagtgggaaagcagggcccaggggagttgctggttggttgactggtgttggtgggtgaggagagatgtccagagtgttaaaggtgtctgggtggatggtgcagccattacatggcacagtttacaatatt

SEQ ID NO: 147796 - DNA, 287 bp, Homo sapiens
tatccagttgctaaaaagcaaaaaatcttccaaatacatcaatatctaatttaaagaaaagaatgtatttacaataccaaatttacaaagctagtaaaataaataaaagagaaaatgtgcaaaacaaaatgtagaaaactacaaattttatttaatgatatgaaaacttaattggataatcaagggattttgcatgtgctggataggaagatttattatgacatcagttcttactaaatcaaaaagttaaatgtaacaataaaaatgattttggctgggcgcagtgg

SEQ ID NO: 147797 - DNA, 554 bp, Homo sapiens
  misc_feature (537)..(537): n is a, c, g, or t
ggctcggcccggttgacggagactctctacttagaaccctcccataagccgaacccaatctgccttttcaccatcttcccatcttcctactgcctccatagttattcttcgggatctagctaagtaaactctaagttattctcccatgttttcctagcacctaacatatcagttccccctccacccccattttcttccacatacggaggctcaataaataatagttaaatgaggctgggtgtggtggcacatgtctgtaatcctggcactttgggaggccgaggcaggaggatcgcttgagcccaggagttcaagaccagcctaggcaatatagtgagacccatatctctacaggaaaacaaaaagaaaaacaacaacaaaaaaaaaacagctggcctgccgtcccagcaactcagaagcctgatggtgggagaatcgcttgagcccggggaggtaaagccttcagtaagccatgtaagccatgatcgcaaccctgtactctctgtactctaacctgggtgaccgagctagagtacngagagtctccgtgaact

SEQ ID NO: 147798 - DNA, 525 bp, Homo sapiens
aaggaacccagactccttggggaaataaatggctgactgcaggtctggggcaggaaatgcacaagataagcctataacattttatcgcaccagaaaacagagaagctatcaaagatcacggggccttgtcagaagggcaaagaaaacatccagaatgggctcctagtagcctaagatgagaaaatttgagcatcaaaaagaataataactgcattggattcaaaccgattaaatatagtaatgtttcattttattcataataatactttaaaaatcactgatctcctttaaaggatgttaagggaaaaattcatcattattctgacaactgatagagaaaatgcaaacagatttttggtttgagtagaaaagccatatgattaatggctaaatgctagaagggcatttgataaaattctattcattcctgatgaaatctctcaataaacaagaaaagaaagaaattctgttaacatgataactggtatctgtcagaaagcaatagctaatatactaaaaatgaaa

SEQ ID NO: 147799 - DNA, 295 bp, Homo sapiens
ttcctgctgtgtctcctacactggctccttatcctcccctgggccctcactttcaagtttcagatggaaatttccaactgtctgctgggcatctccacttagcctgaaaccatccaacatgtatatggttgactattaattatgacctatttcatttgtgtcttctccagctattaagcccttatgagtaccccacacgcatctgggcatatagcagtattctaaagatgcctgcagaatgaaccatcattcataatatcccagtgctttggcatggacaaatttagcatcagag

SEQ ID NO: 147800 - DNA, 280 bp, Homo sapiens
caatgggaatttgggtagggcttacgaattgtgcttgtcactatcatgtgccctggggaggccctatgttgggatacctccaggatcactttatttaggtgtttcaggccgcttggattccccagagaagcctctttaaatgttccaatctcctggtaatgctcagggagcccagtgggagaatagagctggactcagcatctaacattcaatagcagtagtcacttaaacccttatttttggtacagtactcacatcctcaactatgcctggtttcctc

SEQ ID NO: 147801 - DNA, 389 bp, Homo sapiens
accaataggggcttgtgtgtgtgtgcacgtgtgcacgtgtgtgtacatagacagatttttaggaactggatcatgccattgtgggggctggcaagtgtgatgtcttcagggcatggcagcaatctggagaagcagggaagagttgaggttgcagctccagcctgaagacagcatggaggcaaaattcctttcttgggggacagcagatatttcctcataaggttttcatctgatcgcatgaggcccactcacattttggagggtaatctgctttagtcaaagtctatagattgaatgttaatcacatctaaaaaatactttcacagcaacatccagattggtatggacaaacatctggccagcatggcctagccaagttgacacattta

SEQ ID NO: 147802 - DNA, 484 bp, Homo sapiens
ccccatacacccggtccctctggctccactgtggaaccagctctcaggggtcccatgcaggatgccacgccaaacacctttcaatctccattgtgtctttctcttttgaaacaacgccgacctggatgtgaatcctgactgccactcagcagcagtggaaaccctggcaagttttgtaacctgtagaagcccgtttccacatctggacaatggagttggtggcactggtctcacggggttgtaatgaagattaaataccttagcagatgtcaaggggtctcgacctgattccttcagagccaggattctttactgagggatcagggatgggctctgggggagttcatgaaccccagaattgcaggtgaaattgtgtgtctttgtgagaacacggttacgcatttttctgggaaggagatccataattttcatcagatccagattctttttttttttttttttttttgagacagagtctcgccct

SEQ ID NO: 147803 - DNA, 212 bp, Homo sapiens
ctgggtttcgccgctgctcctgttcctcgagcagccttcaagcagtggaaattacggagaaatgaacattctgaaagcgcctagtaaatggtggggaagtgaagacactggaaggtgatatggcctttccaaagtggcatggctgattgatgacagaccaccattggaaacaaggtggtttgactccagagcccgcaccctccaccacaacg

SEQ ID NO: 147804 - DNA, 441 bp, Homo sapiens
gccagtgtaaacgacggccagtttaaacgacggccactgttaaacgacggcgcaatgttaatcgtgggtcagattaaagcttgtggcgatatagagatgatggaggaggaggcttttgtaaagaaagacctggagcccagtggtggcctgaaacaaagaagggtaactttaagggacttcatttatttctctcaatttcccagaaacgatttaagatggcttctttgtaacacattagaaggtagaaactaataagtgaagaaattaaggtgaaaggaaaattcatggggaagaataaaattaagttgaaataaagttctgaccatagatgggccacagatttggttctgagcttcctagctgccaatgtaaagagggaagtagaatcaacaagtggcttgagatacggagcagcagatcagaggatggatgagtggatga

SEQ ID NO: 147805 - DNA, 426 bp, Homo sapiens
atgaacaagagggtggtgtggccacaggtggagaccgcaggatgaggatcgtgggtgggtagaaagattgttgggaaaaggatgatggaggaggaggcttttgtaaagaaagacctggagcccagtggtggcctgaaacaaagaagggtaactttaagggacttcatttatttctctcaatttcccagaaacgatttaagatggcttctttgtaacacattagaaggtagaaactaataagtgaagaaattaaggtgaaaggaaaattcatggggaagaataaaattaagttgaaataaagttctgaccatagatgggccacagatttggttctgagcttcctagctgccaatgtaaagagggaagtagaatcaacaagtggcttgagatacggagcagcagatcagaggatggatgagtggatga

SEQ ID NO: 147806 - DNA, 215 bp, Homo sapiens
gacaaaatgtttaaagtctcattttgtggagaagagaataaaactataattggttgacacagtcacctcagctgttatggagagattttctcgcttattttcattttcactccttgacttgtcacttatcaaattagttaggtgctactataattaaaataatcctctttttaagatgtaatattggataaaaaggtgaaagtttagtgaacaaa

SEQ ID NO: 147807 - DNA, 143 bp, Homo sapiens
tgtgttctaaatggggagcctcaagcacaggggtcccaaggtggggcctctcaaggggtagagtccagcagtaggaggccagcacagctgagaagaggggtgacagacacagtaagaaatgaggtcacagaggccggtgtgtg

SEQ ID NO: 147808 - DNA, 498 bp, Homo sapiens
cactaggtcacctggggtgagggtggggcatggcctgcccagggtagagaaggaaacctatttctttgttcctcccaacaccgtgaaacagccttctgtgttattggacagaagctggagcttcccagtccaaagagcttgcgtttggttatttcatgaatgtcttgatcaagcccaggtataacgtctgccctaaagacagagtcattcttctaccctgagagactctctatacaatgtggttgtttagattcaccagttttttccatttccagctaaccaagagttcaggtactgaaagccatctaatctcagagaaatttaaagctaaataaaggattcttaaaacagatctttacatgtccagtttttaaagcctccattttaccgaacaggaagtttgcagaatgatcacattagcaccagagccttggacactcaagtgaacttgagcccacaaagtcagcccgaaaccccgcgccggtgccggtctagagt

SEQ ID NO: 147809 - DNA, 264 bp, Homo sapiens
tattccaaggacagccattaaccgtgaagtatgtgtgtgtatatacactgccaccatgggctagagaaaaatggtgtttctttttttccctgaatatgaactaggagaagggaaatttctccagtgttctggcataagtggacagtgatgaacattgagaagagacttgagtatacttacgctcgcagactaaacagacatgagttgcccaggtgactgtcatgaaatctggtgtctgtataagtgacaactttgaaattcccg

SEQ ID NO: 147810 - DNA, 410 bp, Homo sapiens
gatgaactttagtgtcctctaatgtcagatttagctaactttctgatgtctgagaagcctcacaaaacattaacattttccctaaaaattgtcaaatagacattaaaaccaattccaacaaaacctggtttatgaaagcagatatcacatgctactgatattgaggttttatttcagaaaaataattctcgaccagtaaggcttccatttgcaaatggtctaccaaggtgctagaagggtacttagcagaagcttccaatttatatgttgtaaccaagatccaatgtgtggaaaactcccgagtgaccttggtcgacatgagtgggaagcaaggatctgtgttccaccaagccttggccacaccgcatgccggcaggggacaggtgtggactgacactgctcatccaggg

SEQ ID NO: 147811 - DNA, 277 bp, Homo sapiens
gcatttgtaaagcctgaccacttacactttgccaaagaagtttcccaccctctttcagccccaggggtcctttccataaacttcttaaggcagtagtttctaaaacattgagaaagggctaagggaaggtcccttatgagccactagaggataaaggagtctgtagagactctcctctttcagccagaatggttccactttttttccccccgagacggagtctcactctgtcccccaggctggagtgcagtggtgcgatcttggctcactgccacct

SEQ ID NO: 147812 - DNA, 273 bp, Homo sapiens
tcagagcttcttggatagcagtggcttcaatcaagtctgaattcaccggcatctttgggccccggacattgggcaatacggtaactttccagaagatgaactgagccagaaataattccaccccctactatatacctccagctcctacaacagaatctctgcttagcttggtaccatttcctctgagactcgactttctagagctttcctcatcgaaagcagggctcaaaaataaatttaaggatgggagaacataccaactttcatacaaca

SEQ ID NO: 147813 - DNA, 419 bp, Homo sapiens
gatttactttcagctctgttccagaacagatgctcttttccactccccacggagatcaagagcttggagcagaaataatagctctcctcacaaaaagacaagagtggagagaaccacacaatgtctttaacttttgggggaagaatcaagagctctaagacaaatcactttatgcacctatctctacagtctttgcatacatggcctacttttattaccccttctctttttgaggtaaccaggtatccaggttaatcacgctacccttggttatcatcacatgtatttctgaaattgtcttttacatatatctttttacttgttaatgtaagacataagaacagcctttatcttgttgattatggtaattagcacatagtaatttctcaataaaaatatgttggaaagttcaatgttta

SEQ ID NO: 147814 - DNA, 798 bp, Homo sapiens
tcaggagacactcaccctaatcttatgcctggagactgggtatgtcgtcccaaaggacaaaaagccactggagcctctttggattagatcataccaagttctccttatgaccccaacagctgtaaatctccaaggcctctctgtggatttacctcttcagggtcaaggtggcaccagcacccaacaaagaacacttaaacctgtgaaccagttggagactttcatctgttgttcagaattcagcagtttcaccttcgaataatgctgcaaatggaatatcagtctctcaccagtgatgctcactaactgaacaaatctcccttggattcagctggacaccagtttcaccttgacatgctccccatctctgatgagtcgcttcctccagcaagatccaatatcctaagtcccacagtccaggacaatgacccacaggatctcccgacagaccaacagccatagttagggtcaactctacacccaaggccagcaggaagtagttggaggataagaccactgccctagtgccaaagacttgtcattgttgttctgtcagaggggaaaaggggagtctgaggaaggattcccaggtgggggagggtcccctgtggggagaaacaataaacagttattctgagagatggctaatcacaaacaacccatggtcacagtgaccttgttccacacatagccccctccagcatgaccctataaatcttccctccagtccctcatctcttggcagatagccccttctctattgtactgtctgttgtaaccttgcaatgtatttcatac

SEQ ID NO: 147815 - DNA, 316 bp, Homo sapiens
aggttgtaaagaatggttctcagtgctgctttcatcatgaaagactgaagaatcactattggctcattttataggaaagaaatactttcacagaagagcatgcctatagtaactttggaaatattccacatcttggaagagctggcttaggatataaagaaacttgaaaataaaaaaaaatggcctaatcagaaaatatttagtttttgccataaactatatcaaacatgtagacatagtacacatggacttgcttcttttggttttcagtgcctgtaacttattaataaaagtcagtggagaacatctatcctaa

SEQ ID NO: 147816 - DNA, 241 bp, Homo sapiens
cagatctcatcagatgaaggataaataaacgtgtctctcaaagccatctttattcgaagaagtttccttcgcactacaaatctaaagttctttctacgaacatcttgtatgaattgatacctgattaagcgcatctaactacgtatttgtatatgtgtctcattgcctcataaaaatccagaagtctttaaatgtgattcaaaaccaacaaaaaatcaaataaacatttaaataaattagt

SEQ ID NO: 147817 - DNA, 254 bp, Homo sapiens
agttgtcaataatttctttatttgtgatacaagcagcggtggggaaagagaaatgaacagacttggaagcttctccgaggccctagagaagacctctgggttccgaacaccagacaccaggagtaaggagggtagttgatgactccccactctttctccagcccctgctcctctgtttttccccttcacccactgcagcttcctcaggtcctgggtcccacgccatcatctcttcgaatgacctcccttctatt

SEQ ID NO: 147818 - DNA, 382 bp, Homo sapiens
ttctgttttatttttagtagagacagagtttcaccatgttggccaggctggtcttgaacacctgaccttaagtgatctacccgccttggcctcccaaagtgccgggattacaggtgtgagccaccgagcctggcccattttattttttttgaatttgaacagaatcctgacaatatttagagaactgctataatttaactttatagaaaggtgtaaaacattacttttcaggcaaagttgatgagaaaagcagtgcgaattaatgaaacataaattattaaaaagcttaaagtaggcaaaatatttttaatatttttaatttttatatctggagctatacagaataagaatactttaaatcaatatttttcagtgagggtgg

SEQ ID NO: 147819 - DNA, 487 bp, Homo sapiens
gacttgcatatattgtgagaattaaatgggatactacatatcaagacttaccatactgctacgttgtgacggtgcctgcttccccttcaccttctgctgtgattgctatacaagaagcatggcaccagcatctgcttctggtgaggacttatggaagtttccactcacggcagaagggagaggggagcaggcatcacatgatgagagagaaagaaagagaggagaaggtgccaggttctttttttaacaatcagatctggacccaggaactcagagcaataagtcactcattaccccttccaccaggccctgccttcaaccctagggatcaaatttcaacatgagatttggagaggccagacatccaaactctactagcctatcagtagccccttactcttccaagaataaggacattcctgcattaaaatgtataatataatgctgagtgataagctcttaaaataaaagtaaaaataaataggga

SEQ ID NO: 147820 - DNA, 269 bp, Homo sapiens
tgggaacatgtcatttccctgagaagaaatcttcctcatttctgctgagaagatcctcaggagcagctgatgagtcttcgtcgttacagctgccctcatagatgatgtccaggggctaatcatattcattgattcttgaggctgccattgtctttcatgggaccttttccaatgcccagtaatgaggaagctgttccaatatttcctcaatgggaaggttttcacttgcttttgagtctaccttgacctcaaataaggtctcctcctct

SEQ ID NO: 147821 - DNA, 141 bp, Homo sapiens
tgtaatgtaataatctttcagtacagcaaagaggtgcgcccagcactgtggtgaagaagaaaaaagagtcagtgcccttctttcgataacatcattcccacctccactaccagtttaatttcccaactttttttcagaata

SEQ ID NO: 147822 - DNA, 320 bp, Homo sapiens
catgtatatcggcgtctatgcctgggctctgttatgttccacagacctatttatacacatcatgaacttctgttgccatctccaagtgagtctgtggtggcttccttcatttatccagcaaatactcattgaatacctaccatgcaacaggcacagtgcaggaatgaggaagcagacaagacagacaacacacaagtgaatcaataatgctacaacttcagataacaataagcgcgatttccaccattaaacctgcaaaggtgaccctgaccagaaggtggggtaggggaggtgttaattagataaagcggaaaggcatc

SEQ ID NO: 147823 - DNA, 384 bp, Homo sapiens
acaaaaaacaaacaaaacaaacacttccctgacatttcttcctctgtcaagacagccccaacaccttccttcccttctcagcttctgattcattccatgggatttgcaacttgccaaaaccaataaaaacgcagaaggccttggctccccagtgccctttggtcatgtgaagcatgtgacctcagataattattggttttgcccctctgtgcctcagttcactcatctgtaaaatggagatccgagtaacacttacctcactggatttgtatgatgaatcagaactacctgagtgctcacaaatgtccccagcacactgtgagggctccagtgttgtcactatggtcaaaatgatctgtcccataaaacccataggcctgctcc

SEQ ID NO: 147824 - DNA, 388 bp, Homo sapiens
aggcaggtaacagcttgagcctaggagttcaagaccagcctgggtaacatatcaagccccgggtctatttaaaaaaaaaagaagaagaaaaaactaaccatagatacacacaaaactgacaattctcatgtggataacagagggtaactactatcaccctaacctaaagccaactgtttcagatttttatgtggttgtttagaacaaattagagccacagcatgtggaagcagcagcacaaattgatcaccatgattggaaacaactcagggcacatatcctgtttccaatgagtatacagtgtaaccatgctaatcaaaggatagccattgtatataatctcctttgctggttggcctgtttcttccttcctccaggaatctttcag

SEQ ID NO: 147825 - DNA, 346 bp, Homo sapiens
tttttagctaaattcttaacagctccatgcccaattcctaatctgtcaaatggcttagaatgttacgtaatgctgagatcacacctggggagacgacaatgttagctcatgtgggttgagtgctccgatgcacgctgggctcgtgtttcactcattaccaatgtaatcatcacggagcctctgggaggtgtgtgctaccattagtacccacttcacagatgaggaaactgagacatagagtgattgagtcacttgtcacctaggcctgcagccagtcaggggcagatccaggattcaagtccaaagaatcagattccagggccccagcccacaggatactgctttt

SEQ ID NO: 147826 - DNA, 227 bp, Homo sapiens
tcaataaatgttgaattaactggatgtttagatggatggatggctagatggcagggtggatagacagatcagcaagtgatccagttcatttaaggagaagaagagcgagcattcaataagctggtgcactaatgagacagaacattaagtaacgatattgatccatgttgtaaatatatatccacatcgtttatgcaagagttttggtttttttgtttttttttttt

SEQ ID NO: 147827 - DNA, 388 bp, Homo sapiens
tttttgtttgaccctgggaggtgaggttgcagtgagccagcagtcagcctaggcgacagagcgagacccgtctcaaaacaaacacatacatgagggaaacgtggtgtgaaaacgatcttttctatgaagaaaaactggtcatattactttatcatgacatcttctaatatcacccactgagccatggcaactccagtgaagagggagttgactgtggcactaaccagctgcgtgtctcggttttctcactggcaaaatcatggtgttcaatgaggtcccttccagcggcaacattctagtaatctttgagagtcaaaagacaaagctaggctgggcatggtggctcatgcctataatcccgggcaccttgggaggctgaggcgggcag

SEQ ID NO: 147828 - DNA, 173 bp, Homo sapiens
ccagtttacccagctctgacatccaggtgctttggctgaaggcttgagggcctcctggggtctctggccccatgtggctccgcctctctgggcctgtttctgtttttgggctgcctcaggacccatcctggccctgactgaggcaagagcatgaccgttgagattgccccagc

SEQ ID NO: 147829 - DNA, 349 bp, Homo sapiens
cagcgaaggagtcgatgcatggaaagcctttcaggcatgcctggctcaggcagcgccggccgagtgtgcatagctatcatttctgttatggtcactgacactgagcaaggccaccagcccaaccacagcattgttgagggtcacaggacgaggatcctgggtgggcaggagagcactgccacgttacgccctgccctgactctgaggaagctgaaaaggttgtgaagaatcatcctgggagcccttcaagaaaaatggttccaagtccctccaggctctgcccagggctggcttggcctgatcagcacgtgtgtggtgtgagccactattctggcctgcctgacttcat

SEQ ID NO: 147830 - DNA, 763 bp, Homo sapiens
tttggaaaacagtctggaagttcctcaaatggtaaaatatagagttatcatctgacctagcagttcccacacctagatacatacccaggagaattgaaaacatatatccatgcaataactcatacatgaatgttcacatctgtacataataaccaaaaagtggaaatagcccaaaagtccatcaggtgatgaataaacaaaatatggtttacccatacaatagaatattattcaacaataaagaggaatggaatgcttacatgtgctacaataacgataaaccttaaagacattatgctaagagaaagaagccagtcacaaaggatcataggttgtatgattccattgataggaaatgtccagaatggaaaatccataaagaaagtagagtaacagtggttgccagggtctgagggagggaggataaggagtgagtaccaatgggtacagagtttgtttttggaattatgaaaatgttctggcattagatagtgatgatggttgcttaaccttatgaatatgctaaaagctaatgattctatactttaaagtggcgaagtttatgatatatatatctcaataaaaattaaaagaataatacactatcaaaaaaaaaccagatttggaaatgaaccaaaaaaaatacttttagaaaagaaaaataataatcattgcagtttaaaagtcaacaagcatttcagagagcagatcagaaccagctgaaaagaacattcagtctacaaaattggccagagtggcacag

SEQ ID NO: 147831 - DNA, 194 bp, Homo sapiens
ctggctcctgtcattttaatttcctctaaacattggttcctgtgctgtcattcctgaggcaggggtgattcgggactgatcaagtgtttattccctggatctcctgctccgcggcttttaaacaaatccagcactcacttctttgcagtgtggccaagttgtccttggcccctgggttcctaatgcggcgcgtt

SEQ ID NO: 147832 - DNA, 305 bp, Homo sapiens
ggactttgtagtttttggcctgagcaactggagagagagagcgaccattcgctgaggtgggaagcactgttggaggagaaggttgggaggatacattaagagttcagttttggacaagttcagtttgagaaccctattgagcatttatgtgcagatgtttaactgatggttgattatatatataagcctggaattcagaggaaagtcttagctggagagcatcttggaaatcttcagactgaatatatggcatttaaggcctcatgctaaatggtgttatctataaaggggaggcagaggtggaa

SEQ ID NO: 147833 - DNA, 677 bp, Homo sapiens
aatggctcttgcatactagaaaaaggccacattccttactctggcatttaagtttttataacctggccctaggttactttccatcaccagagtctaggccatatgatagtaaaaacaacctcatcagtattttattaggtactctgaataatggtcccagattactgatgggatcttaaatagtaaaagctgtatctggcttctgatgttatactgacctcttccctcaccagtacatagctatcccctcatgttgtcattctcctcaccaaaaattttgtctagttactgtaaccaaaattctacttcctctctgaaggttatcgtctccccgaagctctttcaagtggagcatagctgttcattttaggttaggggtaattaggagttgttggcattgttttagatcatgagttggaaaactctttctgcaaaggaccagataataaatatttgaggcttgggagccatacagtctgttgcaccatttcaactctgccattgtagtgtgaagcagctatagacagtacataaatgaatgagtgtggcagtatgccaataaaactttacaaacgcatgttcatatagtttcttaatatatatgataccaaaaccacaagcaatgaaagaaaaaaaaggtaaattgtatatcatcaaaattaacaaatctaagcttc

SEQ ID NO: 147834 - DNA, 405 bp, Homo sapiens
ggggagagtagctgtgtgcctgaggaggaaagggcgtttgggagacctctgctctcgtatgccttaacctccaacactgtgtgactcccagacccacagattcctcgtgggaaaacagggaccaggccaccacccagtgtgatgaaaggtgagatacctaatgggcaggcagtcatcagggttaattcaaaggctggaagaagggctgacctggatgactggaaatgtctttgagctgaaggtcatgtgcaggtggaacgaagagggtgagccttttgcggtgaactgcaagtatttgataagatccctgtccccatggttggggaagtcttgataagcatcctcaatgtgatggagggattagggaacccatggctctacctgtccagcatggcagcaacatga

SEQ ID NO: 147835 - DNA, 281 bp, Homo sapiens
ggtgaatttgtttgcactgtgttcttggagagcagtctaattcaatattctcatgattcatgctttccctcccagtggttttgtctttgatcatggaactctttaaaactgtaaagtcttaaagactcaaagggatgagcccagtgaaggttcaggaactgagacaactgagtaaggagggtgagattattttaggactgaggagtttgtttggaggcttctaaatccaccccttcccaggcattatatgcccaaaaagctggtcttggttgacagactag

SEQ ID NO: 147836 - DNA, 308 bp, Homo sapiens
gcctggatttgaacgccgccccttccccagtcttgggtcagtgagctcacatagtgtagttgtgggaacagactcagcaagacagagccctgggctctgcccccactccttgcgtagctttgggcaaattgcctaacacctccctgcccagtttcctaagctgtgaaatgcagacgatggttatacctaaggctgagtagggatgaggtgagttaacacgtgaagtgctgagacggtgcccagcatatgatactaagcaactgtgattagcactgttgttgccattatcattaacctgcaagcttcta

SEQ ID NO: 147837 - DNA, 294 bp, Homo sapiens
tggcaatgcctaggaaagatgtccagtcccagcagcttaaagccaaaggatgagtggtcacaagattccagggacctatagctttgaaacactagggctacagggagctttataaactctcattacttctctatatcccaggctttaagataatgttgatttctccttttcctttcaccccatcataaccaatcaggtactaacccctcgggactggggactcatttttgtttgttttgtcttttccagtttcctctgtctcctcttttcttgtcttcattgcccacagtatgt

SEQ ID NO: 147838 - DNA, 350 bp, Homo sapiens
atgggattctgaggaaggggctggctggaccttcaagccctctgggattggggggacagggagtgggatttgcctccctgcaggcttgaatgtgtgtgagaatgtgctctattgtaaattcaatgacccgaagacctgtgaaacgcccacaggagagggaatccagtgaagggggtctgcgtgggtaatgaatgggactgggagacatggcattcccggtatttactgtaaatgatgcagattggacctggcccagaagccactatgggattcacaatagggcttcccagaagaggcagtgacaaacctggatcctgtctaggaatccaatctgctgtgtgtcttaggaa

SEQ ID NO: 147839 - DNA, 246 bp, Homo sapiens
acttacactggctgggcaggtcgtcaccctcatcctctgacctgtcagactggctggtgtcagctgacagcggagctacactgaaaacagagacagtactggggcctccgtctagggccttgtactcactggtttgcttccagtcgactctgaaagctccctgctgcttcctccaccattccttcactcgttctggaggaactacccgacctgggttggcatcctgcctctgccactcatttactg

SEQ ID NO: 147840 - DNA, 580 bp, Homo sapiens
tcctgagggtaaacagacgacgaggaaaaccctaatcatagccatgagctctttcttgtttcaaaagacaggacatttaaactgagacaaagaatgagaaagagttattaaccagaatgggggaaggagcattccaggtggaagaaatagcctgtgtaaaagcctcgaagcaggaatgactacagacagtctgctgccgcaagcgcagtttcacacatcacttgcccttgtgtcagtgggagtatggaggagaggatggcaaaatgcacaatttggaaactctgaagagagaatgaacaaagttaacaagttttgaagttctcaacatagcataaggaatcactacactgcctcctgctagaatatgcaaatggttaaaattttctaaaacctgatgtctgaatagtgatactgacagggccagctgctttatatacaaaatagcctttacttcagaaaaggcctcatgcttctaagctgtttccagggatgctcccaacttaggaagacagtttaacaggaaaatattaatcacagagtgctaaacaggatgcagcctctctaccaaaaagcacaaaat

SEQ ID NO: 147841 - DNA, 237 bp, Homo sapiens
taaaactgtacaaaagaatcatttaaacttacagctactagaggtttattaattcacccctggaatttagcatagctaagctcagcataggtatggggccctgttccacattactttaagaattataacaaaatatttggataaggcagtttcaaatcctctccagaattctgaacaccagagaggttaaaaagcaaaagggtcattcaatcaggtggatatctgttcggagttatc

SEQ ID NO: 147842 - DNA, 239 bp, Homo sapiens
gccataaaccactgttctgctgaggcaatctctttgttacaaaaggtttgccttttgatttccttactagaaagctgcttctcaaacatctggaaggggatttgtaatgtgctacagtttaatgtgctcgacctctctaaagcacatgctgaagtttgatccccagcattggaggtggggcctcactggaagtgtttggttcacggggaggatccctcgtgaatggctcagagctgtcc

SEQ ID NO: 147843 - DNA, 1018 bp, Homo sapiens
agagttctgaaagatagaagggagtagtaggaggagatgaatcttcggctagagagtgaggcctgaataggatttaacttaaccaagaggcaaggggaacaaaatacttacctatctcatctagtagctgtgtgctgctagctcagcttcctacttagacttgagcccacttacttttttagagacaggatcttgctctgtcgcccagattggggtctagtggcgcaatcatagctcactgcagcttcagcctcctgggctcaagcttcccaagtggctgggactacaggtgcatgtcaccatgccgggataatttttaaactttttgtagagacgggggtcttgctgtgttgcccaggctggtcttgaacccctggtctcaagcgatcctcctgccttggcctccaaagtttctgggatgacaggtatgagccgctgcacctggcccaagcccactttttaacactgctttgatattttataaatatgttcctttctggcagtgtgtgttagctggatctctcttcttttggcctggccctttgcccttttctttttttctttattttaatttttttttatttttattttttgagattgagtctttctctgtcacccaggctggagtgcagtggcacaatctcggttcgttgcaacctctgcctcctggattgaagtgattctaagtagctgggattacaggcacctgccaacacgcccagctaattttgtatttttggtagagataaggtttcgacatgttggccaggttggtgttgaactgctgacttcaggtgatcctcccacctcagcctcccaaagtgctgggattataggcatgagccactatgcccgacctttgcccttttctggggctcatttgtaggccagggtcctgcaggagccagctatggaggtcaggctggatggtgggctgaggcccttagtgcctggccaagggcagtccctgcctgtgtttggggcgtgggtgttggtaaagcagtgtgttgagaagact

SEQ ID NO: 147844 - DNA, 124 bp, Homo sapiens
atttaacccagcatatccaaaatcattgtcctctcaacatataatctacattttaaaatttgagatattttactttcttttcatactaagtctctgaaattcactatgtattttatatttacag

SEQ ID NO: 147845 - DNA, 303 bp, Homo sapiens
gcatacagtgaagtaagaattagtgaactagaagttatgtcagaagtaaataccagatgtgaaaaactaagagacaaaagaatagaaaatatagtagagagtataagagacatagagttaacttgagaagatctaacatacacgtaactggatttccaggagaagagagaatatggcagaagcaacctgtgaggagataatgactgagaattctccaagtttttaagacatgaagacctgcaagatcaaagcatgataaataaaaacaaaattacaacttagcacatcctaagaaaaaataaa

SEQ ID NO: 147846 - DNA, 175 bp, Homo sapiens
taggaatcacagacacatcagcagtcatcagcagtagagtggaaaaataaatcatggcatatttatgcaacaggatgctgtatagcagtgccaatgattgagctatggctgtatgtttccactggatgggtttcacaaaattgtggattgtaataacctgaggggaaaggaggag

SEQ ID NO: 147847 - DNA, 350 bp, Homo sapiens
gggtgggccgtagccccagctgggtgaagaaagggttatgaactatgacctcaggcagggagtggctcagagcagtgatacagttgttactcagcacagccgtgatgtgaagccaggcctagaaggattccataccttcacactccctttaggtgggacaggcccgccacagtcagagaacaggtgccagggaacatgaccagcctcttctgccaccactccatgtagaggaagtgatgggtcatgttaacaaaggtggactcccccagtgagtagagcagctcctccacacccgagaaggcatagccgtgggcctggtacttatagatcctagaagacacatagagctg

SEQ ID NO: 147848 - DNA, 496 bp, Homo sapiens
aaacacagcccactcgcctgcagccggaggagtcaccctgctggctttcgcatggcttcaggctctgggcttcgggaaactggttcatattctggtatcaccacttcctagtgagctgacccttgacaacttacttaacttccaagatgacacttactcaaacaggatactacaaggattaagaagatgacatctacaaatatcttgaacacattttgagggcaaaaaaacaggattgttattgagattaataaacatgcatgaaaattcttggcaccccagactcatttaactaaggatggagggacacgtctcttctcaccctccttgatagttccgttgccctgagcagagggtccacttcctcctcctgaagaagctcctcttttcgttttggtaacacatcctctcctggatttcctcctagctattggcctgtcctctcctccttgctggcctctaaatcttggggggtctcccctccagccactggccc

SEQ ID NO: 147849 - DNA, 345 bp, Homo sapiens
ggccagactatgactcaggtcagggcctatggagcactgcatagatggggacatttgcagtgatctacctaaagctaagctagctttaagtggaagtctagcgacagcagttaattgtttagtattcacttctaggaaagaatgtcaagttcttgatttcctcatacgaagctatggcagttttttatgtttgttttattaaaactgttcacaaaccacttatgctttcctagcactctcagtagtttgcttccttttacctttcccccacccccatctcttatcccacttccctaccctgaagacttctctagcagcttggaaacactctaattactgtagcta

SEQ ID NO: 147850 - DNA, 221 bp, Homo sapiens
tcaacatgtcacaaccagaggttgaggcaggatctttgtcttgttgactcctacctccagtgccttagcagtagctgccattggagctttcacgaccatcactccccttctcccatgaacacattgtacacaccccaccctccttgatacagcatcactggggcagcagagcagcagttttaaaaagatgctttccctttggtctcctgctactactttgc

SEQ ID NO: 147851 - DNA, 842 bp, Homo sapiens
tgtgggagttcgggtgggaaaaggaaggagagctggtagtattggaagagctgccaatcacaagtccagcttgtcgttccagttgtgctgcctgtgtggaccagccgccttcctctataggcctcagtttccctatctgtacaatgaggaacctgtccttgattatctctagctgccttgagattctgacatgtgggctccctgcatgcctgggtatatgagcatatcagggtgcactggggcactcgggggaatctgtgcaggaattctggttcaggaatggtggaggaaacagatgaaagagcttgaggtttgggaaatagggctgtcttgtagatatgcagagagtcagaggcagagagagagagagagaaacagtggatgatggaaaggagagtgtgggagagaggaagacagaacaagaggaaaggtatatcagaagagggaggagagagaaacagagtggaaaaacagagataggaaaaaaattagtgagagtaagatgaagacagaaaaagagacagcaaaagagaaagaggaagcagaaaggagtggaggagcatgccggggcgcacagaggagtggaggaggtctggccaggtctatacactcggagtgctgagtaagccctggcaatcgtgccctcagcgcatttgagaaacagtacacccagtatcaggttctgcccagctatccagagtgtgatctgcagcaggcaggcagacagtagctccctgggctccatggcctctcagcaccccaggcagtaggctggttggagagacacagagctgaacctcgcccaccccgcaaccccgacacggataggaccgagcctgact

SEQ ID NO: 147852 - DNA, 298 bp, Homo sapiens
ataaaatgttagcttttctatttctgctgtaaaataattatcatgaactgggtcaggtgcagggtctcatgcctgtaatcccagcactttgggaggctgaggtgggtcaatcacttgaggtccggagttcacaacatggcaaaaccctttctctactaaaagtacaaaaattagccgggcgtggtggtacacacctgtaatcccagctacacgggaagctgaggcttgagaattgcttgaacctgggaagtagaggttgcagtgagccaagattgcaccactgcactccatcctgggt

SEQ ID NO: 147853 - DNA, 305 bp, Homo sapiens
ctttatatctctgccagatactcagctctgagatcatggaccatgtctgttttgtttactgctgtatcctcagcccgtggcacagtgcctggtttacagtagaataataaatgtgtaagttaattttttattttaagtgcactttaataattttatatctcataaaaatgaaaaggcctcaaatgtggctctctgctaagtatgattagtcatatagtaaattatttttatagcagatcttgtttaggttgtgaacatgggtgagaaattccagtttctgtcattatgtctggttctatcaagag

SEQ ID NO: 147854 - DNA, 124 bp, Homo sapiens
gcaatacatttgtaatcaacacacacacacacacacacacacacacacgggcccaccattttgagtcagtctccctgcctctaatgcccagatttttttctcttctctacagcgtgctcccaca

SEQ ID NO: 147855 - DNA, 594 bp, Homo sapiens
ggcgccctgcacttcctgctacatcacaccaggaggcccccgtgtctggctgcttcccttcctgttcagtgagactcagcagcgggcacaggtgctacccccagcccgcactttgctattcaccctgtgctgatccccaggcagagccacacttcacgagagggtcacactgtatgtatacccagggaataagaggtcacttcaagtcgcttagttattctcaatatttttaaatttcagtctcaaacagaatgcaatttcatctagtttataaaacttaatatacgtatactgctacctcaaagtaatcaatccaacacttggccagttaatatgacctaatttcacatttacctgtacatttacagcattcatactagagttattctgctaccacacagagatttcaactttattatatactttaacaaaaatggtatgtgaaatggatattatgtctatttacttaagggttattttgcagagtgacttactaaatggaaaaaaaactgtatggtctatattagtaagaaagtaatttttggagaaggattatgtaaaaggaattacagaattgggaataagctgtttcag

SEQ ID NO: 147856 - DNA, 303 bp, Homo sapiens
atgtaagtcacacgtgaccggcagcaacaacacaggtggaagttacctctcctcactaaggggcaagtgctcttccgtaaagtaagaatttgaattagaagacgtggcataaaggcctggattcctatcatgtttgattttctctaagtcatttaacaactctatgccttagctctcaatctgttgatggaaaatgctatctacttctaccaattcagagagacatctacctggatgactaaaaaagtatccttgtatgtgtggtattaataggtgcacgcatctcaacagatcagaattctc

SEQ ID NO: 147857 - DNA, 263 bp, Homo sapiens
ctgggtggctggctaggcccactcactagctggagggccttgtgtccacataccaggttttagccctggtggttcagattatgcctcaggaaaatgaatgtctgctatgggtcttcaggattctgaagctagtgaggattccggtaaaccaggcgactcatttattgactttccgccatgtggcagcccaggtggggatggaggtttcttggtgagccacactcagtgccttgcccctgcggtgctcaggaagtttcatgaga

SEQ ID NO: 147858 - DNA, 915 bp, Homo sapiens
tgaaattgcctgacttttaacagctgatacatggcagaagctggcttcaaattcagactgaaacattcatctcctaaatactttattattcagaggtgctaaaagagacatagccagggttcctaaggcagctggtagggagataagattagtaaactagtcaaccaccatttattgagcactgaacagtgtacctggggctgtcctatgcatggagcagattttataccatttaatcctcacatcttcctaaagtatgagggccattatggtcttcattgtgcaaatgataaaatggaagcttaaagagggtaaatacctgaccacagacatagtcggttaaacggtggagatgaatgtaagccccatcagagtctgtgcccttaagcccagccatacaaagtttcccacagtgtcttcccttggtggctggcatctcactgatggaggtcagcctggaagtcagggaggggtgaggaaggcagtgcacatgtctgggatatctcagccctgtttcttatgtacaagtacatgcatatttctacttgtctacacatactgtgtgctggatgctttacactgtgatgagcatatagtgattctcctgaagaccgtatgatgtcagcactagtcccattatacagatgggaaacttgaggcttaatttgatccaggtcacatggctaataaatagtacagctaaactggaacacaagccatgtgaccccagagcctgagcacccgatcacgttgtctttctgcctccaggaggactcttcaaaatactcctcagaaccttgcttgcaaatctgcccagcacagcccagactcagcgccccacagagcacgccgctcttccccactctaacatacagtggcaaatccatcttcttagaggaaagaggaaaaaaaaaa

SEQ ID NO: 147859 - DNA, 291 bp, Homo sapiens
acagcgtccggagacagacccaggttgatgctgcgttgctttttctcttttatcctcaggagctctgcaggccctttctcaccccattttaccttcactggggaagttattacttggtgcaattattttgacaccaacctaatataaaagtctgcccaggttcaaggggaggacccgtggatcccaactctcaacagagcacgtccatattatagtcagaagagcacgagggctggggtgctgattgatgctgaacttttggaaaagagaatccacttcactagccttctg

SEQ ID NO: 147860 - DNA, 451 bp, Homo sapiens
ggagggttgtgagcagaggagagatggggtctgattcacttttcacgtggagaacaaactacaagaggacaagagtggagaaagctgttgtcgtcttccaagtaagagagggtgctggcttattaataattcattaattaaaccatcaacattaatacaaattatctattgggccaatgctattactcttttatttcagacatatcatggggagaccaggcatcgcattccagctacttctacagaaaaatgcattctgagttccatgatcaacttgaaaccttttccatccaccttggttttaagctgggtactgtgtggttggatagaagacagcaggaaagggagtcagggatgagggcagattaacaggaggaaaaaagggcatctcccctcatcatgcccttttccccagagccaccagagaagagcagtctgaatggaaccttcc

SEQ ID NO: 147861 - DNA, 461 bp, Homo sapiens
caaggtgtaggggatctagggctgtgcagaatgtgccttgttaacaatatgtttacaggcagtatgctggtaaaagtcattgccattctccattctcgattaaccaggggcacaatgcactgcggaaagcctcaggggcctctgcccaagaaagcctgggtattgtccaaggtttcccccaactgaggcagcctgagatacggcctcgtgggaagggaaagacctgactgtcccccagcctgacacccataaagggtctgtgctgaggaagattagtaaaagaagaaggcctcttgtggttgagataagaggaaggcctctgtctcctgcatgcccctgggaatggaatgtctcagtgtaaaacccaatcatacattcattctattctgagataggagaaaactgccctgtggctggagatgaaatatgctggcggcaatgctgctctgttactctttact

SEQ ID NO: 147862 - DNA, 435 bp, Homo sapiens
gacccccaaatgggagggaaagcccacctctagcctgaggacctccagccctcctatgggagtcttgagcctgtacatagataagcgggcttcctagagactttcttagacaaaaatcagggctggcctcccctccctacctggaggcaagaaggaaagagggtgacaaagggaggttggcctcaagcccattgcctacctgccctccacttctgcaccccagaagaagaggggcataaagatcctaccagctgtgtccccagcatgttctcaacccacagaggcccagacccccatctccggccccttctgtccctgttcggactccttagcaggcaggaggctttgtgatgttctcagcacccttgcccagcctctgtcctgggctccccctgccatcctgtggccctgtcagtccctcccctgatctgttct

SEQ ID NO: 147863 - DNA, 581 bp, Homo sapiens
agaatctccgactccacctatggcctgtgacacccgtttcaagaaatcccacctttctgggctaaaccaatgtataccttccatgtaccgatttgtggctttgcctgtgagtcctgtctccctaaaatatacaaacccaaactgtgatctgactgcctcaggtgcaccttctcagactctgtttccccagcccacagtcacttagacaggctcagaataaacctctttaaaatagtttacagactttggtctttccattaacagaatggtcattaatgtatttgatcaatcccttatccacagacttgagatgttttcattgctacaacagatactgctgcaaagaacattctgatatgattgtgggcacttgggatatgactttcttaggctgaatttccagaaatgaaatggaaatacttttttttaaattatgggagactgttgttttggactgagctccagcactaggccccaacagaccagaccaaacaggaatggagttgctcctgctcaatgccacgtcaccaaaatggaactttaaagaagtgacgtggcatcgatacagaccggtttttctc

SEQ ID NO: 147864 - DNA, 431 bp, Homo sapiens
caccaggcacgcagcttgaggaaagcggtagaagagggaagagttgcttagctaggccagcaccatcagtcagctctttttactcctccccaggttgctttacttcctgaacccagaatgactctcataatcactcagtgggttctagaaattatttaactgatttcagcatgtatccatggagggctgtaaagaggagaatgagacagaggacgcgtatctgatttaaataattttagatgtgataattaggtttttgaatgtttcttggaatttttattttctaaatgtgtgcctctttgacttcctcctgctgctgttgctgctattgctgctgctgctactgcttctaattattattagataagtgattgactggagccgaggaccactactattagagtcagctgaccagcaggttaaaatacaga

SEQ ID NO: 147865 - DNA, 384 bp, Homo sapiens
atgccccatgctgctgtgattcaaggaaaaggcagtggttttcaccccgacacacacatccacagatagaactgaggctaagtcaaccatcacatttccaagatggaaaagagggtttgctcctttccctgttttcccattcatcaggctgcatttatacccagtgtggccttcggctctcctcccctgtgaggctatacttcatgctcattttaacatcagttcccctatgtataaatgtagtggagcggaggtcacagagtgatgctggccccctgctccttcaaaggatggttctgaaaggcgactttccaccctcctctgattttggtgcttccacttacctttggatcacaatccagtctggcaatttgaggaacaacc

SEQ ID NO: 147866 - DNA, 192 bp, Homo sapiens
gctctgagtacaatataaaattatgatatatcacattcattcacataaattatttactatttgattatccttcagctgaataatgactatgtatactcttaaattatggagattaatattgttataactttaattttattatgatagtaaattctgttcacgaatgttgtcttcctaagatttgctcacagt

SEQ ID NO: 147867 - DNA, 571 bp, Homo sapiens
ttttttttttttttgagacagagtctcattctattgcctgggctggagcacagtggcgagatctcggctcaccacaacctccacctcccaggttcaagtgattctcctgcctcagcctcctgagtacctgggactacaggcgtgagccaccatgcccggctaatttttgtatttttagtagagacggggtttcactatgttggccaggctggtcttgaactcctgacctcgtgatccgcctgccttggcctcccaaagtgccgggattacaggcgtgagccactgtgcccagccggcaggcttttattaagcgttagatgggaggatagaggagtgaagtggtactggcaggaagtaccaaggttccagctggcgtaatcaggaaggctgcatggaggaagcagcctttgagctgcctgtggagtggtgggcagggtgttgtgaagtggcaatcactggattttgcttctggtacgaggtgtggccagatgcaagaaagagcagggtggactttggtgcaattggtgggggtctggtctgtagggttcccgtggggagccgtggagggagg

SEQ ID NO: 147868 - DNA, 322 bp, Homo sapiens
ttccaacctctctggccactcctctgcagatttattccacccctttaccccaccctcagccacacatacacacacaccagtgtggcctaagtcctggcacaagcatttttcttctatgtttcctccttaggcaagctcattctgggtggacaacatctacacacagtgactcccaaatttccatctctgatcctaacctttttttttttttttttttttgagacagagttttgctcttgttgcctaggctggagtacaatggcgcgatctcagctcactgcaacctccgcatcctgggctcagctcactgcaacctccgcat

SEQ ID NO: 147869 - DNA, 148 bp, Homo sapiens
gcagcccccacagcagtgggcacagtcagcagcaatccgggtgtcagcccctctctgcaaggattgggggccagatgctccctccctggaagccacatcaacgacagaccactgctctactgagaattcaataaagactttttacagg

SEQ ID NO: 147870 - DNA, 522 bp, Homo sapiens
tagctgggattacaggtgcccgccaccacacccggcttatttttgtatttttagtagagatggggtttcaccatgttggccaagttggtctcgaactcctgacctcaagtgattcaccctcctcggcctcccaaaggctgggattacaggcgtgagccactgcgcccggcctaaagtattaggtaacttttttttcaatttcataaaacattgagaggaaagaaacaccttaaataagatcatacctatctgggcttttcttttcctcttctttctttctccccaacatcctcctctcttttttgacttcttaattgtgaataaagcttctgtaaatatatgtggacaggtttttatgtggacatgttttcaggtccttgaaataaatatcaaggagcacaattgctagattgtatgataagcatatgtttagttttataagaaattgtcactgtcttccaaggtagctgtaccatttgtactctcatcagcaacaaatgagagttacccgtgctccacatc

SEQ ID NO: 147871 - DNA, 342 bp, Homo sapiens
agttccagttcacatgcaggactctagggttatttaacctcttctgtcttacatctgtatctttgtttgtttcccctacactacaattcctagttctcaaagtttctagggatgatagtaattatgttacgttctgttctctttgctttatccgaagttgcctagaatagcaataccaacattaacaccaacaatttaattactgaaaatagttaaaagatttttattttgtttgttttgcttggctgttatttttgccactagtctgtgtgtggccaaactattgtttttagaagttacttgaaatagtttctttctgcgcttctaactggatgtatagtt

SEQ ID NO: 147872 - DNA, 406 bp, Homo sapiens
cagcttctccacatccttactaacttgtcattttctgtgtttttggtagcagacatcctaatgcctaatggttgcgaagggatatctcgtggttttgatttccgtttccctgatgatgagtgacgttggttgtgcatcttttcatgtactcaccatttgtgtgcctttagagaaatgtctgttcagatcttttgcccattttttaggttaattggtttgtttgactttttgttgagttgtagatatcattttctttctttctttcctttttttttggagacagggtcttgctctgtcacccaggctggagagcagtggctcaaacatggctcactgcaccctcaacttcttgggctcaagggaacctcccacattagcctcccaagtagctaggaccacaggtgta

SEQ ID NO: 147873 - DNA, 390 bp, Homo sapiens
caagacgaaaaacagtcaaaggcaggggttgcaaaggcaaaggtggtcatgggccaggcaggaaatatgaatgggagaagcagctaggtggagactggcaagccgtgaaccccggcgccatctaaagtggatgctgaccctgggatggagcccagagtagccagttcttgctctgccttctctctgggtctctccagtctcacttccctccagtccagcctccacgatgtgttcaggtgtcaaagcgaccttttgaaacaaaaacctaattatgtcacatcactgcttaaaatctttaaatggtcccccttggaggctatgtttttcacactgttatttttagcagcaaaaccattccttcaaatgaaaatgtacatgtaaaacagaaaa

SEQ ID NO: 147874 - DNA, 378 bp, Homo sapiens
ggagaagcctgtgggctccttctccaaataatgtttttaaatgcataaaataaaatacttagtcttgtaaaggaaaccaatttcattgaaatatagttaccttcaaagagcctgcaggggtctatgtactgaagatgaagaacccctgactggcaattacttgtgtttgctttagagctgtgttgtcccttgcggtagccacaggccacatttgactgttgagcacttgcaatgtggctagtccaaagtgagatgtactgtaaatggaaaatatacactggatttcaaagggcttagtataaaaaaagaataaaaactgcctcattagtttttttgtggattacattttgaaatggtaacactttggatatattggat

SEQ ID NO: 147875 - DNA, 396 bp, Homo sapiens
tggttggaatggagatgaggattaagtaggggcagcagtgctttggtggagaagatgatttagtgacttttggacttcctgagtttgaggcaggacacaggggaatgttaccctaagagctcagcagagagaggccaggattggaacgtgtactactcttgaccactggagctccagacatgacccaaatgcctggtgaatgtctagaacaggtgaagagcaaggtgaggaaaggacccgagggaacaccaaggtttaaaggatggtggagacagtgagtgaggaactaagaagggagacccaagagatggaagtcaaagagcagaggctgggaatgaaagccattggaaggtacagtctcttgcaggagtgagactgtagtgtcatcagaaaaca

SEQ ID NO: 147876 - DNA, 485 bp, Homo sapiens
tgtttcacggcgggcagggtgcttccctatgctcggtcgttattgttatcccggtgttatagagatatctgacaaacaatgtatcctttagatgcttctccatgttaacggaagtaacaacctggtatataataaattccctgggcccttcaggttgttccaataaaggttctcctataaccaagacactgtttaaagaaacacaccccatctgcgaggcccagatgccaatcagtgttgagatgttcctcctctttgtggcaatgtagcaaggtttgcaaacttagcataaaaaggagatactacaccccagtaccaaaagtttcctggatctttttttccatagttttctttggggcttggaaggctggcttaaatttttagttctaaatagattgtggtcgcaactgggtaatcgttacttgatgaaaaacaaaatatccagtttttaaaaaacattcagctattgcttggctcacatcctt

SEQ ID NO: 147877 - DNA, 200 bp, Homo sapiens
agggtccccatgctgaaggagtgatggtgtcaggagagagaatccaggcaggatctgcagacgtggtgccctttgaggtgtcaaagactagatttcctaggcaaccctgctagaattcagggctagtcattgccccttgctgtgacctggcagcctccgagtaacccaagaaggtggatgggctggctgcattttacatg

SEQ ID NO: 147878 - DNA, 598 bp, Homo sapiens
actgaccctcctgctctgtcaccagcatagagccaagtcattaagtcagacaggtccgaagcaaggacagaggttgagaggccagaagaagatatcaaagtaaggctacatttggcagtggttccctccttcttttctcttttcttttcttttctttcttgtatttgagacgttgtctcattatgttgcccatgctcatctcaaactcctggcctcacacaatcctcccaccccagcctcccgagtacccgggattaaaggtgtgagctaccactcccagcattccagcccctttttggcaattattacagggagaaaaatgaacattagaacttgaatttgagagatgataattccaaaccgaatttcttcttctgcccgcctccttcttccctttattttctggtttctatgtgttttcttcctattctagtaaagttaaaataatagatgatcaggccaactgtgtaggaggaagtcatttaggcaggtaatcagctcagatatcaatcggaccaccaccttcctcaggaaagtgctcaagcctgcagctatcacttttggcaacaactcactcagatgcccctgagttgtccct

SEQ ID NO: 147879 - DNA, 116 bp, Homo sapiens
ctgctttgtaggatgttttatgaaacaaaggaatagaaattgtattcatattatacattttgaaattatatctatattatattttttgtcaaagcaaaataaattatacattaagg

SEQ ID NO: 147880 - DNA, 380 bp, Homo sapiens
gcgggcaacgctttttcccgggtgaagaaaatgtcctgaattagacagaggtgtataaaagtacaaaaaaccggccgggcacgggggctgacacttggaatcccagcactgtgggaggccgaggcgggtgggtcgactgaggccaggagttcgagaccaccctggccaacagggcaaaacctccacctctattaaaaatacaaaaattggccgggtgcggtggctcatgcctgtcatcccatcaatttcggaggctgaggtgggcagatcacctgaggtcaggagtttgagaccagctcggccaagatggtgaaaccctgtctctactaaaaatacaaaaatcagctgggcatagtggtgcatgcctgtaatcccagcta

SEQ ID NO: 147881 - DNA, 289 bp, Homo sapiens
tgtgtgtgtgtgtgtgtgtgttttgctggatatcttttggagctgcctggtgccgctgtgtgcagaatgttccatatgtgcctaacatggaggccccatggctgtggtaaagcagagaccagcatataggacagaaggatggagaagtcagctgaactcagggtgtgacttcagggtgagatagctgggaggtgtagtgttacgtgtgcctactggtccttggagtagccgtgccatgtgacagtgtaagctgacctcttactcctctgcatcaggaaacacaccgcag

SEQ ID NO: 147882 - DNA, 401 bp, Homo sapiens
atcttaagtgttttcagttccgggtaccattttttgaggacactggccaaccagaaagaccctagagggccaccaccacagtattcagtgctcagttactgtttgttggatgcatggggactagagtggttaggatcctccaggtcctgtgaagaacagttgaaagaactaaggaaaaggaaactttgagatagttctctttaaacaattgaagagctctcaagcagaaaatagtctggatttatttcatgtttttccagatgggccagcgggtttgggtcagtttaagaaagaatttcccagagctgttctccaatggaatgggctgacattaagtaccgttaaactcctaggacagtgactttctgtggcagtccattcaggagaggccaggaaccaag

SEQ ID NO: 147883 - DNA, 587 bp, Homo sapiens
agtagagatggggttttcaccatgttggccaggctggtcttgaactcctgacctcaggtgatctacccattttggcctcccaaagtgctgggattgtagggcatgaaccaccgcgcctggctgtgacaaggttaagtcaagtcattagggattaacatacgtaaacctatgtaacatatgtattaataagggcaagaagatgttatagacttggctagacagcagtggctgtggatgtggcatgaaagcctggctttcaggggacccagttctgtgattttagcctggtaaagatcggctgagttgttaatttctttcagaaaagttagatggtgtcagcggcttagaatatcccgtgtgggagggtggccatcctgggcatttcaggaggcagcacacataccacacacccaagaagaggctgggaagggaatttattagcgctccccttaggttgagtttattgtcagaaacctgtcattgtgatttcatttgatgatagaaaccggtggcctcaatcacatttgtgatggccaacaaatttacctaagcattttgctaacctgaagaagtaaagcagtggctta

SEQ ID NO: 147884 - DNA, 241 bp, Homo sapiens
ttcctcgccctgcccccagagccaagttctctatcagccgtttatcctcacacacttttctacaatggcattcaataaactgcacgtgtttctggtttaaaaaaaaaaaaaaaaaaagggtcgtctgtactatggcatgtaagtagttccttcctgcttatggtggagtagtagtctatggtatgcttgtcccagttggtccatctagtgggggacatggagttagcaggacatcagggca

SEQ ID NO: 147885 - DNA, 325 bp, Homo sapiens
gccaagggagctctcacaaaagttgagacactttttcatggcttatatcttaactctgaagattatatcactgatctatttaagggaacaatggttaaatgcacaattcaaaaagaattagcacattatgagaaactaaatattctgaatcatctgtctacagcacaaagtatataccttgaagcctttagactatatcataattgctaaaatttaatcagaaactatggaagacacagaggatgaataaaacagactccttgcacctgaggaactcagcctactaaaacaaacagattttgagcaaactcttaaagcataatat

SEQ ID NO: 147886 - DNA, 245 bp, Homo sapiens
ggcatgaacatggctcatctctttccgtatcctcctctgccattacaggagctgttaatggcagtggcatgaacattgctctaatcactacaggtttctaagcagcggagtatcaagaaacccaaaatcattcctgataacatttaagttcttcagccttgtattcaaggttcttcagtccagctaacttaatttttcttctcaacctcaatagagcaaaattggtcttactgcccttgtttttg

SEQ ID NO: 147887 - DNA, 274 bp, Homo sapiens
ttccagacactaactacccatcaattgactggagttggcaacacagataaaacacacttgtctttcctgatctaaattattgctcttcttcatttatatgatgtactagcaaaggcttgcttccaacaagtttgttaaaaagaactaaggatacttaaatgctggattgaataactgagctgatttgatcattaatctttgcaggcatatgaggggttactataccctatagaaccataagccatcagtataagagattcaaagtaaaaaaaaa

SEQ ID NO: 147888 - DNA, 194 bp, Homo sapiens
aaattgccagtattcacttgttttctacttacggaaatgtcaattttatgtgggtcagcctcatagcagggagacaaatgtcccttgcacattacagaaaaaaactaaatcaagctcacatctcctcttgtataagctattagcttagcctcagaattagcttccctgccttaattctcaaccccctccaattc

SEQ ID NO: 147889 - DNA, 1130 bp, Homo sapiens
agccgtggttcctcacctgtaaagggtgaggacaggagcacctgcctcagggtgagaaagcatggtcctcagtagatggtagtggttgccctcaggttcacagcttacctctcccaatttagatgagggaactgtggcccaaagagtcaacatggggttttctggcaaaatctctcttgttttagtgggtactgtattgatactgattcctcgggtgggtaagtccttcttctccacatgatgaaaataagtaactttaattttatacactgtcagttactttaaccattttaaaagttaaaaagtgtcagtacagccaaacaaaaaatcagcaaaactacaggttgggaagaaatattttccaaaccatatgtgtaataatatcttactatctaaaatagcaaaaaaaaaaccctactaaaaacaacctactaaaccctactaaaaaacaaccctactaaaaatgggcaaaggacttgaatagatatttttctagagaagacatacaaatggccaattgatgtatgaaaaaatgctcaacgtcactaagcaccagagaaatgcaaattaaaaccccaatgagatatcatctcatctcgctccagttagaatgactgttaccaagaggacaaaagagcaagtgttggtgaggatgtggagaaaagggaaccctgtgtgctgttggtgggaatgtaaattagtacaactattacggaaaactctggaggttcctcaaaattcataggactactatgtgctccagcaaccccatttctgggtgtatatccaaagggcatgaaatcagaagctcaaagagacacctggaccctatgttcattgcagcattattcacaatacccgagatatggaaacaacctaaatatgtgttggtgtttaatgacaatgtggtgtgtatacacaactgaatattattcggctatgaaaatgaaggaaatcctgtcatgtgtgacaacgtggatgaacccaagtcattatgttaagtgaaacgagccaggcacagaaagacagatactgcatgtcactcatgtggaatctaaaacagtcacaactcacagaaacagagtaggacagtggttgccaggggctgggggaatgcagactgtggcgat

SEQ ID NO: 147890 - DNA, 468 bp, Homo sapiens
ttgtatctttccagaaaggagtgaacccaaccacacatgaaagatgaaagatgcttgatattgtaccatctgcatattaaaattactctacgacaaccttcacattaaaaagtccacttctgttcaagagaagacatttttagcaactcaaagtgaaaagcagagagaaccagaacatcttaaaaataaacatactgaaaaaacaaaaactactccctgttaatttaactgaaatataacccattggtattttgttaaattagcaaataaaaaggtcacaagcaattaaatgaaacaaaagccacactgtgttcatctacattaatgctgaactgggtctcctcgtgaatgacaagataaattgttatggtgccttcaaagacttcacaatgtattttgtcaaagtcgggagggttaatgtctctataagccacggattaccataatgtattgtgtcaaaacgctcaa

SEQ ID NO: 147891 - DNA, 951 bp, Homo sapiens
acttgagttctgtctttatttcttaaatatccagagatgggaactgagaaaaaaagtactcttgcaaaagtggtaaataacatgatccaggctacctgctcaaacaacctgtttgtttcctctatctctgtccatacttaatcctgcatgcaccgcttctattttaagacacatgactgtggaactctatgatttatgacttggtgactttacagtcaccaagttaccagaaaccagcattagatggtcaattccagtcccaaatctcagtcatatgttatcacatgatccatatctccatctctattagaacccaatagtgttgtttttttaaaaggaatacaattgtccactaaaagtggcatggtctccctccagaatgctggtggacttgcctcaaactccacatggtgtttttcctagcattgctactttcaataccacagtgcaagaactgtaggcattacagcccagttcttctgccaaaaactttcttgttcttgtccacctcagagctggaagccttttatgtcacccaggttatagtttgctcagtattcccaggtgtggaatatggctttctccaaggatgaagagacatactctgtggtgaccttcttttttgtgtactttgggtactttggtggggatatcctagcaaccatccactggactcgtaataattttataggtactgtaggcccatgagtacttatacaatttgtcactccctttcagaagtacacatttcttactgaggcctcaaatgcactagccatttcttgttcaccttgtctaattagcatgatgtcattgatggagttgaccaatgtgatgttctgcaggatgttcaggctgtctagaactctttagactatgttatgacaagaggtggggcagagattaaccccaaacatccgagtgagtataaacagtctctgattttttttt

SEQ ID NO: 147892 - DNA, 519 bp, Homo sapiens
tatggatataaacttctaatatgaggaagagacccaaaccaattcaaatagcatgttaaaattcaatctatctacaatcttcacgtccttgattattacattctgtaatctcatgggtatttttgcttccaaatataaggacatacctattatttccttcagttttctttttaggagagttgactgaactatttcaggaaagaagatgtcttactttcctttgcctagtaagccttgctgctttttgaacacagtgcattttcttcaaaatatacccactactttaggtggtcttaatgaatgaataatatgtaattgtgtatacttttctaaaattctttgaaacttccaggaaggaaggtctcattaaatatctatttgaattttagtgaaaagaacaaaaaaaagcaataacaaattaagacctttgattcatgtgtactagcagtggttttattttggtagctagtgctgtgatgtaattgaagcagtattttcatatagaagcattttttactt

SEQ ID NO: 147893 - DNA, 436 bp, Homo sapiens
cacagattctagagcactgtctcagattccatcaaccccatcaaccccttgagcttctgctgacaggtttaaggcaatgatccagaagtatggaggagtcagctccctctggagggccttgattagtgaaatgcagaggacaggagggagcctggcaggcaagcgccccctcctgtctccctcctgtgaactcctctcagccatggttttgccttgcatgccttccagagaagacacacaggttgtctggcaaatgtgttcggctaagtaaatgcacttggcaaacactccgtgtgtcctcctggctcactgtgaagcctgcggtgaggtaatgcattacatcacattgctatgcatcgttccttgcttcatttacctttttcctcgccctcacctctctgttcttacatatcccaaataaaataccagtgcttac

SEQ ID NO: 147894 - DNA, 260 bp, Homo sapiens
gaattaggtggttatcataagattttctcttacttgtcatttcatttgcttttatttaaattattttttcctgcagcttcattcttatgtgaaagcatgatcgtaatataaacagagttgcagcactaatcacgttgacactgcagatgggtctaaccttattcgtagtcccaagtaattgccacaatgcaaattttagcacctatctctatcgtatattactgctttgtagttaacgtttttcctctgatgagttccaa

SEQ ID NO: 147895 - DNA, 345 bp, Homo sapiens
atcctattgcttgataataatgacaatttaaaaattacgattcagtgccctagggaccaagtaatttgttttttgttgaaaaactcagttaatgcaaggatccactaaaacagataactcccttaaacattttatttcaattaaaacatatatatgtatatattcatttgccaatctttctagagagggccttcttttgagtacaaatctgcagattagcgtttgctgtgggcttttttcacacttgtaaacaacacccaatttctgtttcttccaaatgaaagcaaagatacttgtgaaaataatcagagcccaaaagccatctagatttttctcaattttttc

SEQ ID NO: 147896 - DNA, 266 bp, Homo sapiens
gagaaaatgcctggaagtggatcccaaagatgctggatcaagaatggggaataggaagtcaggaaagggacactttgttgttatagtaatactgtgcagtgacataggatttgacaccctggcagtgaccctggaatgactgttagaagcttggctttcctagtatttctgtgacattaatcacattttaatcacaacttccatatctgtaaaatggaggactgggacaatattgattatttttaaaaaactgttattttaggttt

SEQ ID NO: 147897 - DNA, 499 bp, Homo sapiens
cattgttccagaaaagagttggggaatacatacataaaatttcaatataaatcaatacatgtttatcaaatttaaatacacatagcttttcacccagcatgtcccaatctggtaatttgccctaaattagtgcttctcaactagggcaattttttcctccatgagacacttggcgatgtctacggatactttttccctgtcatgcatggggcaggggtggtgagtggggagcagagttataggcatctagcaggtacagaccagggatgctgcaaaatatcccacaaatcacagcacagtctcccacaagaaaaaactagtcagccccaaacaaaaataagctgatgctgagaaactgtccttaggaaatagacaggcttgcaactatgcatatacaagctttttgtatacaatctcgtgtatccaaccaagtagaaatggttagataaactgcgatatatttatacatagctataaagtaataataatgttgctatat

SEQ ID NO: 147898 - DNA, 347 bp, Homo sapiens
gtggtgatagtggtatctgtggtaatggtgataaggggcagaatgaagtatccagcataatcaactgagagacacaatattgttagttgtaagatgacattcttctgtatacattcttttcaaagcaggaacacaatgttggaaaggaaattataaacccaatactagatcaggtgacacttaaggtctagatttcagcttttctattaagcgaaaacttagaacatgtcagttttcagaatagaaatgtttatttccgtatctgaattttaaaatgcattgtgcatatgttctgccacttaaaagtaacaatcttttccatttttctcattttattacaaattgca

SEQ ID NO: 147899 - DNA, 224 bp, Homo sapiens
aattctcatccttccaatatatctactactttgacacaactatccttctacctggctagttttatatcatcctgaccttatttatcaaatggtatgggtctagtgggtgtgtattttcacattcattcatattctttttctctctttccttccacgcttaccctatcctgaactttccaaagcaaaaccctgtgtgctttcagaaatcctactaggtcttctca

SEQ ID NO: 147900 - DNA, 298 bp, Homo sapiens
gtctcccaagcaactaccccaagacataccaacagtgaagccaggacagcaccatgccatcggcgctccagtctgtctggctgggaggaaagtgctgggcatcttacagtaactctagaagttcctctgactaggctgcaatcccacctatatgctcagccctaagagctgtggtttcctgtgctctcatttgtccattcattcattcattcattcattcattcattcagcaaataatctgaaatccagtctgaactaaggcctgagctgtggataccatggcgcgtgagttagatgt

SEQ ID NO: 147901 - DNA, 577 bp, Homo sapiens
aacctctgcaaacttttcttctgcagtttcctcacctctgtcagcattcacagaattgaagagagttcagattttgctctggattagtttggcttaagggaatgttgtggctggtttgatcttctatccagaccactcagaccttgtccatatcagcattaggctgttttgctttcttatcattcctgtgttcactagagtagcacttttaatttacttcaagaacttttcctttgcattcacaacttggctgtatggcacaagaggcctagcttttgatgattgccagaatagtaagacagaatttaaaatggttccatggttgatcagatgggagattggtgggagtagggaacacaaaaggcatgggaaaagaagataggttgtattttggtcatactgacaccaacatgcctaaaggatagccctgtgaaaaaagctagcagacagttgaactgcggctgtgaaacaggaagccgtgagggctagactcatcgttgtagtcattcgtaaagagtaaatacttggagctattgtagtagatggtatcaccacggaatggtgagggagctgcaaa

SEQ ID NO: 147902 - DNA, 673 bp, Homo sapiens
atatttcttaatagaaaaggcacaatgtaaaatgtctaccatttaaaaccaaaactcagtatctgcaactgttccgattgggaagcacagcacatttccgggttcagctcaggaagtaaagcctacacttacatctcggatgctctcaaggggcagaggtgcagtcagtgtgcccaaggcctgttcctggcttcagctcaccctaaggtccccacatctccctcagaacaggctcacctcttggcaatccctgccctggtgctctgtcttgggaggcaagtggcaggcaggagtagcgaccctgaacagacagtgttatccttccctcctcgtgactgttcttcagggcttccacacgcacaggcacctgtccgacctatccatttatgattcacacctgctctcatgaaaggcacctgcggcccatcaagaaatacgattccaaggagaaactaataactactctagtagaggatcattataagttgtagggaaaaataattaggcactgcttccaacatttatgaagactaccctaaaagttctccatatcattcaggggaaatggctacgctcatgtaaaaccatccagtcattccatttatcattccactataaaaacaagggctgccgcaagtctgcctgaaactcctaagcctgaggaaaatcaatt

SEQ ID NO: 147903 - DNA, 212 bp, Homo sapiens
attctgggatatgaatgagcatctttaagtctactgttgagacctcaatacaggaagtataaattttagacctaagatctgaataatcatctagctttgtatcagaaatgttagcagcaatacaaaaacaaagcatggtttccaggtaattataaatgctgggtgtgactgagatactgggataggacagcatcaggtcagactaccaataa

SEQ ID NO: 147904 - DNA, 361 bp, Homo sapiens
gattgaatatggcacaattaatgtttcagcacttctcggcttttctctaaaatatttcaatgggcttttaatttattgcagctcttgattagcagggttgaggcagggttactgctgacctcctgggccaaggtacttctggggctgtagtgaagtggaaaagaacaaaggtttgatagtgttctcagctggagcctcccagggatgagcccctgggggttcactgaataattccttcccctaaagtagtcagagagcaatgcagtgttcttcagatctttatcagagttacctggggtatctgttgggtagaacagcagattcctggaacttgtttaagaatctctggactatggagggt

SEQ ID NO: 147905 - DNA, 129 bp, Homo sapiens
ttcgctgatgtaatttctttaaaacctcatcagcaaacatatgtttcttgaatggttcatatctcagccttaaaatgaattgtagtttgtagctttggaggagaaattgctttgcatttatatcaaaat

SEQ ID NO: 147906 - DNA, 240 bp, Homo sapiens
ttaattgccaacattttaaaattttgaagacttcacataaaaattcagatctctagtatctctttttaaaatgagaaaatatgcaaacagtgaacctacattttcacctagtaaccattcagcctctcatagatggttccagtgtccccatggttcccaaggccaaggccaaatatcagccagcactaatcctgagtcatggcatggtgttacctggctgaatcctgcaggcacttgagt

SEQ ID NO: 147907 - DNA, 264 bp, Homo sapiens
tcccaaagtgggctaggtcaggggcagggccatgggccatggggttgggggaggtgaagcaggtacagagcaaggcagagccttaggagctctccctttggggccccccagggcagacaggatagagattgggtgtcataggaagagcagggactgagggggtagagacactggtgggagacagacagggggacaaacagcaggacaacacagaaaacatggggtccccagaactgggttcccaggacagacagccaacaagcc

SEQ ID NO: 147908 - DNA, 591 bp, Homo sapiens
tcacacatgttcatatacacattctatacttctcaccatcctgtgtcttgtgcacactcacacatgcacacaccacacattctatacttctactatcctgtgtcctacttttcagcccaaacctctaagctcaaattctatttccagaaatcgtttttggtgcctctggcccacaggagcccctctgtctcaacgctttatacttccatgaattttcggcctgctgctcagcggctgactgctgaggcctgcaatgatatgcaagggaacttggctggctaattttgaattttcctttctccagggccatggcaagaggaatatgggcagaggggggaatcagtgctttgtttcagggcaactgccatacataaccactgtcttcaaataaaagcctttcacaagtaggtttccattacacagcaagtcgaggaggagctggtgaaatcagtgagttaggtgagtcccccccatcctcaggatcttttgttatggtggtggtggtaatggcggtgatagtggtgataaagaggaggggatgttgcccttaacgtagtactggcatattacatagctcttccatacaggtca

SEQ ID NO: 147909 - DNA, 229 bp, Homo sapiens
ctaggctgtgggtggggaagatagaactggagcctgagaaactgcaagccctttgaagacagaagccatgagaatcaacatgccaattcttggcaatccacttacccacaaccaacattcaccagcatggttgtactgattgctaaaatgttaaaatatttccaaattaagggtgccatgagccccctttgtgcaccatcctgatgcctgtcctagcccctttaatctc

SEQ ID NO: 147910 - DNA, 248 bp, Homo sapiens
acattcttaacaccccttttgaggtgtcctttttctcctaattcctctttggagctggtgggtgggcattttctttcacccctaacaggtctgctactattaataagcaagccccggttcactcctgtaaaccgtgtgattaggccacgacagtccctctggttcctctaatttgagtgttaaggtcaagagggcgccactggcatgagatggccaaactggcgactggaaacctttccttttaacca

SEQ ID NO: 147911 - DNA, 350 bp, Homo sapiens
acgattataccgatattactagtttgcaggactgtgtccagagttggttccttccggtgggttcgtggtctccctgacttcaagaatgcagctgtggaccttcctgtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatatagtattttcctcaactttt

SEQ ID NO: 147912 - DNA, 432 bp, Homo sapiens
acgattataccgatattactagtttgcaggactgtgtccagagttggttccttccggtgggttcgtggtctccctgacttcaagaatgcagctgtggaccttcctgaaaatgtgaaactccgaccaagtgcagtggctcatgcctgtaatcccagctcgttgggaggccgaggcaggtggatcacaagtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatatagtattttcctcaactttt

SEQ ID NO: 147913 - DNA, 597 bp, Homo sapiens
catttaatccatcagctgcagaggagaaaaaagaaaaattatgtactcaatatggcctatttctctttataaaccataattgcaagcatcattttatcttcatttgttgcccttttaatacttccattctgagtgatctgcagtttcatttttaccaacactcctcccatctgcctcctctttttctcctctttcttttgcccacataagcaagcacacacatatcgggtacaccccagggcaccaattccagaatagttatcatcgcaaagcttcctgtggcctttcaacagttttctgaacatattttagacactaaaatcatcaagtcatttatgcaagaaacattggctcatggagtgcaaagctctgctgtaaaatcctgtccaccaaagccagtatttatcatgtcagggcactctgactacatgcaaattacagcaaatgaacacagtacccattttcttaaaacataaaagtgttctaatagttcctctgatttgggctgatttcatgagtggccataaattcttcgtataaatttcagtcctttcattagtttctcagttaatgtggatgatttactgccttgttctg

SEQ ID NO: 147914 - DNA, 277 bp, Homo sapiens
gctccttgatactgacttcctgcctccagcactgtgaggagtaagtgtttgttgtttaaggtacccagtttatggcatttttgttatagcagcctgaagtgactaagacacccctccttgaaaaaatctgacatgcacaccctcatattctgagattccatgactcacctgggacataaacatgtcccttcctctctgcagtccccacattatgccgtggaacacatgggcctggacatctatgtcctcgccacccagtgggaatatacatctttct

SEQ ID NO: 147915 - DNA, 319 bp, Homo sapiens
aaattagccgggtgtggtggcggtcgcctgtaattccagctattcgggaggctgaggcaggagaattgcttgaacccgcatgcggaggttgctttgagccgagtttgcaccactgcactccagcctgggcgacagaatgagaccccgtctcaaaaaaaaaaaaaaaagaaagaaagaaattatatttcctggctaagcgcggtggctcacgcctgtaatcccaacactttgcaagaaaaaagaaaattctttttcctgacccatccatctagcatcccacctgactattcagtttagttcatctgaaatttattgagct

SEQ ID NO: 147916 - DNA, 292 bp, Homo sapiens
aagagatgctagggcaagagggaggggtgatgtagatgattcaagattgttttccctaccctcttcagtgcctctttcagtaataaaatggcaaaaccaggtactgtgatttctgacctgatttttgattcttataatggtgctttttttgtgtgtagttagttgttaaaatttggtattcctgcaaggagggtgatcggtggaggcttctattcagccacattgctccatcaactctttttttccaaatgccatcacattcacagttctgggagatatgatttggacatac

SEQ ID NO: 147917 - DNA, 310 bp, Homo sapiens
ttttccatgttggccaggctagtcttgaactctagtcctcaagtgatctgcccgccatggcctcccaaagtgctgggattacaggcatgagccaccaggcccggccttgcttggtgtttttgatcaatcctttggatttctgggctgcccagtccagtgaaaactgactagactagaagcaccatgttggcagggacctggctatttcattcacagctctatccccagtgcctggcatgtggtgggttttcttgttgaatgattggattcaaataacattatccaaagaattttggtctcttggcccaag

SEQ ID NO: 147918 - DNA, 518 bp, Homo sapiens
  misc_feature (499)..(499): n is a, c, g, or t
ccattcttcttcattatggctattctgtgtattttgccactccatataaactttagcattagtttgtggatatccacagaataattttttgaaattttgattgggattgcattgcatctatagatcaagttgagaagaactgacatcttgacaatattgagtcttcttatccatgagcattgaatatctctccatttatttagttcttctttgatttctttcattagagttttgtagtttttctcatatgtatcttgtacatattttgttaagtttatacataaggatttcattttgggggtactaatgtaaatagtttcgtttttaatttcaaatccctcttgttcattgcttgtatatatgaaagtaattgacctttgtatataaatctcatatcctgaaatcttgctataatcatttattagtttcaggatttttttgttgttgattattttgaattttttgcatagaaaatcatgtcatctgcaaacaaacacangtttttgttcttattaata

SEQ ID NO: 147919 - DNA, 343 bp, Homo sapiens
aagctctctgtgcctcagggtctgccacctatgaagaaagagtgaaaatgttcccctctcccagggccagctgaggattacatgagttaggacacatgaaatgcctccaacaggacctggcacacaggatgtgctcaactgttagctagtcttattaaatgggtttttaagttagcatttagtactcaagagaggcctctggagtcctcaaatcgttggtgcttttccagctcttcaccctctcttcacagcagttccttaaagagcgctgccctacgggttgctggggaatgaaggccatgccctgtaaagcacctgcccatcgtggtgctgaccaccacca

SEQ ID NO: 147920 - DNA, 382 bp, Homo sapiens
acatcacgaccattcacatcccatgggccatagcttttcacatggccaagtccaaagtgattgaggtgggatatgtactcctctcacagaatgcacgagtacctcccatgacagtgggtaggaatatgcaatcctatggctgggaggaagcaaatagttggggacaataacccaacagatcacacccccaatgcctctatctaagttctaaatacaacatttcccgtagagaggaagccactctgcctcctccactgcatcttcctttcctgcccctctcagcttgagctcaggctccaaaacttgagcgtgataagaatcatctaagtgcttgttaaaaatccccttcctagggcccccctttccaaagatcttgacacat

SEQ ID NO: 147921 - DNA, 390 bp, Homo sapiens
gctgccaaagaccatgcttccatccgtaagttccccagataaatcaccctttaccaaaaaaactggattttgtccttgttctttggtttcttgtctcctcctgtatttgggggtcactttgtgtatgtggccctttcttggaacactatctcagaggccccttcagattagaaactgtctcacactttcttaggaaaacattttgatatcagcaaacatttccttgaatttaatctaaacctgtcattcttcagctccaacaaatctcctcttattcaagtctccattaagataaagtataggctgtcataggcttgggcataatcatgtgtgtgatatttagtgtatttgcaagtaattgtcaagccttccacagtcatcccactcagg

SEQ ID NO: 147922 - DNA, 254 bp, Homo sapiens
cgtgctagcagcaatattgctctttaatgcaccaaggtgtttctatacatgcacatcaaggcacagcacctttccttaaacttatttatgacacagagatctttgttcacatgtttcctgctgaccctctccccactattgccctattgtcctgccacatcctcctctccgagatggtagagataatgatcaataaatactgagggaactcagagaccagtgcctgccggtcctccgtaaactgtaagctgagt

SEQ ID NO: 147923 - DNA, 442 bp, Homo sapiens
caggctagtctcaacctactgggctcaagctgtgctgccacctcagcctcctgagtagccgggactattggcttccctgagaagcctgatgctttagtggggaaggtgtttagagaccaagacgtgggtgctggggtgcccgttactactggggtgctgcagcttctcagcccctcagccggcagagttaggaaatacatggctgttcaggaagccacgcaatggggaggaatgaactgtggacagctggggaccctcgtaggccacagtgcaccgtgccagtgttagcagctgccacatccgccccacactccttgcccctgctgttttgccatgacgcagatcccaggcatcacattcctgcatttggaaatgcctcctcgtacacctgaagacaggcctttgcaacaacacgacgccaacaccacatcacacccgaaaa

SEQ ID NO: 147924 - DNA, 517 bp, Homo sapiens
  misc_feature (449)..(449): n is a, c, g, or t
gagctcggtacccctcaacgctttatacttcgattagtaagggatttcacatcattcactatttactaatcgaagtagaaggcaaaatgatatgctgaaagcagagatggaggcttaatgagaaaagtgtatgggttgggaagagagtaccataaaagttactgcacagctgtgaagtctcaggtaaagttcttttgcatggtttcttcatggtctagtattgtgaatatttcttccttctacagttctggtgctggggtcactttagaggggccaggtagacaaggtagacaagacacagtctaggcccttaagttcacaggttagtgtatgaggtagaagacatagaaataaattaagtatgttgagttaagggaagtaaaattgggagtcagtggaagacaaatcagaggaggcttcctagagaagtataaagcgttgagctcaangctttatacttccgtatggaattccagtatcatatcaagtttgcatggcgaagtataaagcgttgagg

SEQ ID NO: 147925 - DNA, 209 bp, Homo sapiens
ctggtgctggggtcactttagaggggccaggtagacaaggtagacaagacacagtctaggcccttaagttcacaggttagtgtatgaggtagaagacatagaaataaattaagtatgttgagttaagggaagtaaaattgggagtcagtggaagacaaatcagaggaggcttcctagagaagtggggatagtaaaatttcacgtagaat

SEQ ID NO: 147926 - DNA, 315 bp, Homo sapiens
acagaaaaagactccatctcagaaagcacacaaaaaaaagaagaaaatgtttgttcatcctgcctttaattccttattacaaggcgtgaatttttattgttttttttgagacagtctggctctgtcatccggggtggagtgcagtggcgtcttcacagctaggcacaacctcgacctcccaggctctcaagtagctgggaccgcaagcgccactacactggccagctatttttctttttttttttttttttcggtagagagtaggtcttgctgtgttgcccaggctggtcttgaactcctgggctcaggcgacct

SEQ ID NO: 147927 - DNA, 922 bp, Homo sapiens
tttcagggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagcatgttttgctgccgctgcaagtgttgtggccgttgtttctcagaacgtctgaggcagcagctgaatcatctcagtgcaagagcttctgagcataacacgaaacccagaagccaaaggaagagccacgcgtgggcccttgtgaaactaaagcttttcgtgtaagacaacacaaacaaaatttaaagacaaatgacggggaaaagaggagaaaatatattacaaaggattagtatccatcataccaaatacccgtgaaccagtcagaaacatcccagggggcaggtggaccaaggatgtgaacaggctagtctcagaagaagaaatacacatgctcatggcccggcactgtggctcacgcctgggatcccagcactttgggaggccgaggcaggtggatcacgaggtcaggagtttgagaccagcctgcccaacatggtgaaaccccgtctctactaaaaatacaaaaattagccaggcgtggtgtacaggcacgcctgtagtcccagctactcaggaggctgaggcaagagaatcgcttgaacccaggaggcggagg

SEQ ID NO: 147928 - DNA, 341 bp, Homo sapiens
gggtatttgggcccagagcatccttcctccacgagaggagaaaaagagcactaggaaagaaaatgtgggactgggggaaatgagagtgagactagggaaagggagggagggaaaggacagggtggtgggaggagcatgtctattgatttcttcaacacatgtgtattaggtgccacctctgtgccagcacctggacctggggagacagtcatattcagatggatgacttctgccttcatgacactttcacactagtgagctggctagcatttatcaagcgtcctctttctgtcaagcactttacacgctcttttggattgggctttccagcagcagacact

SEQ ID NO: 147929 - DNA, 231 bp, Homo sapiens
ctttccaaaaaacagggtattaaagcataatttttagttaaaaaaaatcaatgtgatatgtttatgagtgacattagtaagatggcagaggaagactttccaggactccagcttgcagacacattaatttgaaccactatccatacacaaaaacatcttcacaaaagttaaagaaaccaggtaagacattacagcacgtgaatacagcacagaaataaaaagaggcacatt

SEQ ID NO: 147930 - DNA, 196 bp, Homo sapiens
tgctgggattacaggtgtgagccaccgcacccattcccagccaaacaaattactattaattaagggcagttaatgagaactagaaagcactttttggataagatattctttttgctattataagatttgttgagtagtaatttgccctaagcagattaccctcaataagttcccatctctcattcttcacaggaag

SEQ ID NO: 147931 - DNA, 184 bp, Homo sapiens
ccttgtgccctgtgctggcaggtcctcccgagagctgaaggtgccttaggacccaggcccatggctgctgacctccactgatcaagggaggcctgatgaatgggggttttctaagtgggatcacatctctcctcaggtcacagtgcccaagaaagggtcacagcttccccctctgattgggtct

SEQ ID NO: 147932 - DNA, 784 bp, Homo sapiens
gttagtttccaggaggcgagagttcaggtgcaacgtctttcaagaggagggcttgcctttaaaggtcctgacaggcactgctgaccctaactaactgcccaccccaaccagggagggaggggctgcgagggatgcgatgagggcctcagaagaagggcgcaaccaacaaaaaccccaaggaatttagaggcatttaaattggttcatgctccaccaaagactttcttttctatagtccatttggcccatttagtatcacagagactacctcctcccacttcagagccacccagccccaaagctaggctgaccatgcaacttggctggcaccagggcaggcctggactatatatggcctggataaaggccaatggccttgtcactttacatcctggattttctgggacggtcttgattccccttaccctctgggattgttctctgccccctctgtcccttgccctctgagaggttggagcccttatccaggcctcagggaaagagctgcaggccaaggaagcattactttttatggctctaagtgcttctgactaaatccagtcccctgataacggtggcctctcagagctgctccttccctgcagttcagcctgatgtgaagcttggggaggtgaccttctccctgcaacacgcgaggcactgccaaggggctgctatgatgtgggatctgcagaaatcctttgttcctagttggctttccatctttgcctctctgtatctctccctgcctggctggtttctctgaagagatcagctggtttcc

SEQ ID NO: 147933 - DNA, 584 bp, Homo sapiens
cctttcttaagaattgatagagatttgatcaagatgcctagtatggaaggacactgttcatcttagaggcttcttaaattaaagaagaaaaatgtggccaggcacagtggctaacacctgtaatcccagcactttgggaggctgaggcgggtggatcacctgaagtcaggagttcgagaccagcctggccaacatggtgaaaccccatctctactaaaaatacaaaaaatgagctgggcatggtggcaggtgcctgtaatcccagctactcgggaggctgaggcaggagaatcgcttgaacccaggaggcgaaggttgcagtgagccatgatcacaccattgcactccagctgggtgacaagagcaagaccctgtctcaaaaaaaaaaaaaagaaaagaaaaattcaataggaatgtcacacttcatgatagaacagaacttagtgagattattttgttatgaacccatcagagaggttttagttactgaaggtactttattttacaaggcagtgaattgggttcatagttagagaaccatcagagtagccacatagcaaagccctattgtggttatcccaggg

SEQ ID NO: 147934 - DNA, 428 bp, Homo sapiens
ggagttggaggctgcagtgatcgtgccactgcactccagccttggtgacagagcaagagaccctgtctcaaagaaaaagacagataagtccttgggagtctcagacggaggacatacatagagaatgaacaagaagcagtaaccaaagagataatggctgaaaattttccataaagacttccacagacttcaactccccagattgaaggaacaaactgaagtcagagtagggtaaataaaaataaatatatatacataaaaaaagctcactacattagtacatagaaaccagaaaaaaatatgtcagatagttacaaaagtggtataattaggttgacttcattttttaaattggatatacaaaatttaacagttaaaaaaatcatcagtcaagcgaaatgtcaacaccacataacatagattaaaag

SEQ ID NO: 147935 - DNA, 404 bp, Homo sapiens
taatttggtgtggcagtgattttactggaagcctgtttgaagtatagtggcaatgaaagagaaaaaaaatccctggtcagtctagaaagacttcacaggagacattgacctgagatgtacaggttgtataggaattttcattgagatggtttcaaagagattcagtctggggatgttactggaaaaggggtcccaatccagaccccaagagaaggttcttggatctcacacaagaaagaattcagggcgagtccaaaaagtgaaagcaagtttattaagaaggtggaggaataaagaatgactcctccacacacagcagccccaagggctgcgggttacccatttttatggttatttcttgatgatatgctaaacgaggggtggattattcatgcctccccttt

SEQ ID NO: 147936 - DNA, 287 bp, Homo sapiens
ggtcttgaactcctgagctcaagcaatccacccacttcgtcctcccaaaatgctagggctataatgttgagaggttctttgtggaacaggctgccttttgataagttgtttgtgttcataagggaataaaaatgtcatcccttccagtactctcccaattttgttggtgcaaggtcttcagaatatttgggatccatgaaaacaatatagagggatgtttgtatgaatcccctaaggctattatgtgttatttattttgtccttggtgcctagccagcatagatgga

SEQ ID NO: 147937 - DNA, 236 bp, Homo sapiens
acactgaagtcttgagatcacctagctggtgagtggagcactgagatttcaacacaggcaatataaagccagaacacatgcattcaaccagagcatttcatggcccatgtgtggtgtgtagaaaaaatgagccaaaacttagaaacaaggcaaatggaaggagacaagtccctttgggcctccccaaggattattaacagtccaggaaaatgtgcccttgttcggcttgctgtcca

SEQ ID NO: 147938 - DNA, 247 bp, Homo sapiens
gacttagagtttggtgggaagcagagagctgggttttaagaacatgaatctgacaactctatggatctggaggagaagctaactggggacgaggagcagtaagaagcctgttacagatgcactgataagaagtaatgagagctggccgggcacagtaatagacaattaatacaatatctgaggtgtaattcatcactttctttcccaaaaccactcatttcctatttgtgttaatagaaaaagccca

SEQ ID NO: 147939 - DNA, 367 bp, Homo sapiens
aattgttgagcatttttatcatgaactatgttgaattttgtcaaataacttttttttgcaccgattgagatgagcatgtggttttggtccttcaccatgtcagtgtggtgtattacattgactttcttctgttgaaccactcttgtcttcccagtgtgtagtccacttggtcatggactataatcctgttaatgtctttacaatttggtttcctagtattttgttgagggcttttgcatcagtgtttatcacgaataatatcttacacttttgtttccttgtcatatatttgcttgggtggtgtcagactaagggtggtatcatacaattgttttttgttgtttcctcttcttcacttatttggaat

SEQ ID NO: 147940 - DNA, 338 bp, Homo sapiens
tgctcatcccggcagcaggcagctggggacgcccatgggagtctggaatttttttttctgggccgcttggttttccccagtagacagaggtgactcacaggctggcaggctaagtggctcaggggatcatgagagccccgatgctgcggtgcaaagttccaggaattcagaaaccaaaatgcctggggcaggagaaagggcaagacttagcccccaccaggaagaccagggagaaaaggtaactccagctccactgttgaggggacactttggaagaaatcgggatgtctacttagctgctagtaataataacaataaaaacaacaccaccaccagct

SEQ ID NO: 147941 - DNA, 334 bp, Homo sapiens
atgaggaactggtttgtgactcaggaaactgaagtcacagagttcttaagttctgagaaaaatgggtcactgtgtttggtgctggacaggacacggggcctgcaggcgaggagccaggcctcaagggttcagtgagttgtccaagccagcgtgactaagggttccgctgggacctctcagattaacttccaagaaggaaagccgctccttgcgcatacactttttcttaactctccccggctggtaaactcaggtggcatcgaggccttggcgtctaccccttggtgacacccccatcaggataacgccttggctgtgtctccctaagacccta

SEQ ID NO: 147942 - DNA, 187 bp, Homo sapiens
cctgttatggcagtggcatgaacatggctcagccctaaggatggcatgttgaaaactcaaaactaaccctcctcccattttacagaggaggaaatggtggctcagagtgtgtgagggactacaaggacagggtcaatgtcttgttcatgtatgtatttcctgacctccactatgtcctgccattaaa

SEQ ID NO: 147943 - DNA, 393 bp, Homo sapiens
aagaatgtttttctcaataataaatacagccatctgatggggcagggacaagcagaatggcatagataatgacaagactgaaaataaaaagtgaagtcagatgactaaaggacccaccaaatattagatttcagagcttgaattttatccaatatgtaatggagaattattgaccttttaaagctggaaaatgacatgaagaaattagtttgcgggaaatatatctgggtagtagaagcatggaatggtgaatagtgactggtgcagaaaacaatgttatctaggacaagagtcagaagatttttttaatgacatgataaaggtctgaaggaaacgtgcaaaatattacaaaggaagaatgggcagggcttagtgagggaagggcctctgtga

SEQ ID NO: 147944 - DNA, 310 bp, Homo sapiens
ggagtctgtgataccccaaatcagtgggtcacaggtgttggaatttccaaagagtccttcttggttttctgggttctggaaatgggccaggaaaagccaggataaagctatgttccccgacctcgaatggaagcttctggctttctctaaatgggtgctccagaaagacaaatgctggggagaagatgatattctttgatggtgatcatgctttatgatgatctttctccttttgtacccacatgtctaatctattctaagtctcaagtgggtttttccttttttcaaaaaatttttttggagacaaaga

SEQ ID NO: 147945 - DNA, 368 bp, Homo sapiens
cttaaaagaaactaaccctgcctgacgccttcaactcagacttctgtcctccagattgtgagaaaatacatttctgttatttaagccacccaatctttggcactttgttatggcagcccttcctaacaagctcatacacctttatattatgaaacattttagagaaataataaaatggacctctatatgcctgtcacatggttgccataattttcaatgtttttccattcttatttcatctatccctcaacttttccccctggattatgtaaagtaaatcccagatattatgatattctatccttaaatacctgagtaatatttgaatgctcaaagaggacagctcatatttattgtgggcaaataca

SEQ ID NO: 147946 - DNA, 510 bp, Homo sapiens
ttctacatcccacctcctcgcctatgctgaatgcaccatcacacagggattacacagtgaaaatgcaaacccacgcctgattctaaataagagaagggaagaaaatccaaaggaacactaagaccaagaaaaatacagacagagaccagtggaaactgacacagagagacagatatggagagagaatgagacagagactgagaccaagagagggaaagaagtgggtggggaaacaggagataatagggacctagaggcctatggaggggtggggaaggggagcaagagatatagatgtgggaagaccaccaggaagggaaagagtggagtgggagactgaggaggaggaggggagagatgagctggggtggaggaaagaagggagttgggaggggaacgtctcaaggatgggaagggagaaggggaggccaagaaaggttaaacattaaaaaggcatcagcagaagctttctgacatgatctgcctttccttttgcttcccagtgcactc

SEQ ID NO: 147947 - DNA, 389 bp, Homo sapiens
ggagacctgaaaacgttcccatgtcattcagtcaaacttttacagacacctccatttaaaacattgtctcccagagaggggagagcaggacagagaggttaagtaaggtcacacagccaatagagaggagttggaatttcagtccaggtttcccactccaagaccacagagaaggagaagcaacacagccagagtggagacaccctcaagcgagcgctggggatgggaaactggtccctggggcatcaaacaggaaacggctggtgctggggccaagctgaaacccaactgttgccaaactcgcagccctgagacaagggctttaaaccgattcagcatcccccagagccgggctcagctttccagctggcttaggctacactgggctg

SEQ ID NO: 147948 - DNA, 299 bp, Homo sapiens
atattgaactgagggccagatgaaagtcacacaggtggactcggatgccagttcctaagtcgggtggcaccataattatgtcttttccaagagtctcttccttgcgatttcagatcatcctttgattattaaccaaaattgacgaaacagtcccagggagtggcctgatttggtcagtgtaacttttcctgggatctgcacccagaggaggtggcatgctccctgttgagagggaaatgctgcctaaagatgaaggagctgccgcccaggctcaccatctggccaggccacagcagcag

SEQ ID NO: 147949 - DNA, 193 bp, Homo sapiens
tggacagtctcaagtgatttcatttacagagactctcacaattgtgacaatgagccatcagttgtgcttgctaatcaagagtagccgagttataatttggcaaccacctttgattgggactcaccttttacttgtctcattccccctttccgttatttctcctaataaattagcagctcatcagcctttgcca

SEQ ID NO: 147950 - DNA, 533 bp, Homo sapiens
tcaggaggccgaggcaggagaattgcttaaacccaggaggtggaggttgcagtaagctgagatcatgccactgcactccagcctgagtgacagagtgagactccgcctcaaaaaaagaaaaaagaaaaccttaacccttacctagcattatgtataaaagttaactcaaaatcataaatctaaatgtgagatctaaaactataaaactcatggaagaaaatgtgtgaaatgttctgtgagatttttagccatgacactaaaagcttgatcccatgaaggaaacagataaactggatttcatcagcgtgaagaactttataatatgctgttgaaaatagcccatatgaacaataggtgaatagataacctgtaagtccataacatagggtagcattcaataataaaaagataagctatcaagcaacaacaagacttgaaggaaccttaaatgcatattgctcaatgaaagaagccaatctgaaaaggttccatactgtatgattctaactatagaacattctggaaaaggcaaa

SEQ ID NO: 147951 - DNA, 356 bp, Homo sapiens
tcacgcccagtccacaacagtggctgttcaccaccctggtgatttgagagtggaggtgggggcaggcagctggttagctggagggcaggtatcacatcaggtgatctagcagtgaggagaggggaagacgagggaggttgcagcacagctgcaaaaggagcaagagagcaatgacagcagaaggctgaagaccagtgagagtggccagggttgcacaggcagaggcttggatttctgcctgccatttcctcttgccctcttcagggtctttagcacagcgcccacctctcaatggacttttattgataaggaattctattctttcagactttcactcttcttgtgtcagaaacacc

SEQ ID NO: 147952 - DNA, 258 bp, Homo sapiens
tgtaacacacaccagtaagtccccataggaaacttttgctatagaagagtctgaagaatccctcattagagcttctaaaagtatttcaggcaggacggtcaatgcgaaaatgaatttgtcaccaaagcagttgtgctacgttgttttattccaggagctgtaattttaggatgttagtattgtgggtggatgtgaaagaaatgaaattatttttccctccacccaaaatcgtaccccagagagcaccagggttgtaaa

SEQ ID NO: 147953 - DNA, 809 bp, Homo sapiens
ctctcagagtgcaggattacaggtgtgagccacgcgcccggactaaggtgagttagtctggacacaaggatggaggactgagggagtgggcagcaaggctgctcagcatggggcccgccacccttgaggcaccacttcagtgaccccttcctgtgcctagaaatgaattttcagggccagagccttgagtcggcttccttccatctacctcgtctttgatctagaaactgaggagggtggggtttccagccttttaaggaaaagaggggactctgcttaggaaaaggtctgactgtctcacgtgtagtgattctaaaactgagcgttggggtcctgtggtgggtggcagcttgaccctttcatttcctcatcgatctttctcccaatgccgttagcattcatcgatgactgttgtttgaattaattatttcattagagattgttgattcttctctcttaatgagatggcagtgagcatgagatgagatttaaactgaccagggtatcggggaaaactgacaacattgatacagcttaggggcatctacagaattcacagaaaaaagcaaagattggcttggctcttgcagttactgtgagcgcctcctgttattaaagttaattaccgtttgcacggtcttctgtggatgttaccctgtcaggttaattttgttatttaagtcttgagttgcagcaatattaaattctgtgcatatgtgctaactctcttttttatgtaacttgggtgcctgttcacctaagttaggagagaatgacctaggtttaggaggtagaattccccgtgatgg

SEQ ID NO: 147954 - DNA, 362 bp, Homo sapiens
gcttaggctactccacaaacagctctttcatctgttcttgcccacaagaatcagagaagtaggttggggttcaggcatccagctcagaacatccaaggtctgccagaaagggctgaacttctgtcctccctgcaccaccaaaatccccatgctgatcgaggagcaaatagatgtcctcccttccctgctcatccttagaggagaacgccaagatccagagaccctgggacgactgtggctgtctttatcactcagccaaagagagaacagcgcaggacgtgagtagacttaagccgccacagctcagctgacagaggaccacttcctttttctctcttttatctgtttgtggaggtagcact

SEQ ID NO: 147955 - DNA, 466 bp, Homo sapiens
gacctcaccagtttccttcgtataaaatcctctgcaagtgtgtgtgtgttgaacataaatgtccgtagggctctgcctttaaaagcaaatttcctctagtctttctcctctggccaggtcaggctataggtctcttatgcccaatgactgtaacagccctaaacatttgtcttaaaaaaggcttttgcaggccgggcggcagtggctcacatttgtaatcccagcactttgggaggcgggcggatcacctgaggtcaggagtttgagaccagcctggccaacatggtgaaatgctgtctctgctgaaaatacaaaaattagctgggtgtggtggtgcgtgcctgtaatcccagctactcgggaggctgaggcacgaggatcgtgtgaacccaggacgtggaggttgcggtgagctgagctggtgccactgcactctggcctgggcaacagagcaagactctgtcta

SEQ ID NO: 147956 - DNA, 694 bp, Homo sapiens
tattttcaaattttctctttttttgtaccatgaaagggggactctggaggaccactggtttgtagaagaggtggtggaatctggattcttgctgggataacttcctgggtagctggttgtgctggaggttcagttcccgtaagaaacaaccatgtgaaggcatcacttggcattttctccaaagtgtctgagttgatggattttatcactcaaaacctgttcacaggtaggtgaattctttcttcctcatctcatcctaactcaagggtagttactctgctatgttgcgatattatcagaactaagctttagaacaaagcaagaatgaggctggttttaaattcttagtccagtgtagatacttgtctctgaaaccctgagtacagaaatctgtcaatataacttgaacaaaccaaatccctgtataaaattttcatgagatgcctttttgcatttacgagattttattaatagaccttgagaatagactcatcaggggattctttcttcattttttcagttggcatgatttttctctgtactacttaagaataccaaaaataaatcactcatctcccactttgcctgttcaaccttgttaacttccttggcaacagtgaaaaaatgagggaggccttggagagttaatttggctctgtgacactaaaatctagattaggaaaatgtgggcctg

SEQ ID NO: 147957 - DNA, 351 bp, Homo sapiens
ggaattcgagaccagcctgggcaacatggtgaagctccgtctctacaaaacattaatacaaaaattagctgggtatggtggtatgcacttgtggtcccagctactttggagactgatgtgggtggatcgtttgagcccaggagttggaggctgcagtgagctatgatcgcgcctctgtgctccagcttgggtgacagagcaagactctgtctcataaaaaagaaaaagattgttagccaagaacagagaatgggaagaaaatgaattctggaagggaaccccccaagtaccatctgacccaggaagggaactgtcatggtgagaggcctacacttaggtgatggaggaaac

SEQ ID NO: 147958 - DNA, 374 bp, Homo sapiens
cttaggcccctcagctggaaaatgggaaatcatatctatctcagcaagttgttcagacatactctggctaaaaggactttatttgcccagtattcacttattcattcaatccacaaatatttataaattgtagtcctcaaaaagcatagaataatcattcccataaaacagaacaggaaaataaaatgatgtaaacatgagttaaatgtaaatctcattcaacaaacatttatggagtttcttctgtgtactaggcaccgtgctacatgctggggacaactgcaaaggtaaatatgccagaatccttgtttttgaagttttctgtcaaatggatgaggagaaaatgaaagagatcacattgtcaatgggtaagt

SEQ ID NO: 147959 - DNA, 412 bp, Homo sapiens
tccaaatcagtttggcagtgagtaaggttaggaactattcacatacattggaataataatagcagcagcagctacagggtcagagacagatctttgagaggccataagcattgaaaagattgtggtacctatcacacaccgtctaaaataaaacaaatattttatttatgggaaaagtgttaaggtgttgataattccaagaaagcttttatttgtcctacaatcattactttgataccttttctgaaatcctagagctgtccccactctgcccatttttttttctcattatggtgatgtctctgggttgctggtgacctgcgtaactattgggaaatctagtttctcaaaacttttagtttttttttagacagggtctcactctgtcactcaggctggagtgcagcggctc

SEQ ID NO: 147960 - DNA, 438 bp, Homo sapiens
tttattaaagttattattacccataagtaaatggtaacaggttttgaattgcatgagtattttcacatttcatatttccttcttcaacacttttctatagtaagacccatagtcaagttaaagaagccttaatgtaagagataacattagacataaaggccaggcgcagtggctcacgcctgtaatcccagcactttgggaggccgagtcgggcagatcacaaggtcaggagatcaagaccatcctggctaatacggtgaaaccccatctctactaaagatacaaaaaagtagccgggcgtggtggtgggcgcctgtagtcccagctactcgggagactgaggcaggagaacggtgtgaacccaggaggcggagcttgcggtaagcccacatcgcgccactgcactccagcctgggtgatggagtgagactccgtctc

SEQ ID NO: 147961 - DNA, 392 bp, Homo sapiens
gttaactcaggtttctgctctggggatgtctgggcacccatcaagctggccgcgtgcacaggtgcagggagagccagaaagcaggagccgatgcagggaggccactggggacagcccaggctgatgcttgggccccatgtgtctccaccacctacaaccctaagcaagcctcagctttcccatctggaaatcaggggtcacagcagtgcctggcacagtagcagcggctgactccatcacagggtggtgtagcctgtgggtacttggcactctctgaggggcaggagctggggggtgaaaggaccctagagcatatgcaacaagagggcagccctggggacacctggggacagaaccctccaaaggtgtcgagtttgggaagagactagaga

SEQ ID NO: 147962 - DNA, 230 bp, Homo sapiens
atttaaaagatgagataaaaatgtaaaaaatgagatctacttgtacaggggaacatttaaatatatctcaagaagaataaggaaacagtaaagaaaaatccaacttcaccaaaacactaaaagagaacttacataatctctaaacaaaatgagcaaaatagtctctctaaaaatggcctcaaaaataagttggaagccgggtgcagtggctcatgcctgtaatcccagca

SEQ ID NO: 147963 - DNA, 282 bp, Homo sapiens
aatgcaacaatcccatgctctactaatgcacactttattgccgtgacagtgacattcatgaagggcagagtagaaccatcataatttaccaccagcagcagcagccacattgtctaccaaagggaaaaaagacacagcacactcctcctggccacttcctcccaagcaggtaggagagtacacattcaacgaggaaagccagagacaacaggcagccaacaaggagtaagtcaacctttcctagcaacactcaatgtcttcatcatgaatgggctctgtagt

SEQ ID NO: 147964 - DNA, 224 bp, Homo sapiens
acaatagcattatacctagagagtaattcagaaagagtagtatccttaaaacattcagtcttctcttttaggaactgtttaaatttacccaagtggactttaatggatttcaaagtttattcacacagttcccacgtacttattatcttacttttttcttgtcattatgaaaaggatttttcttttacttcctaactgctgctattgaaccttctaaaactagg

SEQ ID NO: 147965 - DNA, 751 bp, Homo sapiens
caaagaattctcatcaggttgatcaagagttgaaaagtaaagcactgttcttaaaaactgctctctagaaagatctgcaatggttttgaggactgccaagcaacaggaggtagaaaaatggataactaaataacctcatttacagaaaatatgttaggttaaattgcataggaaaagatagtatgggtctttaaaaaaaatggatatttataacaaagaaaggataaaattaataagtaagttataaggaatatttagaaaaataaaaacagtattctaaaagacaatacttatatctttctaatgtaaatcttagaaaatggtgagaatttcttgtatgctttatatttataagaagtaataatagcttttgaaataattccatattataagaagtcttttcttcatatgtacccaattccaaataagtggatgctggaagaaaatctgtaatttattttatttaaaagaaatgcagtatattaataaatacctattttttggataataaaataagcaacattttccagaatgaggtttttttttgcaacaaatgtgcataccaatgatttgaagtatttaaaagaaacttttctacttgaaaggaaccaagatgactaagtactaattttgcggaatctccaattgggaggatatctactgctcagaaaagcaaactaaaacaagacaagaaattaaaattgacaaaggagaagttccatataatctaattcaaaatcaaatgagtttt

SEQ ID NO: 147966 - DNA, 322 bp, Homo sapiens
tcacaggccagtggggacgggcaggctatcagggatggcaccgggatgagcaactccttatatggacaacaatcaaattagatccctcttcacagtgtgaactcttcctggaacatgccagggtactgaaaaacgaaagctagtatttatgctataatgtgggctggcccgtgctgcccagcagaactctcagctgcctctcagctgtctgtgttgtccagggtggcagcctctggctgctcatggtgctgaatggcacttgaagtgtggctcatgcagccagggagctgctgatttaattgaactgaaatagctaccctgg

SEQ ID NO: 147967 - DNA, 308 bp, Homo sapiens
tttttttgagatggagtctcgctccgtcacccaggctggagttggcatccacactggacagctgcactgtcccttctccttcactgtcccgtgcatgtagttgatgtttgtaatcccccaacagggcctgacgcagaagtctgtggacagtggctgtagggtgtatgaaagcactacagcctgccccatccccatagtgcgggccactacccaccacacctgccagcagtgggctggctccgggctggaagctgccccaacaccatgcccaaccctggccttccccagccagcatcccatggaaggct

SEQ ID NO: 147968 - DNA, 1110 bp, Homo sapiens
tccccggaacattggaggggaatgtggctaggccagcctgacgctgctgcgtcaacctctggctcgttctcggcctctatcgcttccagggacccttctatctgggctcagctgacccgccccgcctctcggcccacgtgccggcagttctcccaggctggggctcagctgcgctggagactgggatgggtcagctcagtgtctctgtctgtttacaaaggaggaacccaggtgcactaaggtaacttcgctactctgctagagtctcaccccgatccctgcgccatttcccttccacctcctgcactgttaagccttgggctgtgagatgggccagtgtagcccggctactgccgtgttccctgggtcagggacagctgcctcactgggagcgccttagaaatgtagaatcttggccaggaatctggagcctgtaatcccagcactttgggaggccggggtgggagaatctcttgagcctgggaggtcgagaccagcctggacaacacagtgagaccttgtctctacaaaaaataaaaaaattagctgggtgtggtagcacacgcctgtagtcccagctacttgggaggctgaagtgagaggatcccttgagcccaggaggttgaggctgcagtgagccatgattgtgccaccaaactccagcctgggtaacaaagcaagaccctgtctcaaaaaaaataaaaaagaaatgaagaatctcaggccccaccccacacctgctgaatggcaatctgcatttgaacaagatccccagagattcctgactgcattaaagtaggaagtagaatcactggcttaactctgtgccttagtttcctcatctgtaaaacagggctgctaaaagtgcctcccctgttgggtcgatgtttacgtgcatgtagttgatgtttgtaatcccccaacagggcctgacgcagaagtctgtggacagtggctgtagggtgtatgaaagcactacagcctgccccatccccatagtgcgggccactacccaccacacctgccagcagtgggctggctccgggctggaagctgccccaacaccatgcccaaccctggccttccccagccagcatcccatggaaggct

SEQ ID NO: 147969 - DNA, 1332 bp, Homo sapiens
gcttcgggcttccaaagtgctctcattatgttggctaggtggccttgaactcctaagctcaaacgaggtgagtagaagaataaaggatggtacaataggcccaccacctgtttttataaataaagttttactggaaggtggccctgaccccactcagtcacagtgctgagtcatgcttctctttagggcagaggtcagcaaacctttgctttgaagggctggatagtaaatattttaggctttccaggctgtaatattacagtctgtgcctgaactatttcactctgctcttgtagcaaaagcagccacagacaataaggaaaggagtgtgggcaaggctgccttccagtaaaactttatttataaaaacaggtggtgggcctattgtaccatcctttattcttctactcacctcgtgaacgaactcctcttcatccttcagaaccccccccccccaccttttttttcttcacgatggagtctcactctgtcgcccaggccagaatgcagtggcatgattgcggctcgctacaaccttcacctcccagattcaagcgattctcctgcctcagcctcccaagtagctgggattacaggcacccaccaccgtgcccggctaatttttgtatttttagtacagacagggtttcaccatgttggtcaggctggtcttgaactcctgacctcaagcagtccacccgccttggcctcccaaagtgctcggattacaagcgtgagcgaccgcgcctggtcttagaacccctcttagatattcctactcccctaatgtcttctcttgtcctttaggataatcactcctgctgtgtgtcttttaactgctgcgctggattcacgtctacactcacgtctgtttgcataccagtctctcctgcctggctttgggcctcatcttcacaccctcagccattcttggttgactcatgccgcatttatggctcttgatccaagcccctaggtgggctggcaccagcatttctttttcttgcaaccttcagaagcaaatgcactttttaggaataaacttggccgggcacagtcactcatccctataatctcagcactctagggggcctaggcaggtggatcatttgagcccaggagtttgacaacaacctgggcaatatagtgaggcccccatctctacagaaaatacagaaacattagccagcatgcatcgtggtgtgcacctatagtcccagctacttgtgaggcagaggtgagaggatcacatgagcccagggagatcaagtctgcagtgagccgtgatcatgccaatgcaccccagcctgggaagtagagcaagaccctgac

SEQ ID NO: 147970 - DNA, 555 bp, Homo sapiens
gtacatggaaccatcagaaagcaaagatgtctctgtctcagctacccatgtcataggtcttggctccatgtggagcatcattgggaacctgctgttagcatgtgtagcctacacacgtgccattttattaccctttgtggatgtgcttgtgtgagggaatctgggtgtgcacagaaaagatatattgaagctgatggcagactggaacggtccttttccccttggagacactgaataaactgtgtattgtatgcctgcatttccacatgtcaggtttggaattctctatggcatcatgttggtgctcagaaagttttggattttggattttcagattagggatgctcaacctgtataagaagccagctcacaaaaaaatagccttaaggagttacttttgggcaaataccattattattcttaaaaacaatacagtagcaaataaagggatgttgctgaccttgcagttaatgttaaagctgcaaagatatcgcacaaataaaagtgttttacttttgaaaaaaattgtcatatacccactgtttttatatttgt

SEQ ID NO: 147971 - DNA, 252 bp, Homo sapiens
acgagagaatctagagaagacgcgggggaccctcatctgcgtgtaaggcataaagcacggactccgactcgaagcaaagaaacttatcttacctgccagttgaatgccccttgtagctatacggtatgtaagagattgatttttgtatgtttgactgctacagattgttcagagttctccatcactcaccacagaataaaccagcattgaatcatttcattaagcatgcctgaactcatcttgtcagtttgt

SEQ ID NO: 147972 - DNA, 228 bp, Homo sapiens
tgtgtttgccaagctatttctaaatctaaaggctttagtccgactcgaagcaaagaaacttatcttacctgccagttgaatgccccttgtagctatacggtatgtaagagattgatttttgtatgtttgactgctacagattgttcagagttctccatcactcaccacagaataaaccagcattgaatcatttcattaagcatgcctgaactcatcttgtcagtttgt

SEQ ID NO: 147973 - DNA, 415 bp, Homo sapiens
  misc_feature (199)..(199): n is a, c, g, or t
  misc_feature (260)..(260): n is a, c, g, or t
ggagagttggaaaacaggctttctattaatgaagaaagagatttctcaaaaagggctgaggttttcccacctggatatggtagcacatgactaacattcaatcttccctttttaacaataactctaaacaagagacacaaacacaaattctacctgtgatgaacctaggagacatggaactgtaaaacatgaagtaaantagagaggacaccaaaaatagcagagcccagaaacagagagaggatattctttggttgctngttttaggaaggagtgaaaaaggtacactgtaaagtgaggagcaacccagaggtgtagaatcagaatcccttactttcaacaatggaaatgggctctaaaatgcagtcaacaatgtctctttggaaccagctgtattctgagaaacaggtgaaaa

SEQ ID NO: 147974 - DNA, 284 bp, Homo sapiens
ctgccaccacgcccggctaattttgtttttgtatttttagtagagacagggtttcaccgtgttcgccaggttagtcacgatctcctgaccttgtgatcctcccgcctcggcctcccaaagtgctgggattacaggcatgagccaccgtgccaggctgaggatctaatttctatccaaacacataaatgcataatctcccactgaatagaagaaccatcaccaatagaaagactgggatcataagtcttttcagtggaccaaggggtaagagggtatttgtctca

SEQ ID NO: 147975 - DNA, 459 bp, Homo sapiens
gatgtgttgggagagaggataggtggtgcgtgtttgtcctttctcagtggcaaactcactaacttcctaaggacaagaactccgtcttggacttctttatattctctcatagtgttaggcttaattctcgggacaaagtatatgcgcacaaatacttgatcattcactagaaaagagtttcagtgtgttcgtcgagtaataggtttaaaaagacacacataaagtctacatggacttgttttccaaattattttcaaaagcataatggtaagatttaatttggttgtgcgtgacagaacacttgaaataatgacttaggtaagacagaagtttccttctttccccatatgaaacaagggcacaggtagagaggccagggtggagtgggaaccggggctgcttctcgcttctctcctgctgctctaccatcctagcctatgatttctttctctcctctcc

SEQ ID NO: 147976 - DNA, 174 bp, Homo sapiens
aattacccacaatgtcatcaatctgttaataaaacaaagccaaatgtattagaatttaactgcagtaagaaaaactttgcagtgtttcggaaggaagaagtagaagaaggatatttatagggctttgggatctgtgctgaaatggtttaaggtgggctttttaagacaggcagc

SEQ ID NO: 147977 - DNA, 475 bp, Homo sapiens
gacttggtaggtcttcatggatttgatgtggcagtaggttaagttttaaaggaagtaaccatttagtaaatggtgaagagcaggaagggaatttcaggctatactgtactttgtaacttactttgtttttcatgtttcctttgaaattatttttagtctcattggtctaaaaatgtttagtgttgttagggggtgtgtaaagaccagaagcttccatgcttttgccatagacactacacagcctagatgggttaatggctagcaaacaccaaaactctcaagtccattgagttaaagaaacttcttggggatactgatacctgcccaccctacctcacaggttttctgtaaagatctaatgggatgtatgaaatatttttaaagacgtaaaagtagtatacaaatgtagaatggttaaaaatcacatggctggtggagaattgcataatgtataattacactgaagggaaaattt

SEQ ID NO: 147978 - DNA, 316 bp, Homo sapiens
gaggtgaggagctctgggtctgatagcagaaccttaaatgctggctattcatttccgtttccacagttgcaagcccagttttcagaaaaggggcagaaaaagaaggaagaaaaagaaatgcaaagcccagcacctccggccatagcaggttctgagtgcttcagatactgagggttcatctctaggggtcttagtttacagcaaagacttggcaaggttggcttaggtggttaagctctcgcctgctaacagacacctgatatttttctccaggccccctctcatttatttttgctcactggtacttctccaaacc

SEQ ID NO: 147979 - DNA, 214 bp, Homo sapiens
acagggcttgtcctctctgagctcagtggtgcacctgtgaaaagggtgggatttggggccccttccagctctgacatgaggtagtttctggtccctggtcttggctacccttacagaactgctcaggccccagaccatccacgccccaaaccgcccgggctgcaggtggaagttgagaaactgggcctgccctttcctcagcacgcctgacccc

SEQ ID NO: 147980 - DNA, 140 bp, Homo sapiens
aaggaattgatattggcagttaacctggggaagtcctcataaattacattttatgttcacttaaataaaacaagagagacagcactgcaacacagatcatattaattacattttacacacttcaaatgagtaattataag

SEQ ID NO: 147981 - DNA, 605 bp, Homo sapiens
aacttcatactgagaaagaatattagcactttggagacccttcttggtcttcagtgttaaataaatgatttatcttctctttaatccatttcagttagccgcaataaatcaattaaggacattatatgtaacttttaggtaaaagtcaattctccagactcatatctagattaaactggcatatattcatccaggtgggatccataaaggtagtattagaccaccgctctcaatgaaaactaggaaaacctgtttgaaggcagcaggaagctgctcgggcaacaataagtgcagacaccaacctttcagaaaagagagaatcttgtacaaataagctgcttcaacaactttttcccaggggacacttgctgatgttaagtatgggcaggaaacgggattcaagcattaggcccagaaatactgttgccgaaagtcaaaaaacagcacagaggttttggtggagtcctacctagatgcatcaagcatgaggagattctcccctcagttcagttgtttaatcctggggctacctgggatgagaaacttaaaacctaagtagaaaatctttgaaaatcaggaatggagtttgcaggacaaaaattaaa

SEQ ID NO: 147982 - DNA, 447 bp, Homo sapiens
cgtgatagtcagactctagagtatcccccggctccacggaaccctgtgcagggaagacctgagctgcgaagccgggggttacactgcgggacatggtggggcaggggccccactcatcaccagcagaagcaaactcagaatcaccccaggtggatgtctacagcctggccacatggaactccatggaaaacacgagctccgcaggtgaggccacagcacaatgtcacacaccccaaggaaacgatcagtgccacacgagacgacagcatgcagatggagcagatctgccatctgagcatgtcggagacagacagaaacctccaaggaggaagtaaaacccgaatcaaagaacaggagagagaaggaagaatggggagatgaggcgcgggcgaggaaggtccacacacacaggcgcagggacccttcagccctgcagactgtgccatg

SEQ ID NO: 147983 - DNA, 326 bp, Homo sapiens
gtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccct

SEQ ID NO: 147984 - DNA, 455 bp, Homo sapiens
ttcttaaatgctcttttgagatgctgcatgcatgttatattaactgttgaaaaaatagacaactgaaaataacttgcagcaaatcaggaaaatgttaatggcatagtaacttactctagcctgtgatatctaggttcgaatatcctccgtgttcaactggatgacggattaagggccttctaaattagagtatctacactgaactgggatctatataagtgattcttagaatacttgggcagttcattgtgagagcaaagaagagcttttaggagaaaattgattatatggaaccgcatatttttggaggttaaggctctgacagaacattaaggcataagacctagctgatgttaagaatatgtattcatttatttatttattatttttgtagagacagagtcactatgtttcccaggctgatcttgaactcctggcctcaagtaatccttcta

SEQ ID NO: 147985 - DNA, 539 bp, Homo sapiens
tctacactgtaaatcccaccacatcctgagcccccggtggggaggagggactaggaggctttgcatctctatcattctcagttgccacgggtttctgcaaagtaggtatccaatgaagagcctgtggcacccaagacagctgtgttttagctgctgtctgtgcattcatacttggctttaggtgaaagtgaatctcttccagaaggttgagtagacttcaccagcacttacctctgcagttttcaatgtcattttggctcttggattaattctgcttcagattgtggaaatcttaatttccaaggtgatcgtttcctatgaagtactttgctgccaaggaaacatagcttagaaaggtccccatgctgtggccaccccctaattccaagcaacgtggcccctactgcagtctccctaacaccctttctgcagggaggctcctctgagcactgttggcccatccttgaccttcacgtggctttgggtgtcttactgaaccctgcctaggtgtgttcctactggctgtggggttgggccgg

SEQ ID NO: 147986 - DNA, 262 bp, Homo sapiens
cagtctgagaaagatgactgaccatagataaccttgaccgtgttattcaccaaaggaagtatatttccaaaacagcccaacatgggttacatgagggccgtgagaaatgtaagctcctccaagagcgtgcagccctcactgttttcacaattgtccatagtcaagacaggaaaaagtgagaaagaaaagcaggacttcatactccagtgagagcgataaactttgacttctggacagaatatacagaggtcaagatgaatca

SEQ ID NO: 147987 - DNA, 469 bp, Homo sapiens
ctttctcttgactcctaccaatagagtcctctgggaggagtggtttttgctatagtatgtggaaccccctttgtcagtttttgtagtgtggtagatgtgaaatagtatcttgctgacactacaatagtatcttgttgcatttacttgatttcactctaaaaatgtaaaatctgatcaattaaatgtcagacttttaattttttatcttttgtgtttatccaccattgtgggagttttattcgtcatctctctgtaccatgactagagacccaagatttaattcagtagctgaagctttcactggtagctcttgtcagcagaccctcagggaaatctattatgccctgtgctatcagcaccaagtatctagtcattgagtcggaaaccaagccttttgtccactctgcctgaggaactgaattagtagccctcacccgtacattgttacctaacctcagaaaacacatca

SEQ ID NO: 147988 - DNA, 428 bp, Homo sapiens
gcctctcaagtagctgggactacaggcacccgccaccatgcctggctaatgtttttttttttttgtatttttagtagagacgggctttcaccgtgttagccaggttggtctggatctcctgacctcgtgatccgccagcctccgcctcccaaagtgctgagattgcaggcgtaattaaatgccttcttgaggacttttataccttcctcttgaagacataaatccagagcttactggtggttgtctgaaaaagatcacatcttgtaataggagtcatacataaatatttctgagatctccctcatacttaaccaccgtgcctggaaaatgcagacaactgtattcagtaaatggtatttgaatataagtaaatcaaaagtgtcgtttccatagattctgtagatgttaccacttagaataattacctg

SEQ ID NO: 147989 - DNA, 356 bp, Homo sapiens
gttacattgctgggcaacatggtattaaaataagacaggtcaaatttgagaaatctgtgattctacaggttaccctacaggtaactgactcaatgtctcagtcctaaatttccaggagaacaattctggtataagcacctggatttagaagctattttcacctagacaaacatgagtacctaggcaccattccattattagaagttgagcatagatgctaatctagaaaagagagatgggttgtccaggtgggcaacaagttgcagttttgatcaggctgctgctgctggtggtttatccagctacaaaattccaggatacacagtttgcctctttctcccctacccccagctggc

SEQ ID NO: 147990 - DNA, 323 bp, Homo sapiens
cacctaataccactgaactgtacactcaatgccactgaatgacacactcaataccactgaactgtgccctcaataccactgaactgtacactcaataccaccgaactatacactcgtaccactgaactacacactcagtaccactgaaccataccctcaatgctactgcactttaccctcaataccactgcactttaccctcaataccactgaactgtacactcaataccactgaaccataccctcaataccactgcactttaccctcaataccactgcactttaccctcaataccactgaactgtacactcaataccactga

SEQ ID NO: 147991 - DNA, 901 bp, Homo sapiens
gctctgacagagccacagtgaacattgcattccatcatctgggtatctccaggaatgtatgtagctggatgtctggcttttcatctgggtttcacgagcctcctgcagaactgaaaccatgtgcaaatcagttctcatacttgctctcctgcctccttcctattgtaattttttcttcccaccttttttattgttactagagaaatgatgaagaaaaagaataggctggagagtcactcaaaattttgttttcctcaattaaaaagaagtaatttagaagttactcaatgatgttttctttaattaaaaaaaaaagtagtttgggaaagcagaaaattaatgaagacagaaaacacaggtttcatgaaaaagttcagcatcccaggaaaggagcaaagagaagtctgcagatgagagttgctcagtgtcaggactcagaaaacaataccccaagataatgttcaaacctgagtgctttgaacaaaggatattgaaagacctcagaagagggcctcagaactcacatgtctctctgaccttctcctgtctctccttcacttccaaagcatgatctttggccaggggatctctctgggattcccttatctgcctgagggatgtacttccaaaagaaatgtgactggcatgacctcctccctaggaatctcttcaaacagccgggaaagactggtcacctgagaggagattggaagtcctcactgcactcagaaaggctgttgtccattcttctagagactttatctgaataacaaggcaacttttgtttaccattcagttcctcccctttcctttctaacttgtcaccacctcccccaaaagcctcaagcctccactcctacaagctataaagacttcaaccatctggcttctcaaaaaaaaa

SEQ ID NO: 147992 - DNA, 291 bp, Homo sapiens
ccgcccaaaaaataaaaaaaaccacgaaaaacacacacaacaaaactacggcacttcacttagtgactaggaccctacctttaccacctgcctcagtagacatactatattacacgcttttggctggcagactggtaattcagtatcacaatgcatagaggtgccaggtaatatcagcacacacctgcgtaatttttcaacacctccctttcctaaaggtagaatcaaaaccctccctgcctactacaccaaaaccaaaaaacaagaactttagctctttcatcctctccc

SEQ ID NO: 147993 - DNA, 250 bp, Homo sapiens
agggagggagcaggaaggggtgagtctagactgaggggctagcagcagagcacacgcgtcttactagagtctgtgctttcctgagatggtcccctacagaaaacccaattttctgttaatcctcagattcctgagccaaactattatttcactgtgaacagagaaatgggatcatgcgaggaacttgagaaggatatgtgaacagattacagtgcaaacagcaacttgaagtcaaatactgatatgaaaa

SEQ ID NO: 147994 - DNA, 484 bp, Homo sapiens
tgccttccctagagtctctcaaatcttaactcattccagcatttattcaagtgcccaaagcccagagtcttatctgagacaagtctacactcccttctgcccatgagccactgaattatatataaaggaagtttactacttccaaggagcaatcattacacaggtgttgggtaagcattcccagccaaaaggaaaaaaattgccagaaagaagctcaaaacacagatgggacttacagaccccatgcaagtcaaaaacccagcaggccagtcattgaatcctacagctcccaaatcatcttttgtgaatctataccccacatctggagcacaggggtggatggctgtgctcccaagaccttcagcagctcagcatctctggctgtgcagggtatatcccccacaggtgccctcatgggctgggttggtgttgagtgcctttgacttttccacactgagggtgccagcagttggtgcatctatga

SEQ ID NO: 147995 - DNA, 378 bp, Homo sapiens
aaattagacagagtggaataatgggtgttccaaggcagtgaggataggagataactttgcaaattttcaggattcccagtcctcaattctaaagtcagccagaggaataagaagcacagcaatgacacttttttttaaagcttaaaagaatataaataaacaaaaactaagaaaaaaatgccaaaagtcaatctctttcggattaaaggaaactcatctgtggtcataaaatcaaggtagtggctccctccgatgacttcttcagagatgaaggtgctggcaggacactggtgagtacctccgcacctgaaagcttcttccaaggccattttaattgcatccaaggatagtttgagttgagtccttactttggagaag

SEQ ID NO: 147996 - DNA, 267 bp, Homo sapiens
aaatatatttgctattgaatgaacaagtagaatgcacttatatattccagaatgtactgatttcgaaagagaaattgttctttactggtattcatgattctgtagtatattaataaatcatttggagattttagaatgacaagcaaatccttatcttttgtagaagctatggtgagttatctatgtatgcaatatgttgtctttgttgatcgccatagaatcatgtaatttaatttatttttggaactcacatatatgttattaaca

SEQ ID NO: 147997 - DNA, 476 bp, Homo sapiens
gtgatcctcctgcctcagcctcccagagtgctgggactacagacgtgagctacagtgcctggctattcactttttaataaaaggctttcctatatatgatctttttaatactcatttagatagccaaactaaagtcaaatataggatctaaggcatgtcttttatataatttgtgtgatattgtttttgttgttattgctatgttgtttggtttttactgtttctatgaacaatatcagtactaagatggtcaatactgagacactgtatcaagtcactgtggtatttagtattattaaaggctcctatatatcactattatgtaacagcctaagaaatccctgaagtacaacagggtccccttttttgtttgcaaactctaaatttaataaggatctatttaattagtccagaattcaaatacatgccaaattttgcaaccacatgggaggtaggcagaaagagatttgaaacac

SEQ ID NO: 147998 - DNA, 336 bp, Homo sapiens
tcttatttttttaaagctaaataatattccattgtttgtatataccacattttgtttatatattcacctgttgatggatacttgggtttcttccactttttggctattatgaagtaatgctgctatgagcatggataaataatctgtttgagtccctgctttcagttcttttggaattgctggatcagaagtggaattattagattatatggcaattctatgtttaaatgttcgaggcactgccatactatttttctttttcttttgagtcagtctcactctgtcacccaggctggagtgcagttgcagtaactcagctcactgcaacctctgcct

SEQ ID NO: 147999 - DNA, 567 bp, Homo sapiens
tctttgtagactcggggctgcctggctggacatcagcccccactgttcaccccagcctggtgcccactgtccgggcagccctagcctgtcccacatcatcccgcactctccccacccctgctattgccctgcatcgcgggggcactggcttagggaggggtcttggtccatgcccatgaagctgggctctcagagctagtgtggatgggagagcagcatcctgctagggccaccaggatgctgagaatttggccagcgagcggccgttctgtgggagtcaggccgagggccaccgttgggaaccaagacgtgtcctgcccaggcgcacggcatgtcccctgcatttggttctcaggaaggccccaccctggcctttgcccggaatccttaggctgggacacagatggctgggacaccccagcttggagctgcccaggaaggcagaggagaaggggaggacttggctgcttccagccacatctggacaacagaaggactgagccaccaccctcaccataggatgcctctgtgtggattggaaaagggaggagacagtggtgccttcca

SEQ ID NO: 148000 - DNA, 529 bp, Homo sapiens
tggtggggaatagggtctgggagattaactgaacacagtctgcaggaagagtgcgtgtatgttgatggaggactatgtcgagatatgtaacactaggggaggaaatatgagctttagagggggatactcagtacccctttgagtagagatattgaagaagtaggataggatagtgtcctgctgggaagattggtaagaagggctgcaaagaagaaggtcttcaacatattgaataaggtgggaggcagatgggcagaaagaaagtcatgagagagggcctgaccaaagtagtgtgggctgtccctgaaactttggggtcggacaatccaggtgaattgctgggactggtgggtgtcagggtcagtccaagtaaaggtgaaaagaggttgggaggagggatgcaaggggatggtaaagaaggcatctttgaggtggataacagaataatgagttgtggaagggggtgtcgaggagaggagagtatagggtttggcacaacaggatggatgggaaggacaatctgatttat

SEQ ID NO: 148001 - DNA, 392 bp, Homo sapiens
acccaggcgcgggggacacctctgaccttaagtaccccttggcgaccaggctcagggaagctctcaccgaggctcggttccatcagctcttcaggggcgaagagcaggaaccggagctacctgaagagcgcggctttccccggctcttcgggctgtggaggctgcgggctcgcgcttgttccgggacaggggcgtggcgcctgctgctggctcggctgcccgcgctgcactggctgccccattaccgctggcgggcctggctgctcggagatgcggtggccggagtgaccgtgggcatcgtgcacgtgccccagggcatggcttttgctctcctggcctccgtgcccccggtgtttggactctacacttctttcttccccgtcctcatctac

SEQ ID NO: 148002 - DNA, 594 bp, Homo sapiens
ctcctgcctcagcctccagagtagctaggactacaggcacccaccaccatgcctggctaatttttgtatttttcttagagatggagtttcaccacattagtcaggctggcctcgaactcctgacctcaggtgatccacccacctcggcctcccaaagtgttgggattacaggtgtgagccaccatgcccggccaagatctgctaaaattaattgtcatggttttacttctggtggctgtggaagctacttattttctttggatgtcattagatgtcttagctcttgaagtaagtagaactttaatgttgtatggattttgccattttgctaacactggtatgctccatgcatccacagtcccgctggaattaatttttccattcataataatttttgttataaacctaactgatggagcttctgggtatttaggtctacattctacttcaggttatatattctgctttcatttttttgtttgttcatttatttgttttttgagacaaggtctcactgtcccacaggctggagtacagtggcacgaacatacgaactcctgggccgaaatgatcctcctgcctcagcctccagag

SEQ ID NO: 148003 - DNA, 387 bp, Homo sapiens
agtctcgagtgaccagtaggattggagcagaaggaatgaggagcctgtggaatgaagcgagggcagaaaggacttgggtgtttatgttctggctggcttttctggagattcttctacccttcctttctcttccccagagctctttcccaatgcagtgttagtcattcattcaaaaatctttactgggccctagctactgggactctgtagattaatgagtctgggccccattcttaggactccatggcctggtgctatcaaggtttcttggggaagttgcatcgataaagtaggttgatgtaaacagttgtcttaatttgatcatcatagagtcaatttgctagagtaggaattttccactggaacctcccacaggtcacttttacc

SEQ ID NO: 148004 - DNA, 490 bp, Homo sapiens
tttccaggtcctgatggtttccacgtccttctcaggtgcccagcaccagacctgctaaaaggtcttagacacacaaggatctggtggatgaaataaggaatgaacagatgaccctaactccagttctgatgggacagtgtagctcagtggctaagagatatgcatgcaattccaggcgctgcccctcactatgtgtgtgatctcgagtgggtctcagcctcagttttctcatctgaaaataggtgagggcaggattaatgcataaagaggagagcgagagacagagacgagagagagagacagagaaaatatgcaccaacgcatggcagctgagaatgatgtttgttgcctgctccatctcagtctgttcgtgcagttcctcaggcaaaataccttggtgccctccttgacttatctctttctcttccttccctgccagccaatccccttggctctaccttcaaaataaacccagaatccaaccactcct

SEQ ID NO: 148005 - DNA, 326 bp, Homo sapiens
agtctgacattggagtcggccgggtcgatgcaggacgcgatcaggtggacgacgaggtggaacgagaagatccccccggtcacctggcatgtcaaggaagaacctggcccagggcctggtcagcctggcatgaggcgtccccgtgaggcccaaggtcccagaagaggcgtggccactggtcagccctgctcacccagccctgcacacgtgagcccagctcacccaggcctggccctgctcacatggccctgcttgtccagtcttgcacacatggccctatacacttggcccttcacacacagccctgctcacccagccccgtccac

SEQ ID NO: 148006 - DNA, 307 bp, Homo sapiens
cctgaaagaccctctccccgtatcgcctgcctgttctctaaaacttgtctcaacattatctccggcatgaaactcttcagataccactgtagctgggttgggcctctctgtctactacacattgtccaggattacagtgatttgtatccttgtcttggtctcctactgattggtaagttccttgaaggcaaaagttatcttagacattttttcgcttaactaaaacacctagcatagagctttgcatggtgtagggcctcaataaatgtttttttcaatgaaacaagttagtgtgcatgttttccta

SEQ ID NO: 148007 - DNA, 313 bp, Homo sapiens
ggcaggggctagatcgtggtgctccttgtgttctttctggagcttggccttctctctctaggcatgccattgggggtgttaaagcagggctatatcatggtcagatttacattttaggaagtgaatgagggggctgggcatatgctagctcatgcctataatcccaacactttgggaggttgaggtgggaggatcacttgagaccaggtgttcaaggctagcctgggcaacatagcaagaccctatatctacaaaaacatttttaaaaattttccaggcatggtagcacatacctgtggtcccaaatacttgg

SEQ ID NO: 148008 - DNA, 652 bp, Homo sapiens
acatttgcgtcttaaaagattgcattatctattatctttccaccactttaagattcatggtcagttatagttttgtctctccaaacacccaagtttttcataaatagttttttatgattcagttctatggagaaccttgtttagaattagtatctgtatttatacaaaatgattaactccttttggcattgttgatgaaatctgtaactggcatctgatgacaactgaatcagtgagcccatccgctattatttttggacaaaaagttcttaattggtctgatgcccttaaatggaagaagttgttagctctagagttgccaattgcgatttatcactatgggaattacaagttaaggaagtcagagtcagaagcgtgaaacagatacacataaagcaagaaaagtaggaatgagtaagggaaagaaaagacttctatttatcttttgttgctggtcttattcttaacattagatcttaagatattgcccgtgtcacaatacattttgatcagcctacttccatttgaaagcaaattattctaactcattaacttcaaaactgatcaattataatctctgatatgattgtgtcttcaagatacatacataataattgtgccttgggcatattacttgtgcccatgctataaa

SEQ ID NO: 148009 - DNA, 304 bp, Homo sapiens
ggtgatccacccacctcaggctcccaaagtgctgagattacaggtgtgagccgccaggcccggcctgacctagtttttcaggttaactttggaatggccttggctgaagggagagtccatcagtcggttggggggcttcgaattttattgttggtttgcattgtaaacagtcctgtggtatcacagtgattagctatgtcttacactttgggatcacattgtaaccacggcctccgagtaagtgtggtctcttcttatgacttcctggcaagaggtgtctcctgcagaaaggaagaagcgcatt

SEQ ID NO: 148010 - DNA, 382 bp, Homo sapiens
ctctgtggccttcctttgccacctttttcatggaaggctgctcattttcccacatcctgtggggactcagaagcgatcagcattgtcctagctcccctgatactttgctcaactctcctttgtacaaatgatctttgattcttatgccatctacctcttccttctgcttttcctaccaaatcctggttatcccataatagtgactgaggaattgactcataatgtttcttccactccaactcttaacatcacttgaaatgtctacactgggctgatgattctcttaaaactcttctgtcacatttccttggcttcttcaaacacaatgacattcatctgctctctactctggccacccaaagcaatcaagtggcccaaagca

SEQ ID NO: 148011 - DNA, 404 bp, Homo sapiens
tatgtccccaaatctcctagcacaggcagggaacataataagcattcagtgagttaatttttgtaaatgcagataattgcctgattcccaccactctcccaaacacacaaatagacacacatttatttttacctagcaacagagaagttaagagaaatgaaccgtaaagggtttggaacaaatattttggagtttattgcattctgttttctcagttgtgctctgagtcagacagattacacatagcccaagatatagccaggaaaccacttcactaactgtaaagagccaacagacttcacaaggacgaaacttccagtttgttatttacggtgccacaaaaggtattgggctacttcaggctccaaggtctcctcaggatgtgggctttggtggtggagcag

SEQ ID NO: 148012 - DNA, 761 bp, Homo sapiens
gggttcgctcattatttcctgctccttccctaggctcgtgggtttcgatattgggggagcggagattttctcttgggtgctggtcacgcccccttaagactcgggatcgtcactaagaaccccgctgtgaattgggggagcttcgggccttcttttggtggggaatgcttggaagctgctcattgttggaaaaagctctttttaggggattctgggtgatgtttccgcctgttgctgcccatcttcctccccagccccttcccgcttcgggcagcctgtcattaggggaagttgagggactctcccacttcaggtggtgttggagagcgtggaatctggagtccggtccctggattcgaatgcgagcttcacaccaattgtcagctgtttaactttgcccaagtttctcaactagttacctcagtatccttatctgtaaagtgaggtaaaatatccgaagcctttggaacagtgtggcacgtaataagggctcaataaatattagctaatattgttcctaaacagttgttgaacatctaacatgaagaattttcttttcttggtggtaaggaggacagggttcattctccagggttgaccgtctcccctcatgtgcaatacacatacgtgctttcgcgcacacatacaccgcaggaatttacgtgctccggtgggggcaaacaaacttgcaagccataatagtattttgataagattatcgaatagatatgtgcgaagttgatgagaacattggagaggaa

SEQ ID NO: 148013 - DNA, 872 bp, Homo sapiens
cttttctaggcaaaaggtgtccaatctctacagacccacagaatctaacagatgtctctatattcctcctccgagaacctcagaggatccagaatggcagctggtccttgctgggttgttcctgtccatgtgcctggtaacggtgctggggaacctgctcatcatcctggccgtcagccctgactcccacctccacacccccatgtacttcttcctctccaacctgtccttgcctgacatcggtttcacctccaccacggtagccaagatgattgtggacatccaatctcacagcagagtcatctcctatgcaggctgcctgactcagatgtctccctttgccatttttggaggcatggaagagagacacgctcctgagtgtgatggcctctgaccgctttgtagccatctgtcaccctctatatcattcagccatcatgaacccgtgtttctgtggctttctagttttgttgtcttttttttttttctgtcttttagatgcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcgggttcccttttctcttactataaaattgtttcctccattctgagggtttcatcatcaggtgggaagtattaggccttctcctcctgtgggtctcacctgtcagttgtttgctgattttatggaacaggcgttggagggtacctcagttgagatgtgtcatcttccccgaggaaggttgcagtggcctcagtgatgtacatg

SEQ ID NO: 148014 - DNA, 529 bp, Homo sapiens
ggctcccacaagtgcagggagagtgctctggtcaggagctctgcaggtgcctcaagaagcagcctgggcagagcctctcagacagggaggacgtgtcttgtttggtgaagggcaaatgtttcattgtggcaggggcacaggaggcatggaaaaagagaagcagggtcagagataggaagtttgggttttatgctgcagatgaagagggggtgtctggggtgttcaggggttttaagttcaggagtaatgtgggaggccagattgaagtccgggccaggaacaatggtaattgtgggacttaacaaagagtgagtacagctgaaggagctggggagcagaaagtatatgcgtcaggtataaggaagaaaaagatttcggaagttatgagaaatgtagagtgagttgagcatagtttgtgatttttagggcctctagaagtattaaagcatcggcagccgctgcatgcagacatgagggctaggctaaaacagtaaggtcaagttgtttggacagaaacgctgcagggtgt

SEQ ID NO: 148015 - DNA, 661 bp, Homo sapiens
cagttgattttactctgcagcctgaaagaaccaatagtcatatcttcctgtatggagatttgagaagcatgaatgttggatgtgaccctcaagatgatcccgatatcactgcaaaatctgaatgttttcttgtagggggggctccggctttcacatctggcaaatattattgggaggttcacgtggggggactcttggaattgggcttttggtgtctgtaacaattatcggaaagagaagagacagaatgacaagatagatggagaggagggactctttcatcttggatgtgttaaggagggcactcactgcagtctctttaccacctccccacttgtggtgcaatatgttccaagacctaccagcacagtaggattattcctggattgtgaaggtagaaccatgagctttgttggtgttgatcaaagttccctgatatacaccatccctaattgctccttctcacctcctctcaggcctatcttttgctgtagtcacttctgaccagagaaaagtcagagatgcgtctatatgctctgggaacctgtttatcccagaaagccctctttttcgcacctcaccaaatgggacaaataagttacatttaatgtctttagttgcattctaatgtcatctaaactcatttatagtgtttctatta

SEQ ID NO: 148016 - DNA, 474 bp, Homo sapiens
gtaaaatgtgaagaagtcatttagtaacaagtgaaagaagagtaaatacgtgcttttgtggaaatttaaacaatctctgtaagggaagtaaaaggactgtgactgaaccttaaggaacattctattggcaaaagaaacaggaacaggactgtgcccatagatttttggtgtctccaatgaccagaatactatcttagaagactttaataacacataagaagacttctatatgtaccaaatgaagggagagtacacaaagaattgaagaaacattcagattttaaaatcagaaacaaggatacagctgcctctaattatttggtataattacaccgtaggattgagcctaaactaccagagctggatgatcaattatgtcactagatttcagatctacgtagacatagtaaatactacacagtacacatcaaagttctaacaattaaaaaggagacactaaagaggttgctgaca

SEQ ID NO: 148017 - DNA, 376 bp, Homo sapiens
tcaaactttctgtagaaaacattatttttttggtaattaaacatagttatatgaaggattagaatgcaaattagcattagaatagtttcaagctaaaacaatattttttaggttttttagcaaaaaatctgtcttcacctttgtcccaagataatttcccagatcctcccagtttttctgcttatgctctcccacgatttactgagtatatttgtacctctaatgagacgtaccatagtggatattgtatgaaattctgatacttgctgaggtaagttaatatgtaaagtgtagaaatctggagggatagcagtagccaataggaggcagttcagtgatagtcatgatatacttcctcaagaggtcacaagggtta

SEQ ID NO: 148018 - DNA, 167 bp, Homo sapiens
tgctccctgggtacgtatgaaatcagaatattcaggagtaactgagaggatgcaaataacatttcttagtacccagctttaatatctaccagacctggtagtctggattatttgtagcaccatggaaaactcattagaaaatcacaaaggtatacacctcaaccttt

SEQ ID NO: 148019 - DNA, 250 bp, Homo sapiens
gtagcccttaagttgtcataaaacaccacaaaaccattcatgactcctgctacaaacaacaatcctggccaaattttaattcttgcacaaactgcagaaaatagccaacgctttgccattgatctttgggatcttaataatactgaattagatagttctatcggctggagcctcagtgcccttgtttgaaatttattaagattaggcggcagatgttccaaagatacaacaattttctgaaatgtgtagc

SEQ ID NO: 148020 - DNA, 470 bp, Homo sapiens
gtggctgatggccaggctgagtcatggtggccagagtagccatgcggggatgccagggctgtgtgctgtgagctggcactggctgctaattaacatccatgggagctgctgcttggacgcgccctcttttaagagcctcctcacattgttcctggtgggaatttcttttcttttaagagaggcagcatgagcttagatcctctgaagacagaagccgaccccactcacttctgctccttgttccactccctgccttcacttcctggcaactcaggagtgaggctgtcttgagtgaagccacagcgatcaactccaaggccggaaaggagttatggagtgtaccttcctggatggaattgctgtcttcccgaagagttacacagaaagtgcatttcctcgtcagccacctgacagcaataactcccctttatgtagaactttacagctaaggcagctgttcaccgatgtct

SEQ ID NO: 148021 - DNA, 479 bp, Homo sapiens
tttgtttgttctgggagttcacccttcttgggaactaagtgatggctcgtgagcacaatgctaatggcccagccagcaatgtgctcccataaagtgctggtgtcaagctgccatttgctttcccctcaccaccagttacttaaaatacaaatctgctgaaaaccagaggaaaataatgaggcgggaaagagagaggaagaggaagtaaaattttatatggtatattggaatgcaaatccagaggagaataatactatgtctgagttcattaagcaactagattagaaataagagtttatttaaaataattgataccaaattacaacatgacatgatgataaagagaaaaattctgtgtcagatgggtctctcgtggatctgtgaagaaggaatttagctagtaaaatgccagaattgcatgggctttagtatggacccctaaggacaactttattatgaacttgtggcacctatactca

SEQ ID NO: 148022 - DNA, 402 bp, Homo sapiens
gctcccacaaaagcgccaagagggttcgcaatcactaaagtgttttgaacttcaggtccttccttcttgaaatcgggcaaaagaggtaatagggggtgcgtccgcaggcggagagggacgcgatttgttcacaccaggcgctttccagttggtcccaacttcacactccctactttccgaactctcaggacctgtcaccaggcaaagcttgcccctccctctccactggcccaaaagatgtaagaccctcagggggcgcctgccagacccagaaaggatggcaactactgaagcccgatgaaacaggagcgcgcgcaaagcttctgcccttggacatccgctttggcagatgccaacctgtgcgcccgaggctgcccctgcccgctcccagtgcgcccattg

SEQ ID NO: 148023 - DNA, 310 bp, Homo sapiens
ttttttatatttttagtagagatggggtttatccatgttgtccaggctgatctcaaactcccaacctcagatggttcacctgcctcggcctcccaaagtggtgggattacaggcgtgagccaccacgcctggccataactattatctttgacaattttcctgggaggtggatgacaggacctgttactgacgccagtttacatctgagatgctgcagtggagaggaattggaactagaaccgacacttacggcttcttgtctggtgtactctctgctgttccatcttcattgcttgtgtgcatgcgtgtg

SEQ ID NO: 148024 - DNA, 291 bp, Homo sapiens
agcagcacatcaaaaagcttatccaccatgatttgaatgaaatttaacttatatccattgagcacagcaagtatgagctaggtacattcaccatactaagtgtatgtgtgagaatatgtttattttccttttaaaaaaacaattatccatgtagcacactggctaagggtatgagtccaagagtccaatggccaggaccttccatctgtaaactgtgttccagttgctcatcttctctgtgcctcagtttcctcatttgtaaaatgataataattataatagaatgccttg

SEQ ID NO: 148025 - DNA, 318 bp, Homo sapiens
  misc_feature (19)..(19): n is a, c, g, or t
  misc_feature (24)..(24): n is a, c, g, or t
actctagaggataaacagnggccnaccttttttgacaaataactcaaaactagatgtacatgtactgcaagtaaaagcaaacttttctggctcttaatggttgtcactggtacacaaaagtttataagccaaaaatgtgcaagcaattacagccacaaaaactgatgcagccttgacctattacagatttctaatattaaacagatacatgcaattccccattctacaatacatatacacagcattcatataatttaagaaacacagtccttccatcatgcaaattaaattaaggatcctggcaacaataataatgtt

SEQ ID NO: 148026 - DNA, 522 bp, Homo sapiens
ccacaacttggacctcccagctaacaacacagagtgttgccgttaagatttttgaagtgtccgtcacatactaaaaagttgtatttgtttaacatgacctcagggcctttagaagatacaactcctctggtacagacacatctggccgtttcccatggatttaacttttatccctcccctccaagatcccacaaagaaaccttagtgggcccaaatgagatgcaataagactcagctaaacctatcctccagctatcgtgtttaaaggattagcctggcatgaatttcctcacaattaattagcattttttgtcagggtaccattcataaaataccaatttatggcacttagctagccaacaataagcaaaatgtttcaataaaatgaggcagcaaaagtttatactcgaaaatgatgaaaaccacctatttttccctaaaattaagacaaggccacatctccagctaaccaccacctattttaactctgcattttacacccacggccctaatacttgaaat

SEQ ID NO: 148027 - DNA, 452 bp, Homo sapiens
tccatggagatgtctttgccaactgtgtccagttgtggcaggtgagtccttcaggggcaccccattaaaagggtgtatgaacatagtcatctgctgccccacagaagtgggcgctggtatgggagaatgtgcggaagacagagcctgtctcagctgggtggtctgttgctctggctttgtctttgttgcctgggcaacatctctctcagaatgtgagaaactcactttctcttttgcatgttgatctgtgggaaggactaacagctgtagctataggttgcctgttatccactaccacctatagttgagaaacagaaaccagattttggggaggtaaaccatcaggcccagggtgcagaaagatattaaatcactgagcttcttttatgtagctctgaaattagttgggaaaaagatcacctccctgaatcctgggagctttttctactaaa

SEQ ID NO: 148028 - DNA, 479 bp, Homo sapiens
aaaaaaaatatatctattgctctatattaaagaggcagattaaaaatttgccctaaaacagaatttgcaactcagcagggtaagaagatgattccattttacttcttataaatagaagtttaaggcacacacgttgtcaaaacaactttataaataagctggtgccaacacactcatgaatactaaaaatgttttccaggttctcagttgtcttctctatgattctattgaggttatacctattccaataaactcaattctcattgcaattcttagtgagtccagtgtgcctcctcgtataagataaagggtttcataaactgacaccatggacacatgaagattagtcagctttatgaagccagtgacttggtagctcctttaagtatttctgtaaggcactttggcctccaatgttcactccagattctatggtggaggagaaaggcttgtggacctacagtttacttcaatgactt

SEQ ID NO: 148029 - DNA, 398 bp, Homo sapiens
caggctggtcttgaactcctgactttgtgatccacctgcctcggcctcccaaagtgctgggattacaggtgtgagccaccatgcctggcctaagagtctttttttttttttcagtagtttttgcctagctagtttttcctaacagaactgttagaaaagcaccaggtttggaattaggacatagtaaccaagtcctaaggacatggctgaagtaaggagaccacttaaaaaaatacctgtactaaagccagatgaggttttactttaaagctatcattttaggaggctatatagtttttccactggtatgtcctactattattcaatctattctttgaaactcagaagttctttggaaacaaatttttaaataattcttcatatttcacttaacaaaa

SEQ ID NO: 148030 - DNA, 272 bp, Homo sapiens
gacctgtataaatgagaccacattacatgagatttcctggtttcaggtccttttttagtgcctcagcaagaagttctccctcctttgaatatctatagcattttatctgtaatgtaacacatcacatgtgccttatacaataacaggcacatctaactgctcctatgagatctatgtttgatttatgtttctatcacccacagtctatactaagtaacttttcactagcagtcagtaaacattttttggacaactacatggcagcccactca

SEQ ID NO: 148031 - DNA, 296 bp, Homo sapiens
accggaagcatggcgcggatgctcgctactgattacgtttacaaccgcgagcgggggagcatttgctgtgtgcagggacagagaagacagacacgctggccactgagtgggggagggagtctagtctatcagtgcagaaaactccccatagaggtgggggctatgacggaaacaccaggaaaagtgatggtggaagatgggggtgacctactgcagatggggtgctcagggagggcttctctgaggaggtgacattaactagattgacaaaagggatgatcaaggcctgtgaaagt

SEQ ID NO: 148032 - DNA, 329 bp, Homo sapiens
  misc_feature (252)..(252): n is a, c, g, or t
ctctgctgagtgagccaagggtggcttccggggaggtgagtgcctggaggagatgtcccagagccaagatgggatgcctcctggtatcaaagtgatgttcagattttttctggaaatctagaataggataaatgtgaatagagattagagtgaacatcttctaggatttgaagcccttgagagcttctaggatttgaagctcttggtcttgagaccaagcctctgcaatgcatctggggtccgttgcacaangtgtgtgtctttttaccaggtcttatccccgcttcagccttttctctcctgttagggatcaaaacttgccaaaacag

SEQ ID NO: 148033 - DNA, 340 bp, Homo sapiens
tttgggatgatttactatactttgctttaagttgtagatattttttgaaaattaatgagatagccaggtgcaggggctcacgcctataatctcagtacttcgggaggcttaggcgggtggatcatgaggtcaagagattgagaccatcctggccaacatggtgaaatcccgtctctactaaaaatacaaaaattagctgggcatggtggcgtacgcctgtagtcctagctactcgggtggctgaggcagaagaattgcttgaacctgggaggcaaaggttgcagtaagccaagatcatgccactgcactccagcctggtgacagagtgagactccatctc

SEQ ID NO: 148034 - DNA, 941 bp, Homo sapiens
tacacatgagctctcctgaattccttccttttcttcctttcgttctttttctggattatttccctgaattgccaagttgaatgaaccagctagaaacgccactctaatgagtatggtttgtgtcgctggagttgggaattctgacaactcataactgtactggttattccttggcttataaagaaatgactgagccctgcaggccactaaattaaaatgtaaacttcagacttcttgaagtgtctctctctctctctctctctctctctaccaaaatgtatctttaacatcctaaggtcactttcaaggtctttggcaaattagacttgggcaaggtgtgaaccaagtcaggcttcgggggctgtgttctcagttgcatgaaaggtcttttctctaacttctcttgcacatcattttgcttaggggggttgtgactagcaaggcacagagcgagaaggataagtctgaccaccaggactgcaggccagtagtgagcaaggggacatactgggcaggaaactctgctttgccctattattttcctagggctgccataacaagctaccacaaatgggaggggggagcttaaaacaacagaaacttattctgtctcagttttgaaagctagaaatctgaaatccaggtgttggcaaggccatgccctcttgaaggctcaggggaaaatctgtttcaggctcttctcttagcttctggtgtggtcagcaatccttggcttgcagccgcactgcccctgtccctgcctctgaggtcatgtggccatctccctgtgtctctctcttcacatgttccttcttataaggactatggtgagatcagttcactccactaagacctcctcttaacccgattacacctccaaagaccctctttctaaataaggtcacattctgaggtatttcaacttatctttttggggttag

SEQ ID NO: 148035 - DNA, 177 bp, Homo sapiens
aggaaaattgacaaaccaaactaagtagcagtaattcatcctactaccaacagcctgtacttgtgacgtctccagtggagagcagatgcccaggaaggagctctacccagcaagctgagggttcaagaatgcttgtgtggctttgagaaaataaacccccatctgtattagaaatgc

SEQ ID NO: 148036 - DNA, 625 bp, Homo sapiens
ggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcag

SEQ ID NO: 148037 - DNA, 646 bp, Homo sapiens
accagactttgcaggccttaggaatttgggaagtgggcagagggctctggtcttgccagctgcatggctttctgtgacctgcttgccctccagagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcag

SEQ ID NO: 148038 - DNA, 466 bp, Homo sapiens
tggttctcccagcggccagctgtgccctgaaatggctgcacacccccgagcaaggcaggtagggcctgtttctccatctggaaaacacctggtcggggagggttcagtaggaaaaccagatggcagagggcctggcaggtggtgagggcacctgcgtggcgagctcttactaaaactgagctgattttttttttttttttttttttgagacagagtttcgctcttgttgcccaggctggagtgtgatggtgcgatctcggctcactgcaacctccacctcctgggctcaagtagttcttctgcctcagcctccggagtagctgggattacagacatgcgctaccatgcccggctaattttgtatttttagtagagacagggtttctccatgttggtcaggctggtctcggacctggcgaccacaggtgatccgccagcctcgtcctcccaaagtactgggattaca

SEQ ID NO: 148039 - DNA, 212 bp, Homo sapiens
ccacaggagtcgagggaggagtggacggagttacccgcaggagctgagggaggagcggacggagttacctgcaggagtcgagggaggagtggactgagttacctgcaggagtcgagggaggagtggacagagttacccgcaggagttgagggaggagtggatggagttacctgcaggagtcgagaggggagcggatggagttctccgcacga

SEQ ID NO: 148040 - DNA, 512 bp, Homo sapiens
caaagagcaggacttaaacatagcattgatgcaacctgttcctaacccttttgcaaatggtttgcaagttctatctaaagacttctgcaagcgtcttaccagcctttaaactggttcagttgcatcaaccacttagtctgatgtgcctgcccttcacccagtgctgggctggagaggcagctgtacaggaaaatctgaccaagtctttccttttgtctgaaattctgcctctctgtccccatcccagatacaattttaggaaagagatgcgttgtaaaacaaaagtttctttggcctccatgcattgtcaatatttggcctgtgaaatgagtatgacttctgtcctcttccctaaagactaaacccaagagaataataaacactcaacaaactaagttattgatttcaccaaagagggagatgcatccattccatacattcattcaacatttgccaaacctaccgtgtgcaggccagtataccagggccttggagtccaaagataatgagat

SEQ ID NO: 148041 - DNA, 566 bp, Homo sapiens
gcaattgcaaattgagctgctataaccatgcgtgttcatgtgtctttttcatagaatgacttcttttcctttgggtagatacccagtagtgggatatcccaattgttttaagaagtcttcccagatctttctatttggaatttttatctctttctcttctatccccgaggtgttttgcttgtgcctttaactgagccctttctactttctgccacgtagctagttgaattgtctcttgatcaatttcccttgccagtgagggggctcatgaaggcagacagtaagtctttctctaaccctcaactgtgatgcttgagacatcataggctagttttgtttgttgaattaaattggattacatttcccctgtccagaaatgtctgtatttatctttcaccaaaaatcctatttcctctgtctccataatgcttcattattgtgctaagctattccctttatctctaatcttcatgatggtggcccaagcgtacagtggctttgctgggattcccaccaattataagccacaggtacgctggcatggaattgggtgatacactcttgct

SEQ ID NO: 148042 - DNA, 426 bp, Homo sapiens
ggcaagacattaaaacataccaccagaaaataatcactttcccataaaggaagatgggaaggaaggaaggaaaagaagaccagaaaacaaataacaaaatggtagtagaaagtccttatcaataatgacattgaatgtaaacagactaaattctccaatcaaaagacatacagaggctgaacggatttaaacaagcacagtccgaccatctgcggcctacaagaaacaggctgggcacagtggttcatgcctacaatctcagcactttaggaggctgatgcaggaggattgctagaccccaggaatttgagactagcctgggcaagatggtgagaccctgtctccataaaaaataaagaaaaattggccaggtgcagtgtcatgtgcctgtagtcctagctacttgggaagctgaggtgggaagat

SEQ ID NO: 148043 - DNA, 786 bp, Homo sapiens
tcagcaaacaccaggtttcatatggagatgcagctggataggaactgagcaccaataaaatgcttcgtcttccactggcaagattttggagtctaataaaagtcacttttccaaatacaggaaaatgctatgagtatcctgaataccttgaggtggggcagctgggtcagcacatggctgaggactgtcaaccacacatcaaataatgttctggatctctcctaacaggcataaaaacagattcacagacaaatgaaacagaatagaaaacccggaaataaatccatgcacctacagtgaactcatattcaacaaaggctccaagaacatacactggaaaaagacagtctcttcaataaatggtgctgggagaacccaatatccatacgcagaaaaataaaactagacccctgtctcttaccgtatacaaaaatcaaataaaaatgcatcaaagacttaaatctaagtccttaaactctgaaatcaccacaagaaaacattggagaaaaatctcctggacatcgttctgggcaaaaatttctctagcaatacaccacaagcacagtcaaccaaagcaaaaatagacaaatgggatcatatcaggttctgcacaacaaaggaaacaatcaacaaagtgaagagatggcccacagaatgggagaaaatattcgtaaactaaccatctgacaaaggattgataatcagatatggaaacagctcaaacaactacaggaaaaaaaactaacaattggatcaaaaaatgagcaaaggatttgaatagacatt

SEQ ID NO: 148044 - DNA, 613 bp, Homo sapiens
  misc_feature (27)..(27): n is a, c, g, or t
taggactgctgctttgtgccaccccgncgggtggagcgctccacccgacggggtgggaaggtgttgcttaaaaagaacaaacaggccaggcgcagtggctcacacctgtaatcccagcactttgggaggccgaggcgggtggatcacgaggtcaggagttcaagaccagcctggttaacatggtgaaaccccatctctactaaaaatacaaaaattagccgggcttggtggtggtcgtctctaatcccgctcctcggaaggctgaggcagataattgctcgaacctgggaggcggaggttgcagtgagccactgcactccagcctgggcaacagagcgagactccgtctcaaaaaaaaaaaaaaagacaaacaaaccaagtaagtggatatcattaaacaattgaggactggctcccttgtcccctgccagggcctgcagggaaagttaaaggccatgttccttttaaacaaagccaagtcatcatggccctccctgtgtttgagacgctagagttcgtcaaggaagcccggtttcctatgggcaccgcctagggaagtgaatcaagaatctcaggccaccccgtcgggtggagcaggtgtccaaacagctga

SEQ ID NO: 148045 - DNA, 429 bp, Homo sapiens
actgcaagcacgtgccaccatgcctggccaattttcatagagatggggtttcgccatgttgcccaggttggaatattttaggctatcagtttagtgacctatatcttcacccaggcaacagtctgttgattttagagttgaatccaggccaggactggcagaactctggcagcccacaagaaagtagatgtcactgcgtgaggtctgatgggcagtgtctggccctgaagagcctggggcagagcaggaactgaaactcctgagcctacaccctacaaaacagcagcagcacaagggtccgtcgcagctggaggaggtcccactcctctctgtgtgtgataatgaaaatattgccacatgtgctactgaactctgaaatagggcttgtgattcattttgatgggaaaagccacatgtgtttaggggcta

SEQ ID NO: 148046 - DNA, 401 bp, Homo sapiens
tttacagtggtgacttttactgggaaaggcattgagtgtccaggtttggataacagaggcgactcttttggaacagggaaagctgtggtgaagaaggcaagtcatatccatgttgtgtcctggcctgataggaggttatcagcaagaaagggagaagtgtgtatttcctcgttcacttatacgttctcaatgtctatctattaataccctcaaaccagtgactttcattcatgtttataaataaaattatatatatgaataccctatcaaattaataatgattatttctgtttactggaattatggaatatttttccttcattttgctgatctaaatgttcattgatgattgagataacatgtttttcagaagagaaatattaaaagcacaatttttcttg

SEQ ID NO: 148047 - DNA, 557 bp, Homo sapiens
tgaggcgcttacggcagggcttggcacagagtcagcacccatataatgttcattattactgcttttccttccccatgaaaccaggcagtgctggctggccaccccaacagatactctcaattcattttttctctggcttcctcctcaggaaaggctgacaagttaaataacatttgtcaccttccttggagctaggggaggctatgcgacatggcagcaggagcgatgtgtccatgaggggaaagatcaagagaatcaaagcggctctgccctgacactgcccagccaccaaactaacactggcagccaagcacctccaggtgtgctgttgtgagcgagaaataagccctccttcaatcaagctgcagtgagcgggggtttctgttcctgaaacttgaagacattcctggccgaatgcacataccatgatgcaaatggctcaaggcgcacacccatggtaattgtttgccaatttcagctcaggcccgctgctgagaacccctgacccagaggaaaaacagtgggtggctgagccatacagtgcttaccaagcccag

SEQ ID NO: 148048 - DNA, 245 bp, Homo sapiens
atgagtaaagacgaaggaggtgaggagcaagccaggaagacttgtggctcctcggcagcagcaacacctgtaaaggcgctgagggcaggaggtgcctggtgcactggaagaacagcaagccctgctgccttcattcccaagttcagttgccacctgttatctgactccaggggcagccctgtggggtctgggcttttcttgagttcatcatacagagtttgaggacagtgcaaaatactctctgt

SEQ ID NO: 148049 - DNA, 329 bp, Homo sapiens
ctgcctcagcctcctgagtagctgggactacggatgcacatcgccacacctggctacttttaaaattttttagtttttatcagaggtcttgctgtgttgccagggctggtctcaaactcctggccttaagcagtttctcctgcctcagcctcccaaagtgctgggattaccggcgtgagacgctgcacccagccttaaatattttttgttgtgggatctccgtcttgttcattagtggcttctgtgtgccattggacaacttgcttaacttctttgggccccgttttcggtttttaaaaatagggacagtaatactgaccccgtagggt

SEQ ID NO: 148050 - DNA, 270 bp, Homo sapiens
caacacagattaaggccaaaagcaaaaatggcaaaatcaagtcctcattctccaagggctcctaccccaagactttcttccttgaccgcccacatggaggcgccatgaacacaactatccacacttcccaaggtcaaaacaaaattgagctccctcttgaaaaaaaaacaacagcagctaccattgttcaacccacaggcattcagagtgttcatacagcaaagtcgaaatttcccctttcaggaagttcctgggaggaagtcagtgccc

SEQ ID NO: 148051 - DNA, 415 bp, Homo sapiens
agttctgatgacactcaattatctctctagcccaatctctcctacattccaaaaacatgtttctaaatcatactccacatctctcctccaatggtctacagacacctaagattcaaccaccttaccaaggttgatccacaagaatctcagactcaacggattcaaaacagaattcaacttctttccacttcctcaaacccaaacttgtacatcctacctatattgtgagtgcttccaccaagccacaaacctcagtggaatcctggactcctttctactcttaataacctacatctaatcatttaccatgtactgtccattgggcctttataaatttctcttaaatctgcagactcttctaccttacttctggacagcatcctctcttccctgaattactaaattagtctccaac

SEQ ID NO: 148052 - DNA, 491 bp, Homo sapiens
ttccctccagttacaccagctccagttacaacagctctgttagggttaccaaaactggcaagtgagctatttcctagaaaccagccactcccatgagatgtataaaacataagaccactaggacaccccctaaaagctgcctgctacagaaagaggcacagtgcacctcggctcagacatgtgttgctgaaaaagtatgcctaaaggggtgttgtaaattgaacccaattcatggcgtaacaggagggagctgtgttttacagaatccatgcaacagagttatctaattttatcatcagaaaaaaaaattccctaaatttactgttctatttgaggttttttataaattggattttctaagtacaagacatctcagcaaactgcatgctctaatgttcaatgaactctccaaataaaggctcaggggcttcaaatacagcctggaatacagcaggcatttgagcactgaggaacaaatgtgtgaagaaatg

SEQ ID NO: 148053 - DNA, 478 bp, Homo sapiens
caaaaacaagaacagcttaagtccaagagaacaacatgattaaactatcacatatgaaaatttaggaaagacttgcagtttttatattatttggttggaatagcttaaacagactctcagacaccaagctggtcttcaactgtagaccgttactgaggcaaaaatcagtttgggcaagccctatcctaaatgctagagtaaaaaactacaggaactacagaagctcaaaaggcacaacattgatattgagccacagtagctgccatattaacaacgatgttcattagatactagtctacacttaatattactgtgtataaaaacaaacaaaaaaataggtacctaaacttcagggagtgtagtggcagaatattttccccctttttgctcttacttataaaaaggccaaggccatacagctctagagaagagtccagtagttttgctaatgtcatgttgtatctggaggatgccaagc

SEQ ID NO: 148054 - DNA, 367 bp, Homo sapiens
gtgattctcaaatgcaggtaggtttcccagtcacagactgggaggtatcttattggagtttattcatggaatataccaagtggggtcgacccaggagaaagttggcaaaaaaccacgtaaggggtcacttggatgaaggtacagggcctcacaattaccaaggaactgctggcagagccaaaagctggacaggaggaccatgagagggacagaccatgcccagtggaggctcagcagcaaggtgcctgcaagatgtgtgtccaccccagatacctttggcatgaggtgtggaggcaacacggcctttctaggttccactgttctggggatggaacttctagaatgcccccaggcctgagccttcctt

SEQ ID NO: 148055 - DNA, 546 bp, Homo sapiens
aacttagcaacatatatacacatgcttatttctgagtgcccctgacatctagcggcttagtggtttcttggatcttttctaatgtgtcatgagccaaagcaacataagctgggccatagcaacacaaatggtgagtaacaaaatagaaaattctcccttactggaaaaagttagatattcttaatcatttgtgactaaaaattttgcattagtgaattgccctccataatgcctttgaaaaggcagtgttagttatgttgcttctaaaatagagaatggatcagaaaaagaagcattctcactgatcattttatagatataatctgtttattgagcatttaagcatgcatttcaggtaatactagatgaatacatagaagattctttaaataaaatgtaaatgtttatccaactcatataggttattttaatataaatatcaaagtaatacttcatttaaaaaggagcaaattcagaaatagtaaaaaccagaaaggaatctgggaaaacagggacagattaaggctattctgggtaatccaaaat

SEQ ID NO: 148056 - DNA, 134 bp, Homo sapiens
aaatacaccatggatcttcccttcaattccccaatgactcaactttctagtctacttttcagcaacaagcgaacctcaggtgtcacctaggttcagtggtgagaggtgtagctattgcacaagttttgtgagga

SEQ ID NO: 148057 - DNA, 446 bp, Homo sapiens
tcgagctcggtaccagttcgacggagatctccttggtgtgaacccaaggaagtgtggcggtcaacttcactgttatcttaaaggcagctgggaggagaccttggtagcgggagggaaaaatatgccaaaagcttccaggaagagacttccccattgacaaaaacagtgaagtcaacccaaaaaaaaagggactctataaacagtagggttggaaacagtgaagcaacggtcaggagctgccggcaggcatgggtgcacgctggtttcgtagggcgactgcacgaggaagccgctgggaggaagtgacaggagcggacaggcgcgtcttacttaacagctggtgacagtggccaacagacctagcaattccttttaaaaaacaatcctaacagggagctgcacagcgctgaagctagctttcagtattagagagtctccgtcgaact

SEQ ID NO: 148058 - DNA, 255 bp, Homo sapiens
aggattcaactttggttgtctcttcatcaataaccataagccctgggcacttactgatcctctttggactcaactcctattccaagaaaatggacataacaataaagttatttccttgaaggcaaaggaccaaaccagatgttcacttacagaagtttctagccccaattcacatgactattccataattttttgattctaggtctgtcctttgggatgggaccaggctgctgggttaaataggaagtgttcaga

SEQ ID NO: 148059 - DNA, 211 bp, Homo sapiens
ggaagaagtctcagatgaaggttatcaagaaggctggagaggctgtgattcagagcacacagagcagtggctttggctgggaagagggatgggcttctgcatttctgtgcatttctgggttcagtggcaatggtttgagagtgttcctgtctggcaactctcattctctctgtgaggataaaaggtactacggactacatttttctacata

SEQ ID NO: 148060 - DNA, 243 bp, Homo sapiens
acctcattctccaatcccctgctatgtttagccctccttccccttttctttgctgttgtttgtttttaagatattcatccgtcagcttaggaactgaagagagctgaatcttaatgagcctgtcaaaatcctaggtgtatttttgttgttgttttctaagtcctgctcacagctgaatgctgggtgaatgacagcttcttgcatctaggagatgatgcctgggcagagcggttggaaactgac

SEQ ID NO: 148061 - DNA, 383 bp, Homo sapiens
cttcagcacatttctgatctggtctttattctcctctctatctctccaggctctgaactcagacagaccaagttcaaattccatatctgtcactacagctgtgtggccttaggcaagttgcttaacctcccccacgtcccactaagcctcagtttccccacctgtgaaataatagtatccacttcacagggtggttgtaacctttaaacaaaatagcctatataaaatccatagcacagtgggtgcctccatgtccccgatgagtggtagctacgatctggcctctttcttccctttcagatgttcccatcctaggccctctttctctgctttattactggcaggtatatggtctctggtgttggtatagtgcctgttaaatg

SEQ ID NO: 148062 - DNA, 215 bp, Homo sapiens
gaactgctttaatagctttttgcataaatgtgtgcatatatatgtataaacgccacaggagatattaaatttaagtcaactggaaggcatctatttggaagggttggataaatagaaataagaaaaacagtactgactgtagtcataaataatcagtaaatttggtcttactgtgcaaattccaaaaatcctacttcttgttaggcaatttaaaa

SEQ ID NO: 148063 - DNA, 382 bp, Homo sapiens
tctcatcaacgttataaggaaacaactttgaacattgaactgacagcgtttgaggacctcctttacgctgtgtaaagtctcagtttccaagaacctatcgatagttaagtgagaactcaaggggaggagtgagtcatagggttggaagtcaggaagtatgatgtagatgaggattggtttagaatttctaatccaaatgagctgctggatcagacattggtctttatcattggagcatctgagtctacacaaagttcacttaaaatagttggtcttactttggaacatgtgcctgagtaagcctctgtgagacagttttggttgtattttgtttctcttgcatattatggtttagtatagtttaactgttttagagtcaaat

SEQ ID NO: 148064 - DNA, 379 bp, Homo sapiens
agaaaagtagagggtggatttctgcaagcaatgtgcaaagaaacttgaaacaacaacaagataacccaggacagcccttacctcacagtggggaggagtgagcaacaaagacaacaacaacaaaaaacagctcatcatcttgttattaattgcaactctggtgccttggatatgcctgattgaagacaagggacttgaaggccagcctataaacatgctatattctcatggaaaacccaatactttaatggctgtatttttgtggtttattattttattgatctcaaaggaaaacctgcagcaaaaaaagttggtgcattttcttctattatggaaaatttctccagttgcagaaataaagtcccaacctccccagtca

SEQ ID NO: 148065 - DNA, 390 bp, Homo sapiens
tctgacccacaaaaacggcaatttcatatggttcagcctataaggtaggcacaagaactaaggaacaattctaaaaaagaggaaatataaggaaacaacaacatgaaaagtcaatcaagctcattcataatcaagtaattcgtaaacatgaaacaatgaagcaacatctctttccagcaaggcacagcacagtaaatgccagttctatatagatgtcgctttaatgtggcgggaggcgtttacttgccatcatccacacagggtacggaagttggagtcagaaaaagaatgtatgaggagttgaaaatctgttcagatcaactccccaatggaaaatgtgcatgctcctcatcttactcaggaaaacaatataatcagtgatataaaaat

SEQ ID NO: 148066 - DNA, 749 bp, Homo sapiens
attttgccttgccttgaaggttattaataattctttgaaaaattgattctgagaaataacatgatacaagcaaagacatatttacaaacatactaaaccattttcgcaaatctgtaaacattcttaattttattattactctgtgacactatataataaaatatttatcaattacagttcactgtctcaaagaattttgaatggtctgggaaaatattaacaatataatggttagtgaatggagcagacaatatgtagactgtttatcccagtttttcaaaataaaatttgtacacagatattttaatatgaaaataccagcaagttaataggggccacgtccacttccacattcatatcgacttcaatgggacttgaagtgatatttatttaatttgcttttttaaaattttctattttgaatacctatttttattttcagaatacagtttaattttgaaaaaaaactatcttgcaatgttatttgggcgaactttataaaattacatacatagagatatgaaaatagcatgattacaattactgcacaagaaatgtgtcagaatgcttgtagtggttgttatagtgtgagctatgaatgttcctttccctcccttttctctgtttatttaatttaggggtttccaatcttttggcttctctaggccacattggaagaagaagaattgttgtgggctacacataagatacactaacactaatgatagctgatgagccagaaaaaaaaa

SEQ ID NO: 148067 - DNA, 269 bp, Homo sapiens
cctgcacaccattttctctgacagtggctgtgactggcattgatgcctcattgttctctgctagagccaccagatgtttgggagccttcattaggctagtgggaaatattatccgtttacagctgctccctttccgtctgtggggaacgggtatcatcaccttacctgtgatttggcgtcctaattattgacaagcgatagacattgtttggccaggcagttttacagccagaatcttaactgggacaggaggcatcctcagtgacttg

SEQ ID NO: 148068 - DNA, 602 bp, Homo sapiens
acccatgatgtccctgcttaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacaaaaatttgctgggcatggtggtgggcacctgtaatcccagctacttgagaggctgaggcaggggaatcgcttgaagccaggaggtggaggttgcagtgagccgaggtagcgccactgcacttcagcatggttgagagtgacactctgtctcaagaaaaagtcatttcaatgaccacctcaggagattcataggtatctgacccacatctgagatgggatttgcattgcattttagctatgatgagaagaaatatttaatatcttagaagattaaaagcatactgtgataatatggaaatcttggtgggaattcagtcattagtga

SEQ ID NO: 148069 - DNA, 438 bp, Homo sapiens
gaggctgtactgtggattggagtacagattgagtatttaagagaaaagcaacaatgtcaagacaaaggaacatgggtaatttagaaaggcctccgaaaggtactaagctttcatgtgatatcatgcacatgttgtttaagagtttgtggagtcaaaaaggagtcaaaagctttctccttcagcgcaggagattttgtaatatttctaaatgatccagccaaacaacattggaggaagaaaaaaaatcaaacactacactacacaagccatcatcctgtcacaaagccattagcgctcatgaaaaacgatggtattgttaaggtttatttatagttctttcttaatcaaataaaaaatgaacaggaaaacactctgaatataaatttttaaagactttaaagacccaagaccagtagcaaaaacatgtatgaagacata

SEQ ID NO: 148070 - DNA, 444 bp, Homo sapiens
  misc_feature (14)..(14): n is a, c, g, or t
taatcgagctcggncccagttacaacagctttatgtatcacgatcattttgttgtatgcactgaaggaaacaaagtagtcataatcacctcaatctctcccactactcctttcttccctttcaccactccagtcaagctgctctccttgagcagggcaggctggctcaatggtcttctccccgtatgtgtatgcacgtgaccatctccctcatctttgagtacttgttaaatgtcaccctcaccaaatagcttttcgtaaccactctattttaatataaattccaacccctcttttcagccttccctttccacccaatttagttttcttcacagcaagtatcttcctcagatacactttatattttacttattaaatgtgtttatatctctcttcccctttgcaaaaaccagctccatgagctgttgtaactggttgttttgtt

SEQ ID NO: 148071 - DNA, 566 bp, Homo sapiens
  misc_feature (535)..(535): n is a, c, g, or t
agacggcactgtttcagctgcattgcataaggcttgacaggacattctcgattgtgttagcttctgagtactttgtgatttctattcttgttacatgtttaatgcatgagctactcagcagtgaattgaaagttgaaaacattcttccacttcgtttctactgttgatttaaaatttaattgtataatgatttaaaaaatatggcttgagactgaagtttggaaagctcccgagacttcctttgtcctggtagaacttttataacccttccgtgtgaactcagctatttgtagggaagattctatctagctattagacctggcttggcttgttcatttcactcttccaattttcagggtttcttttcttttttttttttaagacaggtcggagtgcagtggtgcaatcacagctcattgcagcctcagcctcctgagctcaagtaagtctcctgcctcagcctcctgagtagctgaggaccatcgttgcaacgatggtcctcagctgcagtctgtggagaacgacatccatgggntccgcagggtcattgatgacaccaatatcac

SEQ ID NO: 148072 - DNA, 429 bp, Homo sapiens
gccctacagatctagaaggttgtgtgtcttctgctctagaatcagaaccaataggacatatatagatatgtgagacattataggaattggctcatatgtttatggaggtggagaagtcccatgatctgccatctgcaggttggagacccaggaaggctggtggtgtaactcagtcttagtccaaaggcctgataaccggacgagctgatggtgtgagtcccagttagaatccaaaggctctagaaccagaagcaccagtgtccgagggcagaagatggatatatcagctcaagcagagagagcggatttgcccttcttctgccctttggctctatccaggccctcagcagattggatggtgcctacccacattggtgagagtggatcttcttagtctactgatggaaatgctcatctcttcacaaaatg

SEQ ID NO: 148073 - DNA, 311 bp, Homo sapiens
ggtaatctctgttcatttggattatcatgaattgcatatcattggaatctaaattaatgacctactgaacagagagggttgagcaagacatttgtggaaaggactgttgagaagaatatttatattaggtccaaaggccctcagtgaacctgagagagaatcagcttattttccttttaaaataggtactaaaatttcagagcagttgtctttcctaatagcttcgtctacttctgattgtcacacactctctctgcactcctgcatattgattattatattgtaacatttttaccatctacctggaggtg

SEQ ID NO: 148074 - DNA, 241 bp, Homo sapiens
gtttctctgtatctcatctacataagagatataatttgaatctgagaagaatcaaataaaccagattaatattttgggggcaaaaacatgtttactagttcaacaaagccaaatgtacctaagggaaaggtcaaaggatacttcattccctgctgagcaaatgctcaggaagcacatttgtctacattttcctgtcataacaggaagagtgtaacttcttcctttccacaatagcctaggt

SEQ ID NO: 148075 - DNA, 510 bp, Homo sapiens
ccatatcctgaagtcataaagatattctcctataccttaattgagttctagttttcccttttatggtatgctttgattcatctggagtccatcttcatatggctgttaagaacctggtctttctctattcacgtctccatttttctccatggagtgagggagttttccagcaccatctatcagacagtcgtcctgacctcaggggataatgagttcttcatccagttcccacatacggctctgtctatgagttcccttctctcttccattggggttagagcttctcacagtgaacaccagttattccagaattgcctgaagagctataacagcgtgggttcctgggcccaccagtacagcaggatcagaatctctggctgtgggcctaggagtgtgcatttcccaccttctggcagagactttgctgtgcactggagttttatgaagtattgctcaagtgaagacactgtccttaaacaaatggttattattcaattccttcagtaagca

SEQ ID NO: 148076 - DNA, 253 bp, Homo sapiens
tttgctccttttcttatttttcgtgaggggcaccaaaggcaatgggagcagttggaactgctgtgctacaagcatcaggagacacgtacaacaaaaggcactcatcaaaggacaaaaagtaaacaaaaaaaaaaaattcagccaaccatttagccttcactcacaaatatgagtgcctccttggtatagtcactatcccagaaagcagtcaacaagaaaaaaaaagaacccggccttcatgaagccttcattg

SEQ ID NO: 148077 - DNA, 176 bp, Homo sapiens
aaacactcccatgtccacaacacacacacatccttggcctacaccaattctacacatcttgcaaaacatgctcaagagtagccttccctgtgatgcccttcctgatcattccactccatgaccaattctctctgttctgtacacttgtttaatacatgaccctgtgctgtccttac

SEQ ID NO: 148078 - DNA, 334 bp, Homo sapiens
acatatcagggttagtttctatactaagctattctaactttcattattactcctcaaaaggagcttgtttatttatttttttcttttttcccccaccctccccaaaaggagcttgtttattaatcccagctgaggagcaaggagccactggcagccacagatctcactgctgcacagggtttttagaacttcagccataaaaatgggcagaattttccttgatcatattcgtggtacctgtccattttcttatgcaaactgtgatacaatcctgaccaaccgctcagaattcatctccacttggttcacaggcgccactggcagagcatttctt

SEQ ID NO: 148079 - DNA, 378 bp, Homo sapiens
tttatttgggcttaatgtttgaaaaattgacttattttatgatgacctatcaagtattttaaacttttgatatttggcaaagtttccagaatcaaattacaagttgtgtatttttctgacctaattaatcctctaagatattagtttccctaaagtccaaaaatgaaataaatgacttatttggtataaaaattatacaggaagcattgtcaaatataaaatggtgtttggttttctttgggctgtatttgtataaaaatgttattggtatgtgcaccaaaattatgggaaactcctataattctgatatgacatggtgtacaatatcactaataattataattgttatataaaattatcgtgtgccacagtggtaac

SEQ ID NO: 148080 - DNA, 348 bp, Homo sapiens
taggattacaggagtgagcagctgtgcctggccctaagactaatcatatctcctacacatcagtctagatacgaagactacctaatcctgtagtttgattctgggacatcaactatgatactgaaaatttcattaaactaaggatgacattaaattctaatgtaaaagtaatgataatttaataaggatatatgtgtaaaaaattaatctccatataataaagacacaatttttttttagactttgaccagaaaaaaatggctttaaattataaaatccagtgctgaagacatcattacctcaagcactcacagtagcaggtaaattgaaatgacaattgagaaggca

SEQ ID NO: 148081 - DNA, 378 bp, Homo sapiens
aacgctccaggacgatgtagagatcgcccaagccacgaaattgaaaacgttgcagtagagaatgggacacagccatgttgtccagactgcactcgaagtcctgacctaaggtgatctgccagtctcagcctaccaaagtgctaggattataggcgtgagccaccgcacccagcctaattctcctttatcatgaataatctatgactaactctcactattccattagttcttgtgtataataaataataaacatctattagctgttgttgacttggaataaagaaaaaaaaccaaaaccaacatctattgtttaagccatttttagtctaggttcttttacttgcaactaaaagcatcttaactaacatagaactcttt

SEQ ID NO: 148082 - DNA, 442 bp, Homo sapiens
catggggggaaatagaacatattattcttatgagttatcagtatgactaccatcgatactgccagtatcacccaatatttattaagtgttgactgtgtgtcaagaactatggttcgtgttaatgatgcattatctcttcctgctcacgaactctgtgaagcaggtactattattatctccatttttactaaggctttaggcagatttaatactaagtgttggtactgagtgtagtcttgctgctaaaggcaggaagctgtggtgtcctggcacatgaactgttaatatactgtgtgcttgggaattaggtagacttaggctattttccagaagtcatgagtgccctgcccaggtccacccactgacttcacagcccagctgagttttgcccttttcttgtgtcctcccaccctgtggtgtactgggtgtggcactgctaaaa

SEQ ID NO: 148083 - DNA, 831 bp, Homo sapiens
cccatccactgcccataacattttgcagaactgcagtacagtatcacaaccacaatactgacattgatacagtctgctcatcttattcatatttccccagtgttactcgtatccacgtgtgtatgcattgtgttttcaatactcttttattataaagctgtttttaatgtgattcaattctaggttgttttgttctgccctcaaaaagcattccctctcctaatcatatctccgtcatacccttgtatgttttctttaaacctgttttaagaaagcagctacctgtaagagaaatgagattgaaaacagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacataggtggtcagttgatttatacttcctggttttcagtgttgcttgaattttctaaatggaaacacagtacctttataatcagaaaacaatcccgagttttgatttgagggtgttgtaaaaagttaaaaa

SEQ ID NO: 148084 - DNA, 777 bp, Homo sapiens
cccatccactgcccataacattttgcagaactgcagtacagtatcacaaccacaatactgacattgatacagtctgctcatcttattcatatttccccagtgttactcgtatccacgtgtgtatgcattgtgttttcaatactcttttattataaagctgtttttaatgtgattcaattctaggttgttttgttctgccctcaaaaagcattccctctcctaatcatatctccgtcatacccttgtatgttttctttaaacctgttttaagaaagcagctacctgtaagagaaatgagattgaggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacataggtggtcagttgatttatacttcctggttttcagtgttgcttgaattttctaaatggaaacacagtacctttataatcagaaaacaatcccgagttttgatttgagggtgttgtaaaaagttaaaaa

SEQ ID NO: 148085 - DNA, 519 bp, Homo sapiens
atttggcttcgtggcgtcccaaattctgaacatgccttgaacctgtcaccagccctgggctgtgaccactctgatgtgcagatttttacaggcatgggaactaagaaatgatcctgggtcaatgatgtgcatttcattacctgcaccctcactggctcggccttcctgagagggctcctgctggccctggtgactaagaggctgctcctccagccctacagtcagcagtgttgccattgtgtccgcctcacttcctcccctcttgcaaatgatcaccaggtacccaggccccacagttttcgcctgatcctctggctgctccagcttggggaatgcagagaagtcaggtgagctctgcagggacgagactgtgcacagaggggaaacagttacagctggaccccagatccccgcactccctcccactcccgcgtgtactggcgggagagagctctggtccacgaatggggatgcctggtttcctgtctcagctctgccacagtcttcgcctgatgggta

SEQ ID NO: 148086 - DNA, 397 bp, Homo sapiens
aagaccagcttcctctccggtctggcggatctgttctcaggctgagcagagagtggcaaaggctgcatctgcgttgcttgctcctggcattgcctgcctgccagggcaccacacaagagctcgggcttacaggcacactttgggtgaagtcattcttccctgaaaactgagatgggaaatttatcctgacatgtcagaactgatgaagaaggctaagcaatggctacctgagcattagtcttgggagtgtgttctttcaagcacaggtttaggtttgcccttctattgtttcttctactaacacattatgaaggtagatttccactggaaaaaaaagaccagaatttgaaaatgtaatagagtgcatattcattattaagattataagaaagccttt

SEQ ID NO: 148087 - DNA, 446 bp, Homo sapiens
ttaacaccgtcacactcccacactgctccctcattggaagaacccatggataaaggaacccctccttaaactgtccaacctcccttagaaattgtttattacagtcatgttctgtataactgctgttgttacaggatcgcagtctggcctccttctctaactatcagaacaggttgtttcacatttttgaaacccattttcctcatttgttaaatatcactcagtgaattttactgtcctagtgagctatttaaaaagttaaggcacaaattaatagtatatccataaacagcattcccctaaaatatccccgtctagagttactacttagaatcaggacactgacaagttagtctgtgaaaagaatggcatttctccacatgtagaaaaatgtcctaagaaataagaacctttaaaattccaatctgcacctggctaagaactcc

SEQ ID NO: 148088 - DNA, 291 bp, Homo sapiens
aagtcctgccttccttttagccatgctgatggctgcaagcttgtttctttgtaatagccatagaacatttctattctgtcagtaaccattccccagtgggtggatttttagtttggattcagtttatttataataaatacagggccgcaatagatggcctttctactccttttctgttattgctgacacatagtcctctcggtcctcagtccagtgtgggtttccctgggctgaagtcaaggtgttggctgacacacagtcctctcggtcctcagtccagtgtgggtttcc

SEQ ID NO: 148089 - DNA, 221 bp, Homo sapiens
agcctctcactcacaccactaatttttttagtttttaaatcacccaactagtttatttttatttttattttttgtagatacaggtctcactatattggcctacagtagtctcaaactcttggcttcaagcaatcctcccacctcagcctcccagggtgctgggattatagggtgagccactgcttccggccctaaaatgactttttatgagagattgaaca

SEQ ID NO: 148090 - DNA, 1146 bp, Homo sapiens
atgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacatttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaa

SEQ ID NO: 148091 - DNA, 1092 bp, Homo sapiens
atgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacatttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcattgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaa

SEQ ID NO: 148092 - DNA, 450 bp, Homo sapiens
gtctatagatgattgacagacacaggaatggatgagaccacaagggagaggacagatggaaagaaatatccagctcttggaacctcaacatatggaagaggaaaatggtgggcaaaggagacggaggaaggagtgtttaacaaaggagagattcatcacatgacttgagcaccgctgagaggtagaagaaattgtcttagtccattctggctgcttataataaaatatcataagctgggtggcttacaaacaactgaattgaatttctcacagttttggaagctggaaccccccaaatcaaggtgcccgcagatttgatgtctgatgaggaccagctccctggttcatagacagtgccttcttgctgtgtccgcacatggcaggagggtgaggggtctctcccatgtcttttcttataagggcactgattccattcatgagggctccacc

SEQ ID NO: 148093 - DNA, 281 bp, Homo sapiens
ttggctttggtaatctatggattgtcacaaaggagtgttctagaaatttagtcttaaccaaatagaaaatttcttagtgactgtaggcagaatttctcttagacacataaaataatcttccccttccaaacctgacattctttaagccctgtatatgtacttttttagaccatgtaagcagttactgatagaggttttttcttgtagaaatttcaagtgttgaaagtaggccaggtgctgtggttcctgcctgtaattccagcacttgggaggctgaagtg

SEQ ID NO: 148094 - DNA, 248 bp, Homo sapiens
acaagaactacagcgagaaaagggagacagaagaggatggacgttgctttgcaatcaaattgcagatttttttcccatgcttactgtgtttgggaaaaaaaaaaagtgaatcatgttcccccattcatgattacgaagcattgcatcctgccatattttcttcagtacttactgttcaatcacctctccacagaggtagttgtgctttggtaatgtatcaactttgtaaaataaaaaaattcaattag

SEQ ID NO: 148095 - DNA, 367 bp, Homo sapiens
ttggcagactttagaggagggaggtgctccaaagcttaggctggatgcagagccagaagcgcaagtgatggctgcggcttctaacttagggtagcctgtgtccatggtgtttccagggaagacttcctggaggaggagtgaatggatggagtagataggaggctgggacgtagtggaaggatcaagtctgaggccctgcacctgggtggaggggttgagggagtaaggataacttatttttcccttcttctattccttgaagtttcaggccagtggctgctttatctaagtttcctcctagttcctaggatgctttaaatgtggaccatgtgagtggggctgatttcatttggaggagggagagcag

SEQ ID NO: 148096 - DNA, 838 bp, Homo sapiens
gaatatggcatcttgtctgtcttattcaggatgaagagtaacctgcttattttgtctcctgtgtcccttattccttgggaggtttccctgggtgttattcttaaaaaaagtcagctcacgaagcctaaggtttaagtctgttcaacttagtagtaaattatggtaacctagggtagggcaaatagacctcagtcaagttcatgcagcaggatgagggtagtagcttctgagcatgtgggccgagctctgtatcagtgtggatcccatatttgaagatccttattcatatattcctcaggaaaactagattcctttgcaatttctaaatctacatgaactaagatctcatcaatgaccactaccacaacacatacatacctttactaataaacatactggatttagatgtgagaattaatgatgggtttgttcaatattttccttccaagctgactgacacagtttataagcttatatttatttttctggcattctttagaaatgttttttgggacaaacagccaagtttaacatgaatcaaaatcttggcctgccctttcaactcctccacaataggctccagcgccactctgattttttctctcctgcaacatttaattattaatcttgtgacttttgaaaaatgtcatgtggtttggtagtctttcaattaaaaggagggaaataataccctagtatttttcttgttccttccacctccccttaccattgtcctctctagtactgatgagtactttaaagttgatttttaggctgccctgagtttctgaatgttcctaaacaccattattaaagaagcctgcctcacccgtcattc

SEQ ID NO: 148097 - DNA, 471 bp, Homo sapiens
cctcacctcccacgccctctcctgccactagtctctcccaccatatcctcctctgcggctgccccggggcccagcagctcgttgctgtgtggaggcgtcttcctgtcccccaaccccgctccagtgctatgtgtttgtcctcctgtcctggccgagggcaccatccttcttggggctggggccacgctgcatctctgctgctttgttgtgggagtggacagtgctcagcctgcgctgctgttcctgtttgtggccgtgttggggtttggtgtgtgttgtccagaaggggaaggctgaagcccgcgttctcacccagggcggaagcggtcattgagcccctgtgtggctctgcatgtgtgtgtggagtctgcatgtctgtgtgcatgtttgtttgtatgtgtaggtgtatggtgtttatgtctgtgtgcgtgtttgtatgtgtgcatgtgtagtgtctgtgtgcatggtgtc

SEQ ID NO: 148098 - DNA, 185 bp, Homo sapiens
cagagtgacagaagagccaagtagaggacgctgaattcaaacccaggcagatggacgtaaggcctttgcttttcactatacattacacaccttcccccagtctcaacagagccaagtgtcagacactcatgattctgacttcagcatccattctgttaatctctgcactattctgttttatagtt

SEQ ID NO: 148099 - DNA, 219 bp, Homo sapiens
gatggtctcgatctcttgacctcatgatccgcccacctcggcctcccaatgtgctgggatgacaggtgtgagccatcgcgcccagcatggaaatgtgtactttcaattgcacttgctaattgaaagctggtaaccaagtcaaagataaggcagaaaacaactgcggcagaactagacttcccaacaagccccctccactgttcccagttctggtgtaat

SEQ ID NO: 148100 - DNA, 188 bp, Homo sapiens
ttgttttttccttcttcctccctccgtatctcccttttccctttctactgccaccctgtgagccaccatgcccagccctctattctgtttatttaaaatgttgctaataccattgaccttgattttaggttaaaaaaaaaaagaactcgtagtagatttttgcctctcctctctcctccccctctcct

SEQ ID NO: 148101 - DNA, 209 bp, Homo sapiens
tgagactcatgcttttggcagctgttgggcagctgagtataaaccagactaaggtggttggggcagaaccccagagtactgtcccctgagcctatgttcaagcaatgcagagtggcaaccagaggatgctaaactcgaaggagatgacttgactttatcatgatcactgcctgcagttaccaccaggaaggcctaacacagggtgcagg

SEQ ID NO: 148102 - DNA, 181 bp, Homo sapiens
aaagctattagaaaaaaaaagtgattaaacacaatagacaatgacttaagggaaagaaaaggtaaaaaagagaatagcttgaaaaattaaaaagaaatggtcagacgtggtggctcatgcctataatcctctgggaggccgagcccggccttttttgtttttcttttttttctaatacttg

SEQ ID NO: 148103 - DNA, 488 bp, Homo sapiens
taacaaataaagagtcattacatattagaaagggatccaatcattaggaagacataatcctaaatgtatatgtactcaatcataaagttttaaaacatgaaaagtaaaactgaaagaatagttaaagcagatttcaacattcctctttcagcaaataatagggcaagcagacaaaaaaaattgtcagaaataagacttgaatagtgctgttgacaaacttgacctaattaatacttattgaacagttggtaatttcaacactcctctctaagcaatccatacatttagagaaaataaatcagtaaagatataaaatatacagtaaagatataaaagtgtctttttaaaaagtctgtcagttgacctaattggtatttacaggacactccagccaaccaaagcagaatacacattgttttcaagtacacttgaaattaaagtagaaaatgaattagttgggcgtggtggcatgtgtctgtattcctagc

SEQ ID NO: 148104 - DNA, 382 bp, Homo sapiens
tctcgtggcggcttattgttattgccctgatacaaagttccatcttcctcatttgcctgggaccaatatgtctgagctccctcctcctggacaggaaagtaactacctagtcattctggggacccaaagaccttgctaccaagtgggtctcctaactaccactgagctggctagacaaaaaactttctgggtgatggtagccttgaggtttggctagggtcaccctcccatgacccagcataggattggctggaggctgaggcagatggatagactggggaaattcagggctgatgagaaggaagccactggcccacaggatcactgctgaagcagtttatcttctctgagttttcagtttgaggaaaatctaactatagaa

SEQ ID NO: 148105 - DNA, 474 bp, Homo sapiens
gtgattcaaaatgctgacgtttttgagttccccttttgggagaggcgcatgtttccatttcaaatgtccgtcatcagacatctgctgccttcttgctgctgctctcgttttcccagctgatcatcctctgctttgaccatccctgttccctctatccttgttccctgggtgggcttagcctagttctctgagggtgcttcctttgcattctgcatctttaggaagccactttgcttgttggtttcttcctgagcttgcattagtccatggtggacaactgggttggggaaataatatatttgaagagcttagagcagcttggctttattttttgaagggcacacactgtccccaaaacaggcttttaaaacttggcatgtgccaggagttccaggctgcagtaagctatgaccacaccactgcactccagcctgggtgacaaaacaagaccctgtctcaaaaaagaaaaaaaaa

SEQ ID NO: 148106 - DNA, 251 bp, Homo sapiens
tcaacccgaacctcaggcgaaggtttggggacaagactaagctcagctcccagtaactggccctccccttgcctcaatcccttctggaacaacacaggctgtgccagcctgcacagggcagtgcagaatcaggaaaacctggctggggccagagtacccgggcacatcctcgctctcctgggccgcctggggcctgcacctgccgggggatctgccagcccccatacctgcggccgggcacatttaactgt

SEQ ID NO: 148107 - DNA, 498 bp, Homo sapiens
tgccatttttgtttgaccacttacaaggacaaagagggagcacactaggttttggagaactgtaattgttagacatatctcctttatattcagccaactctgtaactcttattcattaattttagtgctgctatggaaataacactaggccttttgcttatttgaagccagttttcaaaagcagttataaagatggggagacatacaataggcacgggtcacaacgtatgagtctcatgtctcagcacaactgcataggcagcttgacttcctgtgccttctgtaatagcagcttcccggtttagcaagcatgttggcttcaaatccaatcattccttcagaagcaggaagcaatgtcaggttatcatgcaacaatatcaaatctggggcaccaacagcagttatgaggaaatcatatatatattgtgttccttctccaaatatgagtttataaaacagcaaacaccacaaaacttttttcatcttctattattgagg

SEQ ID NO: 148108 - DNA, 445 bp, Homo sapiens
ccacaccctataacctggagccgggactgacctcagacatacccagacctgctgtgcgtgggccatctgagggccccatggcagcccactggtacgtgggtcactgggcccatgagcagtccccaaggagcaaccaagaccccattcagaaggctgagcaggggctgcgtttcaaaccttgtcccagaacccgggcaagctcttggctagtgcgaagaaagtggccgcattcctgggctgctcccatcccgctggcttccccacggtcccgggctggtaaccattaaccagcagcaaaacagcccgttaatcagagggctccatagcgcttcgtgtgctaggggaggcagggcctgtgagaacctcggtgtctggctccgggaaacctttcctaacactctccccaccttctcacccctgcatcctgaaggacgccaaccgccat

SEQ ID NO: 148109 - DNA, 328 bp, Homo sapiens
gggcctgccttgcctcgggcagaccttcctcacctcgggcagaccttcctcacctcgggcagaccttcctcacctccgatctgtggctctttggccacagcagcccctaacctccggggactgtcactccccaaggaaggtcggttctgagctgtgtctggaccctgagcacagacactgcaaccccgggccttgtctttctgctcatgccggtgagaccagggcaagggcaagggcgcgggtgagaccagggtgagggtgagaccagggtgagggtgagaccagggcaagggcgagggcgcgggtgagaccagggcgagggtgagac

SEQ ID NO: 148110 - DNA, 264 bp, Homo sapiens
tgccaatatgtaggttctggtcatggcagcctgtctgtgaactcctgctcatccatcaatacccaggtcagaggcctgcactctgtgaaaccctccggcaccctcccaagctcacctcctgctcctttcttctgtccagtggtgctgtggctattcctcgatgtaataatcatcctagctcacagtagtgggtgctaacaacatgccatgccagacactctgctaagcactttgtgtggatgatctcatcagtacccattagga

SEQ ID NO: 148111 - DNA, 190 bp, Homo sapiens
atatttagttgcttgatttttaattacaacattgacttgtaaaggatgttcccaactaaaaaataaaatgaagtacatgattataaaaataaatattagaattttttctagttttactactttgaacatgttttttctttcactgagaatgtgttaataggcgaaaatgaagttatataatagataactt

SEQ ID NO: 148112 - DNA, 198 bp, Homo sapiens
ggctcaataagcctagacactacagtaaagagttcattaaggtgactaacaagaaaactactaacaaaaaaggcacgtgtaagtcttgctaaccaacggactgcctcaagaggctgtctgaaaagatatgcttggcaagctaaggtccattttaatttgcttaagtttctcaggcataagaaaaaaaataatggtcaa

SEQ ID NO: 148113 - DNA, 308 bp, Homo sapiens
cctgcctcagcctcccgagtagctgggactacaggcacgcaccaccacgcctggctaattttttgtattttagtagagacggggtttcaccatgtttgccaggatggtctcgatctcctgacctcgtgatcaaccccccactcagcctcccaaagtgccgaatttaccattttaaactatttttaagtgtacagttgagtattattttgcagccatctcaaaaactcagcttcccaaagtgaaattctgcgctcattaaacaatagctccccactcctccccacaactcatggtacccattattctac

SEQ ID NO: 148114 - DNA, 296 bp, Homo sapiens
cagggcgcagcagggatgaacatgccactgtaagcagggggtaaacaccatcacagaaggagaaaaatgtctctaggttaagcagggagaaaacaccatagggaaggagaaaaatgtctctaggttccttgggagaggccaacgatatagaaatcaaagcatttaagcaaaagaaactgtaacaactgtttctgttcttttcataaagctagattgtggatttctatgttccaaggtagttacacgggggttttttttgttttgtttttttgtatttttttttttgttttgctttg

SEQ ID NO: 148115 - DNA, 488 bp, Homo sapiens
taaccagagtccagtggggtaaatgcaatgatggggcccaggagggaggagtgagcacctattgttttgtggaggaagaaaggttaagctttatggaggaggtgcaaataaaatgtgaataacaatatcagtatagatataatttttttcatgcagtacaaaaggctataaaatgaaacttctagaggattatctagactccttcctgcaaagccacagttaacaacagttaggttttttttcttcttcttcttcttgaaataactaaattattttgaatggtgaatgtaagctttatgaggctggaactttttgtccgttctgttgcctgttgaatcttcacctaggagagcgattgacacttaatagatgctcagtaaatatttgttgaccgaataaatgagcagtagaatgacatgatgagatcttttctagacagagatgactggagggcatcagggctggagactgggggagcaatgcgtgtt

SEQ ID NO: 148116 - DNA, 203 bp, Homo sapiens
aaaaaattgttgtcaatcaaaccaggctacactttcagtactttgatttcagagacattaactgtggaaaaagtgtcttaggacccatgacataaggtctgcctcccagttaatcacagatgtggccttgcctagcactccatggcatgaacctgaaccctgaccctgcgctccccggggaagggtctgcctccgccaggccc

SEQ ID NO: 148117 - DNA, 491 bp, Homo sapiens
atggtcctcttagaaaatctttagcacatgtggtgtgccacagggacagtgtgttgaggtcagcaccatgttctgcagagagcaggggctttgaactcagaacaccggctccctgcaccctccctatccctcccaactggccacagcccctaaagctcttactttcagtgttgcacagctcaggccctgagcctgtggaagtccagctgggagtcatgaatgagcccagggcctggggcctgagacctggggtagacttgcagcctaagctggaaaccctggtggagccctcaaggatcttcaggtctcagagctcatggcctcttccaaaccccagggagtgcccttttcagggtgagtgggtcctctttgcaaagttctggttgctctgtggtaagccaggaccttgcactagactccgtgccaaacagggtgcctgtgacttgccctgagtcactcctggggtctaccccttcaggcagcctcatctc

SEQ ID NO: 148118 - DNA, 382 bp, Homo sapiens
tgattgggtgaaaactaatgcagaagggaggatgagcgagaggctgcatgggtacaaagttacagttaggaagaagaaattgggtgttccattgcacaggagggcaatgatagttgacagtaaaatatcatggccaggcatggtggctcatgcctgtcatcccggcactttgggaggccaagtcgggcagatcacttgaggtcaggagtttgacagcagcctggccaacatggtgaaaccctgtctccaccaaaaatacaaaaattagacgggtgtggcggtgggcgcccataatgccagctactcaggaggccgaggcaggagaatcgccggaacccgggagccggaggttgcagtgagtcaagatggcgccgctgcactc

SEQ ID NO: 148119 - DNA, 508 bp, Homo sapiens
gagaacagaaaaagatgaggattccacatttttcctctcctgtcttcagagacagaagttggcatgaaagacactgcaaagttaagagagcagatcaggagacacaagttgtgtctccagtgcttagtcaatttcaacctatgatttacactcccttatgcttctggagcccggtcaccgggcgagtgtgaggggagaggtcagctccctttcctggcagccgtgtgctaaggaaggtctctgggttaggcagctgggccatgcaactgctgcaggctgcctttctctgtctgaagccccaggccccactgctgccgtggcctgtttaacgagctgtcagaggcggctgcagtcccacgtgccttcctgtgttgactccaaaggctattttaagcagggaagatggtgggaaacaggaagtgtcccagctactagaagttttgcatccttcaaggagaggggctgggaaccagatgtccccggtgaccggctacggagtaccgagcag

SEQ ID NO: 148120 - DNA, 326 bp, Homo sapiens
ccagccaattccctccctgggattcccctccactcacccggaaaacagtgagagaaggatctagaaatggccacattaattaaggtcaaacagcagaggccctaagggccatttctacttgggactttacagatatttcaatgtcatttttaaaaacatgtctccactcagggaatgggaatcttaagttcccactcctcgttaaccaaatccccagcctcatcatgggatactccagggttcggcatcatccttccagggtttcagggaggcggtcaccctcagcagctcctcttgcagacagcaggtgcacagcagggttgagc

SEQ ID NO: 148121 - DNA, 809 bp, Homo sapiens
gccggcccagataaggaagaaagaaagaagacaagaaagaacgaacgaacgaacaatgggaaaaattgactgacagacctctttaggtctgcgagtttctcatagtggttcacttcacccagtggtgcatacaaagcacccaaaccagttggtcttttcctttcttgtctttgaggctgggctgctgggttctaataagtgcagtatcaggcttccttaggattattttcattcctaattcaggttgagcagagcccacgatcaaggtctcagtatacttgaagtttctaccgggggacctaggtatcctactatgaaaacagactaagaaagtcttgttaacgccttcatttgattgattgattgattgattgattgattgatttattgccacatagaaagcaagcttaggcatcttcatgtgcacatgagaaaagccctggaagaggctgggggcggtggctcacgcctgtaatcccagtactttggaaggctgaggtgggtggatcacctgaggtcaggagttcgagacgagcctggccaagatggtgaaaccctgtatctactaaaaatacaaaaattagctgggcatggtggcacatgcctgtagtctcagctgtttggggaggctgaggcaggagaatggcttggacctgggaggcagaagttgcagtgagccgagatcgcaccactgcactccagcctgggtgtcagaaagagactccgtctccaaaaaaagaaaaagaaaagccctggaagacagggcccagcatggagttgaaagactgccagtttactccttcctttca

SEQ ID NO: 148122 - DNA, 251 bp, Homo sapiens
ttgacctctcgctcacgaacaggcatccttctcaggaacagcaccatgtgtgatgactgaattagcgtctctggccagccacagaggagggtggggacagatgtataaaccatgaacttggctaacaagcaaatgaaggctacacagaccaaatcccatcaatcaaaggacccacttgatttcagttaagggcggacagtagaggtggggagcacatactcacggtaacccagtgttcggttgagcggaga

SEQ ID NO: 148123 - DNA, 318 bp, Homo sapiens
ggctgctagcatgtcaggaatcaaataaaaagagagggctggggaaatctcccttcatcatttagtaagcacacagtcatcaaatccccatgttttgggaaagatatacatgtcctagacatagattagggtctcccagtccagagatatttattttcccctctctagagaagaaacttccagtctactgctaggatagggatggagcagttacctggtgagtaagagaacagatttagagaaataacagcttttcaaacaggcctttcattttaaccctttcatcccctgagatagctgatattgccaattcctgag

SEQ ID NO: 148124 - DNA, 738 bp, Homo sapiens
ctctctagttgtgttgcctgtggattcaaagaagaaaacattctcagaaaaatggaacccattcttcaagtaagggaatgtggagagtgacattctcctgctagtaaggacaagagatgataaaattgaactaaggtgatcacaatgggaatgaagagaagcaaacacattcaggagatatttctgggtccataggactttgtgacttcttgagcacagtggcgaaggaaagacagatttaaggtttctagtctacattcatatatggatagtgatgactacaacccatgggaaacatagagaaagtttcattaaaaaaaggacaggtccaaaggcagtctacaaacttcaggggagtacatgctctggtcaataaatgtgtagttattcaaaatgcaaggttcgataaacataagaaaatgtgccaaattcattagtcatcagggaaatgcaaagtaaaagcacaatgacatactagaatggctaaattttaaaggaccaatgataccaagtattgatgaagacgtggaggaactcattcaacgcaggtgggagtgtaaattgatacactactttggaaaaatgtttggtagtatttatcaaggctaaaatatgttagcaattcctctcctggttatatgaatagtctacaaaaatatatgtatgaaaatgttcagttattcacaaaaactggtaacaagctaaataatgtcttaaatgtagaatgaataaattgca

SEQ ID NO: 148125 - DNA, 413 bp, Homo sapiens
ggagtgtgcctatattgcccaggccggttttgaacttctggggctcaaatggtcttcttgccttggcctcccaaaatactgggattacaggtgtgaaccatggtgcccagccaaggtcaactgatttttaacaaatatgccaagacaattcaatgagagaaagtgtaggaaaaaaagtcttttcaaacaatggtcctgggacaactggatacccacacacaatagaatgaagttgaaccctcacctcatattatctataaaaattaactcaaaatataacaaagcctttgtttataaaacatttgttagactgaaaagtagaaaactcttttttttgtttttagatggagtttgcagtgagccgagatcacaccactgcactccatcctgggcaacagagactctatctcaaa

SEQ ID NO: 148126 - DNA, 532 bp, Homo sapiens
actgaactgcatatcacaaactgtgctctgtaaattggagggtttttgttttgttttgttttcttatgaaattagctttgagctataaaagatcaagagaatgtgaagaacagttgttctaatcacagaaggttgaatatacccagtgattcaaagacagaaaggagaaaaaggtctgggggcagcgaggtagaaatgggaaggaaggcttttagaaaaaaccttgtatgagaacagaagatgaggcaatttggagatagagattgtgggtggattgtcaggagtccgacggtgataatggatgttccaacaaaaggtaaacataactgcagataaaacctctaaaaatactttcctttcctaagagatgctgaaagttctgttctctgagatacaggggtaaaatgaaattttgtgggtgatttatagcaaccatattttgtttgtgagtgtgcggtgctttgtatggtgcatctatatctctgtgttatcatctaggacagtacttttcaaactttgtgcatcaaagttg

SEQ ID NO: 148127 - DNA, 525 bp, Homo sapiens
tcttcagcacagttggtgttggctgaatatttttgactgaggctaaagggtcattttgggttttgtcagggtctcagagccagtgtggtcctctctgtccatgggatccgattgtcggaagcattgatgccatctggcgtggaggccgtccaccgtggggactgtgcagcgtgggggccatctggcatgggggctgtctgatgtgggggacatccagcttggaagctgtctggcgtggatgccgtccagtgtggttgctgtctggcatggaagctgtctggtgtggggactgtccagcgtggaaggtgtctggagtggaaggtgtttgatgtggggaccatccagtgtggggctgtctggtgtgggggccatctggcatggaagctgtctggcgtggggactctctggcgtgggggccatctggcgtggatgccgtccgatgtggggactgtccagcgtggaagctgtctggtgtggaagctgtccgatatggggactgtctggtgtggaagctgtctggtgtgg

SEQ ID NO: 148128 - DNA, 507 bp, Homo sapiens
agactgacccagcttcgggcatcagttttgactcttcctttcctggcagtcacagtttctagaggtgaaggtcaccagagctgggcaaactcctgagccaactgcttcccaagcctgagtaggttaaaaatactgtgtctgctgctgccaaggaaaagaacatacaaggttgtgccttggcaggccctagcagggactgggtgccccactgcaaggaaaggtggggccctgatagaaaggaccaaggatttgggcaaagatatcaggtaggctcaaggttagacctgaatcagaactccagatgacatcttaggtaggaacaccctacccaccttgccagggaagaaaggcctaagggcggcctggtggggctgggaggagaactggaaagttctcttgccttcacatgtgagctcccacagcaaacttcctgaggctggctctaggcctgtaccatctcctacccttcacggggatggaggggaagttgtatgtggaagccaaatg

SEQ ID NO: 148129 - DNA, 340 bp, Homo sapiens
cagcctgctgggggttggagggcccagtagtagaaaagggcttcatggtatgtaccactaggaggcagctgcagaaaggaatcctgagaagtcagagggagagagcaccactatgtcagggtgtggtctagtccatacctatccacagggaagctctgatgaattcaccaatgaaccccgtgcctattgcctaaatgtgggtgttgccatgtttgagggcatttgacaggatatttttgtgtaaggtgtaaggaaggggtccagtttcaattttctgcatatggctagccagttctcccagcaccacttattaaatagggaatcctttccccgttgcttg

SEQ ID NO: 148130 - DNA, 393 bp, Homo sapiens
tgataacatgttaaactactactaattttttggactttcctgttctttctcactgacagttatgtcttgggggtcctgggggaggtgtcaaactgctattgttggcattcctacatatgtccttgatattttttctactttacatggaacagaaagtactagaaaatttgtaagctgaagatgcctttttgaggttcttgcatctgcgctatgacaaactgctaaacatgtacagttcttgagcacaacattccttagcactataatttatatatccttttttggtttagattaaggactttaagtacagtcctttctagaaaccaggaaacagttgttaaggtcctttccagcctcataactgcaaaacctctaatgtcactgctgtactaa

SEQ ID NO: 148131 - DNA, 474 bp, Homo sapiens
cagagtggatagatatccacatgaatttgacagattacacataggtaatgctttagagttttttgaacattttcagaaacagtatttttaaattttatttgcaaggaaaaaatgcttatcagtggcaagtcaggtagggtcatgttcaacattggtcaattatctcacccattctgatcacttgctctgttcccgccactggctcttcttctccctcttaaatatattcaggctccaaggcccgctctctagactcttttctatcttttaagagacaaggtctcactctgtcacctaggctggagcacagtggtgcaatcaaggctcactggagcctccaattcctaggctcaagtgatcctcccacctcagcctcctgagtagctgggactacaggtgtgagccaccgtgccccagccctctgttttataattagctataaattcagctactctcgttctgccgatgaatctc

SEQ ID NO: 148132 - DNA, 356 bp, Homo sapiens
caatttaactgtctgtgtgatgaggatattggaaaggagtttctgactgattcattgttcacacttgcctctcccagccgagggataattggggccttgcctaatctgcactcgctcacacccaacatgtgctgggcggggaaaaaaggctgcaacctggccggctggttcccggacctggccttgcaccaaccaggaagatctcttctctacctccttttctgtgttcaaggtgatacctgcttaggactcccagaaatatcattagcaggaaagttccacagatttaatctagtctaaacctctgagagttgaggacactgagacccagaaaacctgagtgattttcctaggaa

SEQ ID NO: 148133 - DNA, 525 bp, Homo sapiens
tcaacccaaaccacagaaaatgacagtgccatacagaatctgagcgttacatggcatttctagaaggagttgtgcagggtttcaaccctgggcacttcccctcacactcctaagacaagggacaacctgacccagcacatgagggagtaagacatgaaactctgccagctttggcagaggcaaagcaggaaggggcctgagtaaggaagtagaaagggaaggtagaagatcaagctttaagacaggaggatgaatatggactttgaagaagatgtgaaaagtgagagtgggaggaaaaggctatctatgaataaggggaggcttagggctcaagcaaggaagggccattgtggactggctggaagagagaaactgtaattggaaaggggaatttttttttcccttcacaaatgaaagacaacagtagaagagggaagcaatgggaaacaacagctgaacctgccctttccttccagcctaacctcccttcactgtcagcagcactgggaagggagcagcactggg

SEQ ID NO: 148134 - DNA, 241 bp, Homo sapiens
aaagttgccccacctctctgagcattggcttccccatctgtgaaagaggagtgctgatgtttgccttctaggggcctagtgaggcttaagggtgagcagcaggcacacagaaagctagaaatacaggatcactgtgggacggtggggctggccacctgggcaggccacttacccagcggccccctctgtctccaggtgttcatcggcgtaaactgtctgagcacagacttttcctcacaaa

SEQ ID NO: 148135 - DNA, 563 bp, Homo sapiens
gtaaatttatagagacaaaaagtagattcatggttgctagggagaaagggatagaaagtgatggccaataattacgggattttcggggtgggggcggtgaagaaatgctctggataacggcaatgcttacacaacgctgtgggtacactaaaaaccactaaatttcacacattaaaagtgcaaattttctggtgtgtgaattatactcattcacgattttcaaaaacactatgtatcaaaattgtgtaacttaattaacgatgtacttaaaaggaaatttatcactttagttgcttaaattttaaaaatctaaattaacgaaataagcatctaatttaagaagtcataaaataaagtcaaaaagtcaatccaggccgagcgtggtgtcacgcctataatcctagcactttgggagcccacagcagggcggatcagttgaggtcaggaattcaagaccagcctggccaacatggtcaaacctggtatctactaaaaatacaaaaaaaaaaattagttgggcatggtggcgcatgcctgtaattccagttacttgggaggctgag

SEQ ID NO: 148136 - DNA, 567 bp, Homo sapiens
cggtcgatctaaggatccccaagatggtcctcagctgaggggtcacaggaaattgagaggactaaaaccaggacctgtgagagggaatcaaaagtgttttgcctggagaggaaagctgaccaagactgcctaaaataactgatggctgtcacttgagacctttttctttagaacgctaaactaggtcctttagttgtataaaccaaaagtaaaatcctaagcaccccagccaactgaatggatcccatcttggccaaggggattccaaagtaatcctgaaaaactagttcagaccatgaaaagaaggagggggtcagacatgcctcattatgccctcctcctcctgaaggttggaataggaaacacttgccatctgtcatctctaagtgcggccacctataagacctaatcttcataacaaccttggcctccccttatctccagcccagacactcctttcagttgattccaggtttttatttatttactttttgagacaggatcttactccgtcacttgggctggagtgcagtggcgcgatcacagctcattccagcctccaactcc

SEQ ID NO: 148137 - DNA, 122 bp, Homo sapiens
ccgagattgcgccgctgcactccagcctgggggagagagcgagactctgtctcaaatagaaaagaaaagaaagtgtccctggttagttccctgctgcccttcctcacctcttccttcatgtc

SEQ ID NO: 148138 - DNA, 558 bp, Homo sapiens
catgttatcctacataatggctgaatcaagggatgctctcaacataggagtagagctccaacaataacctgctcagtgcctctggctagaatccttttagcaaggtcacaggagatattctccatgggtgtcttgcatttctgcacatattgcaagaagaggacctatcttttcatggatatttgtagactgaacaacctgaaagacagagataatatctcccttctgagcagaggacatgttttctttaacacccagtataacaaaaataatatttccctcccaggcaaaagttgagcaggtttacttgcagtccattataaaagatccaggttccccaaactcagagttatccagctgtcatgcaaacacaacccaagtgtctagcctccatttgcgctgctctgggtcacacctgtggatttggggtgcttggggagcatggcgagctggtgtgaacttgaagctcataccactggctgtgccacagtaataaagtcttttgcctaggacccaggagtctcgtgtcttttgttgggtaaaatctcagatccatca

SEQ ID NO: 148139 - DNA, 533 bp, Homo sapiens
ctctgtatttctttccctcatacaatttccttcttgctgttctccctccatccttttcattgaggccttcagaattcctattataagattttgttttaatctatcccacaaaccctacacacaatctctttttttgttgttttcttggcagagtctcgcatcgtcgccggggctggaatgcagtggcaggatctcagctcactgaaacccccacctcccaggttcaagcaattctcctgcctcagcctcccaagtactgggattacaggcgtgcaccaccatgcccggctaatctttgtatttttagtagagacggggtttcaccatgttggccaggctggactcgaacccttaacctcgtgatccgcctgcctcggccttccaaagtgctgggattacaggcgtgagccactgcacctggccagttcttaagttttagataggtttcgataatggtggaacttagaatggataagacttgtgggccagaaacttgagcctatgatgactagatttcttttgagagaaagtct

SEQ ID NO: 148140 - DNA, 831 bp, Homo sapiens
ctctctctttctctggagaagagcaggaaagtaatcccagctaaccctcatgcagccaccactctgtgtcagaatctcttctaggccattgcattgaataagtcatttaatccatataaacctgcaaggagtaggtgatattgttaaccccattttataggcgaggaaactgaggcatggtgaggttaagtgaccagcaaggtggaaatctgaggtttgacccatctcctggtgtggagtccagttctctcagcttcactgatccttcctgatttgtgctgagttagggaccccttgggaagcccccatgggcagggggtgctggtgctagcatttcctgtggattatgggagggggatgtgtggaggacctgtgtctactgttcctctagcctctgggggatttggagaacccactctgcccagagatgtaagtcatctttggatatagatgagacttgttccccctccccctgaatcccagggcacagctctatggaataagctctagctggaacttgtaaagtttggcccagccctccctgggaggctaggaggtggggaagagccaggagactcgaagtggtggtggtagttaatgtctatgtggttagacgttaaccagttactctgtggtgccaggcactgtcctaggcacgctatagttatcattgtctcctttggtgcccccagacagcccagggtcaagacaggtagcctcagtttacagatgcagcagtggaggcttgcacaatgagtaggtggctttgttcaaatcacagacctaggccaggtataaaagcctaagtgtggtgtaattccagcactttgg

SEQ ID NO: 148141 - DNA, 254 bp, Homo sapiens
cttagtattcactggaatttcagtgcgctgtgctctcaatgagatgggctcaagagcatgatggtgaggtcctggtacggcgcggctgctcaggccatctgtacaaaccactaaggcgaccactggctcacaaacttctcaggccatctgtacaaaccactaaggtgaccactggctcacaaacttaaaacatctactcttaggacatgtttaaatagcttgctgtcactatgcaaaggaaaactgttatctcc

SEQ ID NO: 148142 - DNA, 168 bp, Homo sapiens
caatacaggtggccactaggagctagaaaaggcaaaaacaggattctcccctagagtctacagacggaatgcagtcctgccagcaccttgattttagctcagtgaaattgatttcagactttagacctccagaattacagaataataaattttttttttttttttttt

SEQ ID NO: 148143 - DNA, 414 bp, Homo sapiens
gagttcaagatcagcctgggtgacctgtttctacaaaaaatacaaaaattagctggatgtggtgacgcacacctgtggtcccagctactcaggaggagagcttgaggttgggaggtcaaggctgcaatgagccatgattgagccactgcactccagcctgggcaacagagtgagatcctgtctcaaaaaaaaaaggcaggatattgtcacagtccctaccttacagaagattgcacactttatagctcaaataatactcaagccagatctcaaggtactaaacacacatttgggataggggtgatggacaggcagagacttgagccagggctgcctggttagccaccccgagggccagtcccagcttcctcaccaaccactgagagatcccaagtatgtcctgccctcttttgt

SEQ ID NO: 148144 - DNA, 197 bp, Homo sapiens
ctgccaaagtctagaagacaggcaagcatcataccctgaagctctctcaagcactcagaatggataaactctcttatgtcatccagttctgcaccttattctttgtggcacagacctttccaagactcctctcttgaccttggccataggtggccctttctagatcatatgtggctcaaccctagttaccatttact

SEQ ID NO: 148145 - DNA, 604 bp, Homo sapiens
atttaagctaggagggttgtatgtttccaggaatttattcatctcctctaagtttcctagtttatgtgcataaagatgttatagtagccctaaatgatcttttgtatttctgtggtgtcagttgtaatatctcttgttttgtttcttagtgaggttatttggattttctctcttcttgtcttggttaatcttgtgaatggtctatcaattttatttatcttttcaaagaaccagctttttgtttcttttatctttttttttttggtttcaatttgatatagttctgctctgatcttggttatttcctttcttctgctgggtttggatttggtttgttcttgtttctctagttccttgtggtgtgaccttagattgtttagaaagacttagaaagttttccagactttttgatgtaggcattcagggctatgaactttcctcttagcaacacctttgctgtatcccagaggtttcgataggttgtgtcactactgtcattcattttgaagaatttttaacttacatcttgatttcattgttgacccaatgatcattctggagcaggttatttaatttccacataattgcgtggttttgaaggttc

SEQ ID NO: 148146 - DNA, 210 bp, Homo sapiens
agagagatgagaccaggtgcagtccattgagatgtgaaatagagaagtataaagcgttgagctaacgctttatacttcttctcaaaggcagtccctccacacgttgacttgatcctgtcctctccattctctcaaggttatgctgcatgtactatcccctcttgcctgtgtgactttccctgtctgctctgtatttgctttatccatcca

SEQ ID NO: 148147 - DNA, 415 bp, Homo sapiens
gaagggggcacaccacacctcagagccacatgaggaagcaccaggagtgcttaggaggcacagggaatgagagaaaatgtaggcaagcctttctggtgatttccaccagaaagaattggctaggcagagtaacccagttcaggattggctagtttgaataatctcagcaggctctagggtagagagcctgtctttagttgtctggtacctaaccctggggtgattagggaaggggtctagtggtctggattgtaagagccagacaaaagaggtggttggggtgtgggcttcgggttggttggtctgcatatatactcctccttgtaggtgcgtcctttactatctctaggaattggctggccctgagaagagcagtctccccaggttaagcaaggccctacgaagtcaaagcact

SEQ ID NO: 148148 - DNA, 203 bp, Homo sapiens
atccccgcagtttgggaggccgaggctggatggtcttgatctcttgacctcatgatccgcccacctcggcctcccaaagtgctagaattacaggcgtgagccaccgtgcccagactaacatcccaatttttaataccaaaaattaccttaaaaataatacttactgaggctgaatgtggtggcttacgcctgtggtcccagca

SEQ ID NO: 148149 - DNA, 312 bp, Homo sapiens
taggctttggttcccaagttgaccactgactggaaagaagtgcttgatgggcccctgtgtttagcatctcaaataatgcacctgaagtcagaaaggaggacagtgctggacctggactccagtgacagggcagcaggtcaccctgcacatagacttcttgggctgaaagccaggaaagaagatgctaatgggaccagcaacctctcacgctcactcatagttcctgggcacatggaccatttcaaagacagctcgccttcaaactcagttctcatctggggaaggattcaatctagtgacaagcagttatta

SEQ ID NO: 148150 - DNA, 232 bp, Homo sapiens
aatccttgggataaatgctcttgggtaaatgctcttgggataaatgctaaaatctttgggataaatagtcttgggaaaaatgctcttgggtaaatgctcttgggataaatgctatccttgggataaatactcttcggataaatgctaaaatcatcgggataaatacttttgggataaatgctcttggataaatgctcttgggataaatgctaaaatccttgggatagatact

SEQ ID NO: 148151 - DNA, 986 bp, Homo sapiens
catcgtccactcaacctgccagtgcatctagatgactcatacatttatgctcttctgcccatttcatctggattcctgaagtccatgaaaatttcatcttagagtctacatttgggcttttccttgaccataacctcttatctggcttggtaactacctgtcatagaagatctctcaaatgacctcatctccagaatttacctgctgctgaccagatactttcatcgtcatgatcagaaggagagtaaggctctgcccttggatgtgaggccctaccttataatgtggcttaatggaagggcattggaaacccaagttcaaaggtcaccctgacacatgaggcactcataggaataattagcaaatggtaaaatcagctcagcaaagaagcaagaactgaatataagcacatcaatagaaagttctccaggggctggaataccattttgctaatattaatattccctacagtgactggcatatattggtaatatatagctttgcacatattggttttcaatgtatatctcttacatgcatgcataaaaaatgtaatatattccaaagtctgccttcataggcatatgttgcttctgcctttggggaacatttaaagagaaaaaaatcaaggcagtgggctgaattgctctatgttgttttatttttatttttatttttgagacagagccttgctctgtcccccaggctggagtgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtcttttttttttaatactggaagaaaaaatattctgttgtgtctcatacagtgcttaggatgtctttcacagagcttattaaaaagataaaacccgatgcgccagg

SEQ ID NO: 148152 - DNA, 588 bp, Homo sapiens
caacgatggtcctcagctgtgagccttaaaccagccttgtgacttggtttcatctccttttaaccacagtctggggtcagtcctgcctgtcagggactcacgcagtgactgagtgcacccttgtcccagagctagccctgttcctcaaggtcttagaggcagtccagtctgcccagggaccagacatgttcaatgcctgctccttccctgaatagactcaccaaccacaaaccccactgtagactcagcagcagccatgtgactaaactaatcctggaggcaatcccttcagagacccaacagatctttatctgccaaaaatcagtctgtaaaggctgaaagaggtgtttgctgcttcaaattgagacaccaatgcaaggctctatgaataataaagaatcaggccaacatgatgccacagctgggcatggtggctcatgcctgccatcccagcactttgggaagctgaggaccatcgttgcaacgatggtcctcagcttgtccagtcgctggaaattccagtgatgagattgcagctcatgaaggtctgagtgagtactacagggaagcgatactctgagtaccaca

SEQ ID NO: 148153 - DNA, 320 bp, Homo sapiens
aagcatttacatatgttcttttctcatatcaatgagatagctactattaattatccccatctcacagctggaaacactgaggctctgcaagataaagtgatcacccatatcatacagctagtaagtgtctaaactgggatttgaattgagatctatctgattctttttttttttaataaaaaaatttttttagagacgggttctctctctgttgctgaggcaggagaatcgcttgaacctgggaggtggaggttgcagtgagcagagatcatgccattgcactccagcttggacaacaagagtgaaactccgtctcaaaa

SEQ ID NO: 148154 - DNA, 375 bp, Homo sapiens
tctttttggtagagatggggtcttgtcatgttgaccaggctggtctcaatcttctggtctcaggccatccttccacctcattctccccaagaactgggattacaggcatgagcaactgcacctggtccatatgcttcttatagttgaagaagtgaagggtcaatgactttactaaaatactattaaagtaataaagctaggacttagccccaattattcatccttaaagtccaatactttcaatatattaagttgctctttattatatgaattctaaatatcttttttaccttttgttatctaatctggaaatcctatataaatgtataattttatacatgctgactgatatcctctctagtcttccatactagg

SEQ ID NO: 148155 - DNA, 337 bp, Homo sapiens
attacaattactgttgtttttaacccatcagagagctgagaaagtgaagaatcctagttgaactacattccagaaagtgacaagcccttcttagagaagaagagacacatgcttgctctcatttctcatggtatgaaaggagaggaaatctgctattgaaggagaaaagaaatcagtcaaaaccttattgaacttctaatgtccatgggctggcctgcagacagattacaattttaagaagaccctatcaaagagcaagttggtactcacccaataactctttcccgcaggtctccacaagtaataccctaaaggctgccagcagagctgagagaga

SEQ ID NO: 148156 - DNA, 629 bp, Homo sapiens
tgatcttataactattgcatctcttgtttagaaatttattaacttagtttaagggtgaaaacagtaattttaccttttttgggattgtgtgtgtgttttcatttttatctgctgaatttcaaggtcacaccattgtgccactactgatttccctcttagtaaggtcaatactttacactttattcattgctgagtagggtcaacactctgactggcagttatccatctagtcaccggtagcaacttctcttagactgcctgatgtattttagttgtgaatcagaattttagagctagaaaagaaaaaatgattatgtagttccatgctcactttttttttgttgtttttgaaacaacagagcgagctccgtctcaaaaaaaagaaaaaaagaaatacatatctaatgttacagattgtggtttattggttaattactatgcatttttttcagtttaaaaaataatcttattttatatacttctctcggtataatttttcatgacatttcagcatgttgataatatgtgtgcatctatttcagtgccttaaagtattttgagagcaatcttttgctgacagttgaagaactgttaatgaaatactgttcattaaaaggatctgtgaaatc

SEQ ID NO: 148157 - DNA, 222 bp, Homo sapiens
aacctgctcaggttagtggggttctgaaaccgagaagggcttcaccaggagaatggcatttcaactaagccctgaaagagaaagcttggtgagaaggggtgggtgtttgtggaagacaagacattccaggcagcaggaacagcaaggcgaaggccagaagcaggagcgcccctttggtggagttgaggaattacaaggtttgtatgtggaacacagagtggg

SEQ ID NO: 148158 - DNA, 362 bp, Homo sapiens
ttttctaaaggccctttttgtagcaagttccctgtggatccttcgagaaatattttgagcacatacaagcatgtgtgtaaatctctccagtattttacacaaatagaagctgactgcacattacagagcactgtgcttcctcactatgtatcttggaaactgttccacatcagcacgtggacatctatttcctttttcatcatggctgcatagcagaaaatttgtctcttgtaaaagttccccaagcagttgtgagagcaggctaggtgtggggttgacgggctggttggtgctgctagcgggttgaacagcccttgattaaaacagcaagggcagcatccagcatgagccgagccctggga

SEQ ID NO: 148159 - DNA, 306 bp, Homo sapiens
ccatgttgggcaggctgttctagaactcctgtcaagtgatccgcccgcctcggcctcccaaagtgctgggattacaggcatgagccactgtgcctggccttaaatctttttaagacagatttttgctatggaaatttcacaactatgcaaacatggagagactagaatactgagagccggtgccacccccagcttaacagttaccctctggcagccagtccagggtcctctgtgtccccacccactgctccttcccctgggttattttaggcaaatcccagacatcatgtaatttcctccttcttc

SEQ ID NO: 148160 - DNA, 191 bp, Homo sapiens
ttggcagcacaagtgcttctaaattcatcacaattctagaaatctcacctgttaacaaaagtagttcctaaagagtatgtcatttttatgagttttaatagctggttttctattaaagtgtataagataccttgcttttatgagaggattacacaaatgtggagagaaaaaaacaacagaaaaaacacacc

SEQ ID NO: 148161 - DNA, 268 bp, Homo sapiens
tcgccttctggggcagcagggtcacggtgggggggctagtcctctctttcagcatcttgtttctcagccgtccctgcggctatttgtgcaatgtctgtctgtctgagtctccgggtgagggcagacaggatatggtgcgaggaagtctggggtaagtgtgagccgaaccccgccctggagtctctcggggttgtggggccacagccccagcttaggttaggccttcactgctgctggcagggcctccagagagaagtgcgcctgggtg

SEQ ID NO: 148162 - DNA, 385 bp, Homo sapiens
cttgaaggaaattgtgtgcctggtttcttaactatttgaaatctcagtgctctttaataaccatttagtgattctagactagagaatgagatggcttttctaataaattatcattaagaatgtataacaccatctaaacttggaataatctttctttctcttcctttaagatttagtcttcatgacctcctaattgctaaatcaattagcctttttctcggccatcatccctcagaacctcagctgtggtggatacaatgttgcttgccttactgacttgctatctggcttccatgggagtctaccggctggacctggttctgccctctagacccacaccacgcaatcttcattcctttcccacatgactgcactgtagctattt

SEQ ID NO: 148163 - DNA, 475 bp, Homo sapiens
caataacaagaagaaccttataaattgtttaaatacatgaacattaaacaacatgttgctgaacaatgattgggtcaatgaagaaattaagaaggaaataaaaagttttttgaaataaatgaaaatgaaaacacaacataccaaaacctatggaatactgcaaaagcagtgttaagagtgaagttcacagcagtgaatgcctacatcaaaaaaagtagaaagatttcaactaaacaacctaatgatgcacctcaagaaagtagaaaggtgagaacaaaccaaacgcaagattagtagaatgaaagaaataataacaatcagagcagaactaaatgaaatcgagattaaaaaatacaaagaatcaaaaaaatgaaaatttggtttttgaagagataaataaaaccaataaactgctagcagactaaccaagaaaaaaggaagaagacccaaataataaaaataaaaaagtgacttt

SEQ ID NO: 148164 - DNA, 466 bp, Homo sapiens
ctccttctactaccatcaaagtccttgatctgtttcccaacatgaattaacctttccatgttttcgttacatttgaacatcaggaatgtgtagacggaagcagttcatcctgggaggtgagaatgagcattgaaagagccatccgtgaaaccgtaaggctgggaaagagaagtgaaggggcacatggaagtgttcatctctggggcagggaaaaacaatccggagaagatgagtcacacctcatttgtaacccatgaatgaaaatcaatactgttacttatcataaattacactgaacatagtgcttacacttgagtatcaatgcagtaaaaccactatgagccaattgattgacttttctagatcccaattctatcattcatcttctggtattcatcttctggcttagctactatttcctggcacagattcttaataaagatcctttctccttggtcccagatgt

SEQ ID NO: 148165 - DNA, 368 bp, Homo sapiens
atgcagcagacactgtggcggttgttaaatatacaaagaaaaaaacctatagctttcccattagggaacttcatccaatggggggacacgagactataaactattacgtcaccacacaataagtgctagggcagagatgggtagtatagggcactctggatgcagaaaaggggtaacgcacaaaggaaggccaggtagaagagacgattattcaagctgagttttgcaagatgtccacagtcttcgcctgatccacagtcttcgccttgatccacagtcttcgcctgatccacagtcttctgcctgtgtcacaaggtcattcgcctgatccacagtcttcgccctgatcaacagtctacgcctgaatg

SEQ ID NO: 148166 - DNA, 484 bp, Homo sapiens
caacataggcaattcaattgagatgacagtactgtattagtttctgatataaacaaatttaagacatcagtatggggaatacacggtgaataatatggaaagctgtacctgtaaaatacttggacattttgattttatagtcagctcactatttgccaacaatgtgtaatgctgccacaaaaagctgataagattttgggttgcattaatagaattaaagtatctgggttgaaggaggtttcaggcataattgaagtctccacaagtttctgatcagaacacatcttaaccattagattcattttgaatgatggacttctagaatgatacaggcaaagtggagcttattataagatcaagaatgaaggcaaaataactaaataacaggtataactgacatcaagatatttcaacctggaaaaaagaaaatttagcatgagacaaagacctaatagatatcttgaaatatttagatatctgtcat

SEQ ID NO: 148167 - DNA, 439 bp, Homo sapiens
gaaacctgggcccgtataccgagaagaaggatggccattgaaatgaatagatgcaaacttcagcaatgccaggaagcattagagccacactcattatagtagaggcataaaaacagctagtcctcctttatatgtgggactgtccctagtgaagacatccctcctggaacagctgcattttccccttccttccttccttccttccttccttccttccttccttccttccttccttccttccttccttacttactttctttcttagctttctttctttctttctttctttctttctttctttctttttctttctttctttctctctctctttcctttctttcttttcttctttctttctttctttctttctctttcttctttctctctctttccttccttccttctttctttctttctttctttctttctttctttcttt

SEQ ID NO: 148168 - DNA, 335 bp, Homo sapiens
ccaaagctctggacaaaggatttccccagctattttgcagcttccaattgcagacacaaaaagaaagaaagagagagagagagagaaaaaaaacacattgctagaaaggctgcagtaaacttttatgttactgttctgattgtctttgcccaaaaaggtgtcttggaaattagccttcagcttcagagaaagggacccataagtctcagaagtcaacaggatgttcacctgctgcacagtgtggctttgtttgtttctttgtttgttttacacttaattttagagtcaacattcttttctgcagcattcacctgagaagctggaaatcaaaagct

SEQ ID NO: 148169 - DNA, 423 bp, Homo sapiens
gcctgatgacagcttcgaatccccatcagaagaaaacccagcacctggttcaacgtgtgagaaaccatagcggggacttttgggagagtccatcacacacaccatgaagctcccatgaaagcacaaaagaagtgtctaacctgaccggaggagttcaagagacagagcgaagaccagcagctcctcctccagcttccaacgcagagcgcagtcggcgagactgcagctcattgccgctcagggacccctggaaggcggcctctctccaccagcttcaccttcaccgcagctgcggaagctcatgctcccctctgcagcctgcggctttgattcctggaacgcagtaccgcagacgccacaggcatttttatggggaaaccgctctttctgtccttgcctgcactcccaggccctctcctacct

SEQ ID NO: 148170 - DNA, 168 bp, Homo sapiens
ctgaaaggagaacatctgtagatatcagagatttctctctttgaatctctagcttctcagacctagaaactctaattaccttagtctcctggaactcttggctttgtacaactctaggagcccactttctctgccccactgctggaaactctagccactaaattaggg

SEQ ID NO: 148171 - DNA, 308 bp, Homo sapiens
tgtctgtgagctgtgtgtgtgaggtgtgtgtctataaagtatgtgtgtgtgtgagatatgcctgtgtgtgcatctgtgagctgtgtgtctatgaggtacgtgtacccatgaggtgtgtgtctgtgagccgtgtgtgtgtctgtgagctgtgtgtataaggtgtgtgtctataaggtatgtgtgtctgtgaggtgtgtgtatttctgtgaagtgtgcaagcatctatatctgtgagttgtatgtatgcaagtgtgtacgtgtgtgtgtgctttcaatctggtcgctgactcccttcacacactcagctg

SEQ ID NO: 148172 - DNA, 350 bp, Homo sapiens
ctcgcgcctgcttagcttcaagatcagacaagatcaggcgtgttcagagtggtgcagccatattcaagaagaactaaaaagtgtaataaaataagaacacaagactatcactgaaaagaagttcacaatttcatgcacacacatgaaaaagttataggccaaaagcaatatagacatgagagtctaggggaggttaacagcatccagtctggagtccgagtacttgagagttattctaagtttctcatttctctgtgatcttgagcaagttatgaaattctctttgcctcaattctttatattgttaaatcaagtttagactaaagctgccttttaacgtattttaagtt

SEQ ID NO: 148173 - DNA, 137 bp, Homo sapiens
aaggccaaaccaaagtctcactcatttaactatgaacttgtgattatgatagagaactccagcacctacttctgtaggggcattctgttctagatgccaaccagatgcctgaggtgaagtgcaactggagctcagtg

SEQ ID NO: 148174 - DNA, 330 bp, Homo sapiens
aaattttatcttttttgggacattctcactctgttgcagagtgtagagtgcagtggtgcaatcttgactcactgcagcctccgcctcccgtgttcaaaaaattctcatgccacagcctcctgagtagttgggactacaggtacgtgccaccacgcctggctaaaaatacaaaaaattagccgggcgtggtcgcgggcgcctgtagtcccagctactcgggaggctgaggcaggagaatggcgtgaacccgggaagcggagcttgcagtgagccgagattgcgccactgcagtccgcagtccggcctgggcgacagagcgagatccgtctc

SEQ ID NO: 148175 - DNA, 310 bp, Homo sapiens
aaggacgatatctagcagacatctagctcaccaaaaatgaaagaagatccacaactgcataaaacatttcccaggaaaacctccaacctaaaaacacctttgtgatagtttattactgtacagtaatctggctacatattatcgtaaatctcaatgtatgttttctgcttatttcatattttgtcttccggttaaaagacagctaggtgataggaaacaacacgctaaacattcagggctctaagtctcaattaagtgccaagacacagggcagcctgtgaatcacagagattaattcacagcaggtgtg

SEQ ID NO: 148176 - DNA, 305 bp, Homo sapiens
ctggggccagtagctccctgttttcaaaagcaggtgtaatcaagcaggtaaatctctgctctgagcagacatctctccttggtcatgtcccattttatttcttctgattagagattgaacaggctccacctgtgcttaataacatcgctgctggattggacgtggcagcacccttctcctgggctggagtgtagaatcccctgggactcctccccattccttgtaccacctgcctcccaaaggcagaggcctattgtgctccctttgcaccacctcttactttgattcctttttcctttttcatt

SEQ ID NO: 148177 - DNA, 234 bp, Homo sapiens
gaagggctccaaacagagacaagtagactagttgcgaacatctgttaagtgtgaaaagggggaacaatgggaggatgtgggcatggttctgcagataaatgaagggcacctgctggggatgagccagcgaggtgggaaagaccagctcatgggaggctttgtctggtccactaaggagtttgagcattatccgaaaacaggaggctaagaaagcgtttcaactaagaaagaaat

SEQ ID NO: 148178 - DNA, 386 bp, Homo sapiens
gccggcaccatgtccctagcgggggggatcctgcccactatctaggtgtggctatcaaaggcatctaatgttaagttagtgttgacacgccagagatgtcaggaagcatagattgttaatgatcccaggagagagatctcacaaccacacttgtccacattcctggctactcagaccttagcctttctttttctctccctctttctctctttcccctcggacctacctcttaatatgtctctctacaaatgatttttaaaaaccatttaatagagaaaaagaaatgactttaaatttgaagacgtgttaatttttgtcatcattaagaataattgaacatactcagaatttgtggatttcaagtgcagatacagataaccttttgg

SEQ ID NO: 148179 - DNA, 249 bp, Homo sapiens
gagacaatgtatatgccacttagtgaaacttaatacttgtgtggtcacatgatgctgtgcaaagtataaacaggagtgagtcttcagtaaatgacacactatcttcttcagctgctcttataaagttaagatgttaagcagtatagcagctgtcagatgattttttagcagattagaaagaatactaattttaaagtttttgtatgctgttacctactgtactccatttacaactaagtggcaaaagca

SEQ ID NO: 148180 - DNA, 288 bp, Homo sapiens
tcaaaacttactacgtacgattcaatgtgaactttatgattgctttaggaaggaaaatctatagaggcaaaaagattagtggttgctcacatctgtaatcccagaactttgggaggtcaaggcaggtggatcgtttgagcccaggagttcgagatcagcctgggcaacatagtgagatcccatctctataaaattaaattaaattaaaaaggactgactgcaaacaggcatgaggatcttttggggtagcagaagtgttctgaaactggattgcagtgatgcttgcac

SEQ ID NO: 148181 - DNA, 263 bp, Homo sapiens
aagtctccataaatttagggttcttcctggagacttctacaggaccgtcacagtgatgggatcagagtcaaagagcttcacgaccacctcagtgacaccggaagggaacgtccgagtcagaagtgtgggaagccaccgtggtgacccgcagatagtactggtcaactcttgcgtgataaagagggatgagattgtgtataaggttgatcatggacaaacttttatgtctgcttctcttaagattggggaagagggagaagata

SEQ ID NO: 148182 - DNA, 217 bp, Homo sapiens
gtctcttcccgactgccagccctgagaggacaggtcccagctttcttccccgccgaatcctcagggcctggctctgggtccggcatatggtaggcccttaacaatcctgtgctgaatgaatgaatgaactgcatcataactgcctggctatgtctgcctctgccctgggttgagagctgcttgaagcaggcaccagctctgcttcacctctggatcc

SEQ ID NO: 148183 - DNA, 537 bp, Homo sapiens
  misc_feature (529)..(529): n is a, c, g, or t
  misc_feature (532)..(532): n is a, c, g, or t
tctcacttttataagaagtatccaatggctccacgcgatgttttgaagttgccctaaaaggtctttaggttccactgttcaccctcccatgatctctctcccccagggagccagagcttctatctggagcacacagatgacatcctctgtctcacagtgaaccagcaccccaagtacagaaacgtggtggccaccagccagataggtaggaggtcctgtggcagctgaggctctcccagcttgcagggacgctgacctgtcagcaattattgggagagggagtgggtgggttgcttacatccatcccttcttgttgatgttgctgttgattttttgagtcctgagtgtatctgtgtcacctgcgttgacacatccagtgactgtgattctgagggaccataaagtctgaccagcgcctgagagtccaaataaacgttggcccccatccctgtggacttgtaagaatagtttttcagaccccaagtgtcaagaactccagcctgagcaacagagggagactcttatttcnaanaaata

SEQ ID NO: 148184 - DNA, 801 bp, Homo sapiens
tctcacttttataagaagtatccaatggctccacgcgatgttttgaagttgccctaaaaggtctttaggttccactgttcaccctcccatgatctctctcccccagggagccagagcttctatctggagcacacagatgacatcctctgtctcacagtgaaccagcaccccaagtacagaaacgtggtggccaccagccagataggtaggaggtcctgtggcagctgaggctctcccagcttgcagggacgctgacctgtcagcaattattgggagagggagtgggtgggttgcttacatccatcccttcttgttgatgttgctgttgattttttgagtcctgagtgtatctgtgtcacctgcgttgacacatccagtgactgtgattctgagggaccataaagtctgaccagcgcctgagagtccaaataaacgttggcccccatccctgtggacttgtaagaatagtttttcagaccccaagtgtcaagaactccgtgtcttttgaagctggttattgtgcttggccagggtaggtttcagtaagtgtgcctggaccccctgtgccctgggaaactgccggtgacaaatgtgaactgattcacatttatgagaagtttgttttcacttagtcatctcgagcaatttttacaacttcctgcttgttttcattgaatcatgtccatttttaagtttaatttggaactttctgatgctggtgttgagtgcttcactgttggaaacgtgacttattttagctattgttttcccttgacgcttcctcattgccattgctcaccc

SEQ ID NO: 148185 - DNA, 552 bp, Homo sapiens
aaggaagccgaaagattggacaccccttctttaaaatagcaatgcaaggatggactgacataggcagcgagccccttttgctgggtaacattgttatggactgaattgtgtcccccccaaatacgtatgttgagtttttaacccttcatgtgactgtattggagatggggcctgtaaggaggttataaagttaaataagttcataaaggcggggccctgatccgacaggattggtgcccttctaagaagaggaggagacgggaggtctttgtctctgtgtgtgcctctccgtgtgctcacaaaggaaaggccatgggaggacgcagcagcaaggcagcccgcctgcaagctgggaagaggttgtcaccggaaccagcctgatggcacctggggctcggacttcccgctcccagaactgtgagaaaatacacttgtgtgggtcagcctcccaggctggggcacttggtcatggtaggccgagctgtctaatccacctctctttcaggacccaccgaatcccgaaaaatagagctcttccttcctctgctcgta

SEQ ID NO: 148186 - DNA, 794 bp, Homo sapiens
ttgccaagcattctacttatatgctttacatatattattttaatcaccacaactctaaagtatactaatttactgatgaaaatattgaagtgggctgggtgcggtggctcatgcctgtaatcccagcactctgggaggccgaggtgggcagatcacctgaggtcaggagttcgagactagcctggccaacatggcgaaacccacctctactaaaaatacaaaaattagctgggcgtggtggtgtgtgcctgtagtcccagctacttgggaggctgaggcagaagaatcacttgaactcgggaggctgaggcaggagaatcacttgaactcaggaggcggaggttgcagtgagccaagatcatgccattgcactccagcctgggcgacagagtgagactctgtctcaaaaaaaaaaaaaaaaagaaaaaatcaaattatatatatatatatatatatatatatgtatgtatgtatgtatatgtgcatagttaagtaaatcaccccaattttttctaatatttaagtgaacatttaaagataagcatttcttaatgttaatttcttttctttcatgtaatcttgtcagtagacaaatgatggtgactatattctgtaataagtacatatattatgattaaaaaaaaaagcgtgtactatctgcccaaagagatcataagcactttggagctataaacttcttgtctatttctacttccatggtactgatattctcttctcagataaccaaacaaaaacagctgaataaaatcaaccattaatagtaacttgccact

SEQ ID NO: 148187 - DNA, 484 bp, Homo sapiens
gaagagcaaccctctggtgtggggcagggaagtaggactgagaaacacccacgagagcaagcgagttatggggctctcctcccaaccactccccactttcagcacttgtgtgatgtcattctaggaacaccaccatcaccagcatggagagcagccgggaccccatgggcaggtccctaacctggtcctggtagttggattccacctctggaagtgagcatatctctctctcctttgcttctgcaaggaaggcacagtcccaagccttttccagcagtccccaaatttcactgactgccccatcctgaccttcctagctgtcctctaccctactgcagcttccactgcatgcgtgtgcatgcagtggtcagggcctcctgaaggcagttctgaggaatggctctggacagaagagggaagggtactacatgactcaatgtgtccctgagctgtggccagcagcggattggggagggggtctgtc

SEQ ID NO: 148188 - DNA, 369 bp, Homo sapiens
ttttgtagagaagcgtcttgaactcctagcctcaagtgatcctactgcctccacctcccaaagtgttgaaattaccggcctgagccactgtgtctggctcctatgttgtccttataagaacaccatgtgaagatacagagacacacagggaaaaagcccatgcgaagacagagacagagactgaagtgctgcagctacaagccaaagaatgctgaggattgctggcaaccaccagaagctaggggagaggcatgtgtggtttctgctgcagaccctccagaaggaactaaccctgctgacaacttgatttaggagtgctggcttcctgaattgtgagagaataaatttctgttctttaaagccaccaag

SEQ ID NO: 148189 - DNA, 311 bp, Homo sapiens
ttaagcaacacgagaaccccgtgtgggtgtacccagttcactgatgaggaagcgctcagaaggtagaagccctgcccaggactgtgcaaacgtaaagccagcgtcagggcctggcccatctcaacagttactccccactgtagaatcagggtgggagctggggggctctcctcagctgtaatacaagggtgtttctcacaccaaacctttgtatgaatagattcagataaaaggtcagcccacttgcctcaggccccctagtctgcctacttcttgtccttccctcctttttcagcagcaaaatccccttt

SEQ ID NO: 148190 - DNA, 437 bp, Homo sapiens
gcccgtgttctcagcctctccccctccgactcctgcccatcttcctggtcacatctcctcccaccgtctgccttgcttgctgagtccatgcatttgttcatttccccattcaacaaggaggtatcaagcaccactatttcccaggcacattcctagggtgtagaactgaaaaacacaggtaaagtactgcctccatgcaacagacattgtagttgaggaaacaggcgataagccaaactgataagagaaatataaggtgtgttaagacaaatataagatggtgacaaatgccccagagaaaataataaaatagggaagggaggcaggaagaggggccgttaatcagggtagccaaggaaactctccagcagccagcctcgttccctccccagaggcttcacagctgctgttccacacacctgaagtactgttccctc

SEQ ID NO: 148191 - DNA, 223 bp, Homo sapiens
aatatcctcaagtcttgagggaacatcaggtctcatcagggtgtgatcagcccacagtttgtgccagttcctttcatccgcctgtgggtgacaatcccttcttgtcccatcaccaccatgtgataatcctcgcctccagccttaatattgtctaattgtatgagacaatctgtccaaacaggtcttcctgtgttaaggtcagacctcgtgagtatgtgatcat

SEQ ID NO: 148192 - DNA, 498 bp, Homo sapiens
caggtttctattgtacaatttctcattgaaaactgcctcagcatatttggagaagacatcacttccctcttggagaagagctcaatgacttgtgacaacagtgatgcttcaggtaccttgaaaaattcagttggttttgatgagaaacagtgagtggggatgccaggagtcatgagagatgcttaggcagtggctgtcctggagtccagggcaagccccaagcacaatgatgcaggacccaggactccatctgctcattcttcataaggttggctcacaggtcatctgctgagaaggtcacctgctcctccttcactgtgctcactgaatgaggacattccaagatcccagctcctcccatttgaactttcctcttcctaatcccatgcatctatgtttgagaaaatattcccacatgattttctatcttcccatttcttccatgttgtattactttattattattaataataaatgcacatattgtgtatatgcata

SEQ ID NO: 148193 - DNA, 686 bp, Homo sapiens
aaagagggagtcagcacttcacatggccagagcagggtggggtggaagtgccacacttttaaacaaccagatctcacaataacttactcactaccatgagaacagcaccaaagggggaaatcttcccccatgatccaatcacttaccgccagatcccacctccaacagtggggattacaattcaacattagatttgtgtgggagcacagatccaaaccatatcattccatccctggcgcctctaaaatctcatgtccttctcacattgcaaaatacagtcatgccttcccaacagtccctcaaagtcttaactcatttcagccttaactcactcttatctgagacaagcctagtcccttgtgcctatgagcctgtaaaattaaaaacaaattagttgctcccaagatacaatgggggtacaggcattggctaaatactcctattccaaaaggaagaaagcagccaaaagaaaggggctacaggcactgtgcaagtccgaaaccccggcaggacagtcattaaatcttaaagctccaataataacctgctttgactccatttcttatattcagggcacactggtgtgaggagtgggctcccaaggccttgggcagctctgcccctgtggcttttccagagttcagtccctgcggttgctctcatgggctggcgttgagtgcctatgg

SEQ ID NO: 148194 - DNA, 655 bp, Homo sapiens
ttcagttgcatcctcctctttgctcactcatgtttaagtttttcctatagcaaattaaaagggaaagatacaggaaaagagagaaagagggagtgcgagcaagtgagcaaatcaaatgaaaaactgttggataagtttctgctatcctagatgatgtaataaaacccggaggtgagtcacagggcttaggtttaacctatttccttcatacgtgatataattattggtgtttttttctttttctttcttttttttttttttttaccaatttctgcccagtagcatagacgaaaagactaaagaaagtggtgactcctgaatctcaatagagtactggcaccacttccctacgaattactaaaaaagaatgagaagagaatcagagagaaggtataaatttgaaattttgccctttatgtcatggtgatgtgacaactaatatctctgcacaaatcagcatctgagactttaagtaaacagaccaatatctttatgggaaggagaggaaaatcatttttcctgcttagtcaaatgacaaataaatgtagctaatttataattcatccatgatacaaatttacagacctttggctctgaaaaaatgtgctttttacatttccatagtgatagttaacctcagaacactctatgatgg

SEQ ID NO: 148195 - DNA, 274 bp, Homo sapiens
cttatctaggttgggtaaaggcaaataagggtagtggtggaaaatgaaaatgatgatagggtacaaacgtgattgaataatataaagagtcgagttttagagcaagtaaactctaaagagaggatgttggggagagttgaacttttcaaatatagatttttggacactatacttaatactgatgatagcaacaatagtattactgatgggagttggtgggtgagactgggtgaggaagaggtagttggaagtgaagatatgatcagagtgctag

SEQ ID NO: 148196 - DNA, 382 bp, Homo sapiens
cccaaaatgaataaaattatcattggagttaagtatctagttgtgatcacttttggggagggtcttcattggcatctgggagagcctttgtaccttcaagaaggtacaagcaaggcttgaggtgatacagaatttaagagaacgatatgcaaattttatgttgctttcactggttttagctgctcttgataaagaaaggggccagcaagcttggttacatgcctatatgggcttgcctgtcataccacttttgtcttcgagcttctgaacctgactggcaggattgaaatgcaggcagcacctgatgctcagattgcttttatagttctacaacaagggtaaaaagagtgggtaaaatgtgagaggaacagaagccaatgaa

SEQ ID NO: 148197 - DNA, 464 bp, Homo sapiens
tgctgcggtgagctagaggacccgggccaatcccataacctgtatgactttctcgatattagtaaaatcattacataactttgtcaaagttaagatataggataaaccctgtatgtcttaatggctcacccagttcagttaggccttcaagacgctacatcccctattatagaagaactactcactttccatgaccacactcttataattattttcctaattcagttgctgcaactctttagaatcacctcctgctaggtctgataaaaactctactctggaaacagaatgaggtcagtgtcagttcgtttctacttcactttcttaaccctaggaaagaaggtatagatttctcatgccattcagtccagctgcgtatatgggacacaatgttaaccagtggaaataatacagactttatccttcaggtgaatctggtttgagtccaagctcaactccatact

SEQ ID NO: 148198 - DNA, 440 bp, Homo sapiens
agtgaggtcctagaagaaacctaggtcgaatccagcaccacgttggtttcagttggtcttagccagcttggcccacactctgatttttttagagtcttatgacccctagcttcttatgacccttattttaacagtttccttttgctggtcatgtgaaatggctgcctagaattttctattctcctgtgaccatctgtattattcctgtctcaccactaggtgtatctgtcttgcaaagatgtttagtttatttataaacatatttaaatacaaaatattacattaaatatttgttgttttgattggattatgtattgcatgagacttggtctgggttatgctgcagtaacaaatccctgatacaccagtggcttgtcacggcagaggtttatttctccctctcagtccatatccagtgtgggttggcagacagttctggt

SEQ ID NO: 148199 - DNA, 455 bp, Homo sapiens
tgcatgaaatgatgacttattttgatcactgagaatttttggtgcccctttaacctttgcacctggggcaggtgtctcacccttagtcctgtccccacaagacatgttccatcacctaacaacatgaagtgagtgcccatggtgtgtccgcagctgagctaggatctgggaatccagtcataggtaaaacagctacacacttcttcatccttcaatgtacagccaaagagatcctaagtcagaagggacagctatctgggcaggcagcctcatcctgtgctcagctggaagaaatggaagaaacgtggtacagaatgaaacagacattccacttacgtttcgttgttttgaccacacaccgtctgaaccgcaccttgtaggctgtggacccagggaccaccccccgcccgcccgcctagaaactaaaaatccccactacgccctttctcagacac

SEQ ID NO: 148200 - DNA, 360 bp, Homo sapiens
tgcacagatctacagcaaaatgttctaacggaattattatcactgatgtagaacaaagggtggtttttattttcagttttgcttattcatatttcaaaaatctcctgtagtgaatatgtattaattcctaaggaaaagaagaataggaatcttttgtaagtttctcccccagatcagcaggatcacttcagaaattcaccttaaatagtaatttgtttcctctcctttctccctatactttctgagtcctatattttgattccaataaatgagttttatcatttaatctgtaattaaatgtgaaccttgaatcttcctggtttatccaagtttgggtttgaaatcaggtgaagacaattc

SEQ ID NO: 148201 - DNA, 176 bp, Homo sapiens
agcttcaagtaaaataagtccagacataaaagctctatttactgcattgtctccagcccccccccaaatttcatccagaatcagtcaacagagacagacaggaagcagcaatatataacaagtgacttcaagaccgagctaagaacatcaacatctcactatgtgaaatcaagtag

SEQ ID NO: 148202 - DNA, 523 bp, Homo sapiens
tatgaataggttaagtaagaaatgttgcaccactacaaaagcctacataggatggaagaagatattaaaagttgctttattgtttttattttttcatatcatgttgctctttatgatttctcaggcttttgaccattgtaaaggggaagtaaagcttcagagttcctgtactgcagggaattagaatctattctctgtggttacaaatacaaattaacagaagtaaacatagaaaatgttatgtaataactgtctattaaaaccctatagggcccttgagttgcaaaggattacagttatcatgtggggaagcggaaaatgttttttacactgactttagtctgcatatttctatgactgcaggacatgtaactagaagagtaagcaataagtcctgttatctttggcaagcctttcctacctaaaccacactgaccactctttcccctgaccaaccaaaatgctacaatttggatttattccttttcagtgtccctgggtattttattctgttgttttctgc

SEQ ID NO: 148203 - DNA, 346 bp, Homo sapiens
cctgggcaactggggaataatatagtatatttgtttaaagcatagtctctgaaatcagactgactggctcgaaacccacctctaccacttattagctttgtgacaaattctcacctcccatgtctccatatttcatctattcacctatcactctcttcctcaaaaatcatcagtggctcatctttccacactgcctacaggataaagtcaaaactctccagcttcatctaccgcctatcttcttcacagccatcatgttccagtaagaaaggacatgtatcattcttttttgactgcccagcatttaacccttttcttatgtctggggaaatccctacctgccaat

SEQ ID NO: 148204 - DNA, 641 bp, Homo sapiens
ttcccaaagacttattttttccaagctatctgtggatttttgtggatggagcactccgtaatttaaccatgagattagcctaactcacttgatgtttacagagggaggaatgccgtacttcttactatcttttcttctgtgtttgtgcacttggataatttctccccgagttctcatatccctgatgttactcggagagcctgtctgcagcatctgctccctggtacggctggctcctgccacatgctctgagccatcggcaccagccgagcagctctcagagaggagatggcaatttgggatttccccccctttttttttattacaactttgtcagttattcccatgagaatacatgtaaccagaatgtgggggacactttagagaggtctgggggactcaaagcaaagactctccttgacagttttctcatttcactttttttattccttgcttggtgaacatgacttaaaaacaaaacaaaacaaaacaaaacaactcccctctgttttgtacctaaaagttttgtgtgtttggtctttctgtactaccaacaactgacttagctcgcctgcctgccttcctttccccaaacccttacccgattctgtctttctcttcttccctccttgtagccaacc

SEQ ID NO: 148205 - DNA, 375 bp, Homo sapiens
tggcacattctattcattgaagtagtcacagagtcctgcccaggttcaagggagtcaaaatggactccatgtcacaatgggaagtggtgatcatctggaagagcatgtgggcccattttctgggatatcttctctgtcacattccccttcctgggtctctgccatatgtctggcacagatgaagaaattcaggtttagagaggataagcagtttatttacctaactcctcaaaagttaccgagcccaggtctgtctggcttacaaagtcctccctgcctcatcctgggacgtttctttaactgcatgtaaaccatgctttgggtgcctccattatcctcatgtctttagggagttccctgttctttgatgagaga

SEQ ID NO: 148206 - DNA, 184 bp, Homo sapiens
agtgcattaaaagccaccatcaaatgtggacctggactcagtttccctctgttccctcccaccctcaaatgtggacgtggactcagtttccctgttctctcccaccatccaatgtggacgtggactcagtttccctctgttctctcccaccctcaaatgttgacgtggactcagttttcctctg

SEQ ID NO: 148207 - DNA, 180 bp, Homo sapiens
aggtcggtaccggtgttatcgatgccactgcctcagccaaccgtggactagatcccaaaatttatgtccagtctagatcactcccctcagctcaacttaaatattcagtgcctacttaactctccgcttggatgcctcccaagtatttacacagaactcttgctacccactcctctccac

SEQ ID NO: 148208 - DNA, 931 bp, Homo sapiens
aactatacaagatggtaatattgagaatgagcaggcacgttctcatgaactaatgagaaagtaaagcagtgatatgtttagttcctcaatactcccatgtcattccattatgttcaacttatatttagtgagtgcctactaggtgtcaggcactgtcatctctttattaaacattaactctctggccatgcatttaatagagaatttgacctactccagtccttgaaagggtcaccttataaaactcatgataccccatcaactctgctatacccaaccatacatgactggattgtggttggcagatgacaaggctgggccaatctgatactctttaccaggaaccgggaatgggatcctgggagcctgcatcagataacatgaagcacttgaactaccgggtcaggcggtgcgtgagccacagaagatgtcagagtaaacaaaagttgaagactcgggggaggccattctgctctaggagaaataggggagagggtgggggttgggtatcacagtccatgtacatacaacctacctgtatttcatttcttacctattcttgaatgtctaacacctatgaagttgcctactttgtcctttcaatatacctctcttttacttgtgacttgtatgagtggtgttcctattccttatgggcaaaaacactttagcattctattaagtcctgcaacagacaaaaagatgagaaatacttagtcctcctgccctaaaagaccatatggttaggaccaggtaagtatataaataaccatatataaggcagactataagtggcataaaaagtactatgaggtttcaaaaatagaggatcatatcatatccaattcagaacatcaaaacagtttcaccaatggcgaggcatggtgactcacacctgtaatcccagcctttgggaggtcgaggcgggtag

SEQ ID NO: 148209 - DNA, 517 bp, Homo sapiens
aggacggtgataaagagagtaaaatgtacatggagaaaatgcaagtccttaaaaaggcttgaaaatacattatgagggagatgagatgagaattcaggtcagagataagctgaagtgttatcattaaaaagccacattaaggttagaattagcaaatctaggatcttagaaatagcttttggtaattctctggatattgtctaacacaagtaatgacagtgaagatataatgaagaagttaaaatttattaaaggcacaattatatgtctgtctaagcactttaattcattatttaaatgtttgtgacaacccaacataattggtaccaatcattattctcaatgtacagatgataaaactaagacttgtagagattaagtaacttgtccaaagtggtagttgtcttttagcagtatcattactatttcttttaatatcaatacgtcctaaagccagtttataatttatttccaaatctaatgcattccctgtgttggtcacttatatcacacttct

SEQ ID NO: 148210 - DNA, 245 bp, Homo sapiens
tcattcctttctcaaagcccttattgactttctacttcaaggttaaaagcaacccaacttctttacttagccccaaaggccctgcctgatctgacccatgcttgcctcggggacctcactcagaaccactctctctgtggggaaaggacttggggtcttcgggactggaaggaggctaggtgaggaagtgcatggaaagagtggttctgagtgaggtccccgaggcaagcatgggtcagatcagg

SEQ ID NO: 148211 - DNA, 249 bp, Homo sapiens
ggcaagagaaaccctttaaacctgtaaaccgaagtttttgttaaaccaaattcccccccttgcctccaggctttgccaccaaaaattgaaaaccccctttccaaaaaaaaaaaaaaagtaacataactagacataccttcccaacttctttacttagccccaaaggccctgcctgatctgacccatgcttgcctcggggacctcactcagaaccactctttccatgcacttcctcacctagcctccttc

SEQ ID NO: 148212 - DNA, 1125 bp, Homo sapiens
gattctagctgtgggtctgttgtctgatgaaaagtctgaaacggtacctaaaactactaaattaattttaacatctttgagttgtttttagttctgtgagaagagcatatctattttggtttactcagtgagtagagtagtgtctaatactgagtaaatgtactgtaagtatttttgaaagaatgagtctttgggtttacataccctggggtttgtaaacaaatatctgttgattggcattaatcctgatggtatccaaggtacaggaatggcaaagggaaaagatagggcaatactgactgatgcttcaaaatcatgccctagttatgctataatcaagcaggaaatgtttatggaatggaaagattaaggaaaaggtatgttcttattttagcaataaaacgaataccagaagctttaacattcaccagtacaaataaatagtttcaatggaataggtcgaaagtaaagggacatcactagagtaaatgctagaccttccctctccttttatttttagcaacagcaaagcagaaactaagatctacaagtgatcaaagagggtgatccattcagtttctgtgtagacaggaataataataataccttttacatattggtacagtttgtaaaaacactttcacttactcatttaatcttcatagcaacttgatgaggtagaatactataggaagcagtattagctcaggttggtacgtaaattactgtgtttaaatttcaataaaacagctatggaatccaagacattcttggcgcctaataaactgtattctttgccaacagtgaaagtgcttctctgttgcttggtaagttttttccccttagaatactaataaagtaattgattaactttcatttttattttgatttgattgggacagcaatttagcagtaaaaaatgtcacctttataaatcctgtggtttctggttcttggccagttaaattcaacctgaccaggaggcacgcttaattctaaaattgcttttaccttctgaagtttttgtggtatagacatcctcctttttctactttaatgaaagcatgttataagcagatcataacaatttttttttctttaaaacaatattgtaattaggccagt

SEQ ID NO: 148213 - DNA, 327 bp, Homo sapiens
cggtgctctagcagagagggtcgggtagaaaggtaaatacattatctaggagtattgatttatttctagagaaaaatagagcagtatatttgccagcagcaaggaagtaagcacaagcaacagatactgtacatacaaccttcattttttgtttttctgcttttattgtttttaattgatagagtaattgtacatatttatggagtacagtgtgatattacatgtagagacaatgcataatgatcagatcagggtaattagcatatttgtcacctcaaacatttatcatttctttgtgataggaacattcgaaatctgctcttccag

SEQ ID NO: 148214 - DNA, 314 bp, Homo sapiens
ctattaaaccaggcagccacttagtccaactatttttgggtcccaaatttaacacttagtgtcttagaagaatttaattttcatagtccaaaaaggtcagaagcctggttgatgtaaaacaagtggtgtctattatttctctcaggaaggcagaaaaactagggcagggattactgcagctacagaatgactgtcctccacacctctccttgttcaggcggcttggcctactctcctgacagtgcagccacggaaaaagtgccaaagcatgccaacctcaaacagaggtgatgacagagaagctgaaatcctgg

SEQ ID NO: 148215 - DNA, 308 bp, Homo sapiens
cactactatccccccagctggttatgcctaaaagagactatcttagttttttgttcctttttatttccccaagagtgtagtctccacgtctccttaacatctccttagtgcagaacctcctctgcatcctatctgctactgccttggtttagggccccgttttccctctcccaggcctgagcaatagtttccccacacttcctcctctatagtcagctactcccaccatctatccttcccactttagacaaagggaactttctaagaagcaaatcattgttgttgactttttctcccttccaaaatac

SEQ ID NO: 148216 - DNA, 464 bp, Homo sapiens
cctgaccaccttccactagactgtgagacagaattctcactctttcaataaatgtttgaccttccactgctacacagttgatgctactttctgaatgctgatttttacaataatttgttcctgtatctatattgcattgtgctacctagctcaacattttctttgacagtcatcagtataacattatatatgctaaattatattttaaaataacttatgaaatcaaatatgatgatatacttgtgaagagactgcaacacaatagtgagaaccactgccctggaaaatactcacctttattaggctacagacataacaacccttgtgtaatgggcagaaggtgccagtggcatagccatgtaaaactccatacccctttaatatgcttttcttccactgacttgctttttctgaaaagaaattactgccagtgaatgctctcatgcttagcttttttttttttt

SEQ ID NO: 148217 - DNA, 677 bp, Homo sapiens
ctgtgaggttgcctatgctggtgtctgttttagttatgtctttgtaaaatgcattacttaatacagttgggtccataaaagattagtatgtatttgactaaactgccaaaaatacaaagaaagcagtggaacagttactttaaaactggtggggtcagatggtccagaacaaaaataaattccaataattttaacttccctgcactgtcaatcttatggacaactactgctagaaaggtccaataaatgctatttgttctaagtggtagatattgccaattgatatagagcccatggctttgtttagacagggcaaaaagaaactggacttgtactaattgccgatagatatcatggccaactttccattcaagcagttccaagggaagtgctttccacagcatttaatctcttgaacatatgacttctattaaaggactgttcaggggctatatatatcatttactttttgaaagtaaagtccctcagagattgaaacagcacaccatttatagtctttgagatctctttttatgcaaaacataattctattaaactaaagcagaaataaaaatttcttagcaacaaacacagaagttttcagttcattggtggaacagaattggtgatttataggcacttatgattgagttacttatagaattctttataaaaaa

SEQ ID NO: 148218 - DNA, 561 bp, Homo sapiens
tccctatgaattgatatacgtatcccaaactccataaatacttccctccatcgacttccctctgaagtcaatgtcttacaatgattcaaaattctccagggctgcttctgaaatgaagctatgatgcaagcaccatagcaggagtccctgttagatttccttactgaattaaaaagtttgttttagtttcccctaggagagaaaactaaacttggcctcagttggactcaggttaaagccactcactagctctgtttaagtcactttacactctattttttcatctttcagggctgtcctgacttggtttaggagatggtttatgtaaatgtgactcacacaaaaaagggctaaatgaaaaaaatcacttaaaaaataaataccttgacaaacgtaattaataatcacagagaagtgtatagtttgagagtagggagacgctggagcgcggtgtatgatggagaagagtcttaacctgtatagggtcttatcctggaattgagggcgctggactggagctaaaggacgacatggaattgggcgggcggtacatgggaccca

SEQ ID NO: 148219 - DNA, 138 bp, Homo sapiens
acatggcaccaactggcccattctttctaccctgcctgcaggggaggaaactgaggcagcctggccagggcagggaacgtagcctgtgttgtggctctaacccaggtgtgggctcgggcagattccttagtctctctg

SEQ ID NO: 148220 - DNA, 652 bp, Homo sapiens
ttttcctttttcccacggcacttatcttctaatatattaaatagtttacgcatccattatactcattgtttattgtctatccacatctttctctaccaaaggaccacaactaatacagaaataagctctatgtgggcagggatctttgtttttcatcaacattatttcaagtacatagaacagtacctggcaaacagtaggggccaaaaaaaaattctgcgatatgaatacataaatccaacccaagagtgtgctattttcagtaaaaatctgtcctccctggatagtggaagagaaggtcacaaaatggataattagtcctaggaaccaaagcaagtaaatataagccaacactctcactttgctcaacaagcatcactgatttgctaacagctctggataaagacagagcaatcagttaagccaacaactcattagattcaaagagatgtgtccccaaaagcatatctactagccatctgatcactaattgacagtatttttaagcatcgtgttgtttcctattcagtctcaaccttgaaaatactacacacagaagggaacacacctctccacctctccttctttagcaccactggctatttcttgcagagggaaacagctacaagctgggggaaaagactggtgcatg

SEQ ID NO: 148221 - DNA, 408 bp, Homo sapiens
tctgactctcaaccaggacacacaactgccactaagtcatggctgggccctcccaaacacaggccttgccacccctcgaggcaacgtgacttttgttttagagctgattgtgctgctttggcttctcactggtctgttctcgtccttggtggccaaacagatgtctctgccatgtgacaggttcatcaacaagcaaacacatttcagtactcttgacaattatcgaatgcataccatgagctaggtattgttttaggagcctcacaggtatgtatgtatgtatgtatgtatgtatttatttatttatttattttgagacagagtctctgtcgcccaggctgaagtgcagtggtgcgaccttggctcactgtaacctccgcctcctgggttcaagtgattctcctgcct

SEQ ID NO: 148222 - DNA, 402 bp, Homo sapiens
gtgtgtcccaatttgtctttctaacaacctgacccaaatctctctctactagtgaccctatgtctgattggttctcagagctatttgcctgaatcccccagggtttcaaatcaattctacaaagaagactgaagctcggactttcactcctgacattaagactcattatcttctagtctgctgctcactgaagtgctgtgctaaaactgtggatgagagtactaacatcattgtcatgcaagtcttgaaaccccacccaggcacctgtgaatacatgcagacagctgcagagtagtttcactcctcttacctttaagaataatgtgtgatgaaacccaagaggggagattaaaactgcctttgcaaagattatgacagtgagaaaaatttgacatgggaaaa

SEQ ID NO: 148223 - DNA, 271 bp, Homo sapiens
ccaaagtgaaagggatttctaggttgacgatagccataggagcacatgcttaagttagcgctgcagttgcttaaggtaacacatgtccttgccgctgaagcacacctggatctccctctggcaaggctggaggccttcagccttccccagcccagcttagggagcagctctgagccccatactcctccttctccagggatcttctgccaagttcaggctttgcacagtcggtccctatcgggtcctcagtgcagagtcttttgcaacataa

SEQ ID NO: 148224 - DNA, 248 bp, Homo sapiens
atctggccagacaaacccaggtgtgctgatcactgggcagaaggagagggatggggtcacagggatgtctaagtttggctctcagaaacctccgcagttgctggaaaaacaactatatatcaataacaaccactcagggcctaataatgtcaggtactatgttgtgtttatacagtagctgtatatttgtttatacattatttatacctctacaataactcttccatataggtgtcaccccaattttt

SEQ ID NO: 148225 - DNA, 161 bp, Homo sapiens
aaaaacctggttctttgaaaagataaataaaattgatagaccattggcaagagtagccaagaaaagaagagagaaaatccaaataacgtcactaagaaacgaaatgggagatattacaactgacactactgaaatacaaaagattattcaaggctattagg

SEQ ID NO: 148226 - DNA, 206 bp, Homo sapiens
aatgcaaactttcaaatcaaacagcacaagtacagttcatatgtgccgaaccttagggcagtcagaaaggatccagttctctatcaggaaatttcagatcataccagagcagtgcatttcaaattatctatggtgaaggatacattgttaattaccagtccatcatagactgatactttagtaaatacaataaattactagaaaaa

SEQ ID NO: 148227 - DNA, 135 bp, Homo sapiens
ggaagtgaaaattggagatcaaataacaaaaaaagagagaagggaaggaggaggaagaagaggaaaaggaggaggagggggagaagagaaagggggaagtggaagaggaggaggaaaggaagggggagaaggagg

SEQ ID NO: 148228 - DNA, 440 bp, Homo sapiens
aagttatcacactccagcaactttcagtgtttttgttaagattcaaaactaggggatctggcttgggtcatatgttcactttttggctaaagaatggcagggaatcttgactcataatcccattaggctgcattcagtggggtagaggtaattttcctcaaagatttggggtgctattatcaaaatagtaaggaaatatatgctgtacagacaaaaagtaatgaatatccacaaaggttatgtgatcataatctttgaatattggaaagaggaagatgagccttggtaaggatgtaaggcaatagttggaatatccatggaggcatatgtgtttcaacatcaggaagaacattctaacaattagagctcttaacaggctgtattgtgagttatggacttcttattcatagtaggatattcttttcattgcatgtggtgga

SEQ ID NO: 148229 - DNA, 560 bp, Homo sapiens
acccctccgcgaacgtgttatcctcagcaccttattctttactttagattctctgccacttactgagtaaccttgagcaagtcatttggcttttctatgcctcagtttccgtacatgtaaagttacgaaggcacctacctcacagagctattgtgaggattaaattatgactaacacaagtaaagcacctagaacagttcctggcagatagcatacactcaaaaaatgccattcagagtttcattattactagcactacttaggacatcatacaccattactactgatttcacacatacatcttctaccccacctcaagaaaagttgcctgaagacaagtattggcatccagagggagtaaggtgcatattagtacccttccttgccctcctccctcttcctaccccttctgcactctccacccgtatcccaaatacacacactgaggagtactgctatgatgggttaggtttacagacattttcttggccagtgcactgagctgaaggttcaaggacatgtaggcatggtcgttatgcgattacacgttcgcgaggacg

SEQ ID NO: 148230 - DNA, 277 bp, Homo sapiens
gagcctcctcacccaaggtcacgccatttccaggacagcaccctggtgactgagcgaggtaagggtacaaggcccttatagggccttctctttgacttcttcccacctccctttatggatgtcagttcctgatgaacatcttacacctcaaaccgtgacccaacatctgcttctgcagagcccccctgtggcatcttgtgccctcctgccccactccctctactctatatcttcccatagttagaatgggctttttttttttttttttgagataagg

SEQ ID NO: 148231 - DNA, 393 bp, Homo sapiens
ccgtgctgtttagttgtgacatgggagtaccatgtgcatttacactgagacctccatactgcagaggccacaggtaggactgaagagcaaaaaataaaaattaaaaattaaagagtttcaaatgagcccagtaccagccctatgaataaggaaggtatcttgaccctccacaccagttcagtcatcagatagactattgagtggctttagtgaatgccacaaagagcagaagaattccatggctgagacttgcctaaatttctgattttaaaactgaaatataatgaagtagttgttttaagccactaactttcaggccagtttgttacatagcaatagataactgaaacagctgggaaaataaaagagacctgcctgcttccacctttcaaa

SEQ ID NO: 148232 - DNA, 632 bp, Homo sapiens
  misc_feature (22)..(22): n is a, c, g, or t
agaagcaagcaaaacaaaaacnaaacaggagctgggtgtgatggctcacgcctgtaatcccagcactttgggaggccgaaggggggtggatcacctgaggtcaggagttcaagaccagcctggctaacatggtgaaacccgtctctattaaaatacaaaaattagccaggtgcagtggcaggcacctgtagtcccagctactcgggaggctgaggcaggagaatcgcttgaaccctggaggtagaggttgcagtgagctgataacgcaccactgcactccagcttgggtgacagagtgagactccatttcaaaagaaaaagaaatattttgattggtatctgttctccttcaacgtatttatagacaaactaaatttgtaggtatgtgaagatgaagggaagatttgttctcggtgtatggtattcattcagctaatgtttgaatacctgatacatgtcaggcactgtgttgttaccttcaaatgctcacagtctagcaaagaaaaagtagtgtgggaaaatgggatggtctagatcatgctgatggagccctacagaactacagcatttgagtcatagctaatagattaacttggcagatacagttggggtgctttatacatgatgatgta

SEQ ID NO: 148233 - DNA, 623 bp, Homo sapiens
ctgatcagcaattccacttctggctatacacccaaaagaactggaggcacgggctcagacattgtacacccatgttcacagcagtacaattcacaacagccaagaggtggaagcaacctgtgtccattaacacacgaatgaataaacaaaaattagccaggtgcagtggcaggcacctgtagtcccagctactcgggaggctgaggcaggagaatcgcttgaaccctggaggtagaggttgcagtgagctgataacgcaccactgcactccagcttgggtgacagagtgagactccatttcaaaagaaaaagaaatattttgattggtatctgttctccttcaacgtatttatagacaaactaaatttgtaggtatgtgaagatgaagggaagatttgttctcggtgtatggtattcattcagctaatgtttgaatacctgatacatgtcaggcactgtgttgttaccttcaaatgctcacagtctagcaaagaaaaagtagtgtgggaaaatgggatggtctagatcatgctgatggagccctacagaactacagcatttgagtcatagctaatagattaacttggcagatacagttggggtgctttatacatgatgatgta

SEQ ID NO: 148234 - DNA, 812 bp, Homo sapiens
tggagtttaacgtttacttctgagccccgcccagaaagcttgctctgtgcttatagcttcaaaaaagtctgcgaacgagatgaactggtttgaatacagacaagcctgtcattggaagttttgagttggatttttctttcccctctgacatctgtaagggtgaacgacgatgagaaccaccacttaactgtgttaggggattatgacgcgcagcagccatggccaggaaagcattccataccctgagacttcctttccttgcacttctctcctattaatatctaaagtaatccctcacgttagcacataatgaaagcagtctctcacccggctattgcatcttcaggtgagttagataggacagagcgtagtcccccctttacacctcagacaaaaacttaagaaacgttactcgcccaacacaaaacaactgactgaccaagcacctgtcttcccctcctcccatccaggtctcctgactaatcccttcatctttccatacctggccctgacctctagcaggacctaattccattcataactgttgagagtacaccatgagctactgattcataaaaactccaaaaagtggttcttctgaggatggactttagtgggattcttttgaccaggaattaaggaaataatgtaaaaacacatgttattggatttattaagcaccttccttgtgcttaataagtgtttgaattcagacatttcaggggtaagactacttaacctctgtgttcctctcaactatctaatgtacacatacaaaaatatgaacatggctgggcgcggtggcttacacc

SEQ ID NO: 148235 - DNA, 454 bp, Homo sapiens
ctggtcaccggcctctgctctccctgcctctcagacccttggcagcccctgggcctggcccacccctttccactgcagagctcccagaaccttccaaaattacactcccagaaagcctggttaagggagagagctgaagttctccctcatgaatgactaacagctacgcttcccttctgtcttatttcacgccacttacctttctacccaggcaaactataagcaacgcacgcatgaaacacagattctctgagcatctccagatccgagctgttctttgcatgcttcctgccacacactgtgcagtaaacaatgacgggcctacaacagcgctttcttacatctcactatgacgttttcacatcgcttacagaatacaaccgtcattagcgcatttccagtttgctctaatttatgccaaacatctttgttttaagcagcacttccccataca

SEQ ID NO: 148236 - DNA, 299 bp, Homo sapiens
tggcaaaatacccatttaagtattttataaaacctgatatccaattgtatgccttgaggcatgcctagagatctgtgctcccaaatcctggatctaccaaagttgcttgtttgcccagaaagtggtatgaccacactcctccctgtcccagacctcaccaggtgtcctagagtttaaactgcctctttgcaggttatctgggaggttaagtgtcttaggctgtagagtcatctgtgtttcgccagggcctgtgaccactccagaagtcctggttgggaggtttctaaggagagcaggag

SEQ ID NO: 148237 - DNA, 405 bp, Homo sapiens
cctgttggccaggctggtctcgaactcctgacctcaggtgatctgcccgccttggccttccaaagtgctgggattacaggcgtgagccaccatgcctggtggtacttccactttttattccacacatttcagcgccctttcattttgggaaactgttgtagtgtgtgtaactcaatatattttaaaagttaattttttttaaatgccaagatggtaagaaaatacatgttagtgttttgtgtaccttgaaacaaatatattcttaacaccccttttgagaaggtgtcctttttctcataatcctttggaggtgggtgggcattttctttcaccccgaacaggtttccaactattaatatgttggtgttttagcatttttgcctcaacaatcacttttttccaatt

SEQ ID NO: 148238 - DNA, 418 bp, Homo sapiens
tgagacggggtctcgctctgtcgcctaggctgcagtgagccatgatcatgccactgcaccccagcctgggcaacagagtgagaccctatctcaaaaaaaaaaaagaaaaagtttagactcttcccccaagttggtcttggcagtccttagacaggtaaactcccttcaatgctaaatggtgtcatagggtaatgataatttaacaattaaactttttcttcctttattagctttaaaagtgtcccaaatcctgcatcaccagaaaatcaccattaaatttttagaatttaaaataaattctagagttgacaagaaaagttaacaaggaaatttcaagaatgtctcttatctattatttggcccttaataaaagatctgttctgacctaagtaagttttgatgacctgcgatggtgacc

SEQ ID NO: 148239 - DNA, 596 bp, Homo sapiens
atgttatcccaactcaaagagtgatttcctatggccgcattccttatgacattttaaacatcataatcaattttataattttgtttgccttttccacgtctatacttatacatatgtatatgtttatatataattataaaacattatgtaatgtcaaccctccgctctagtcaaactgggttaattcattatcttccaaaaatatcttgagcctctttacagctttacacagaaaaaagaaagctcacagagttcgacacttttttaaatatgtgaatatgtcctagaattgcttctgctcctcaatacatacctaccctacccaaacatacgctcttactaaattcttacccatccttaatgtttttgcccaaattccattttttcttgagacagggtctcactcagtcacgtaggctagagtgcagtggcataatcacaggtcactacagccttaagctctcagcctcccgagaagcttggactaaagtcatgcaccaccacactcacctaattttcgtatcttttgtaaagaccggttttgccatgttatccagactagtcctggacttgtctggatacacgttcgcgaggcc

SEQ ID NO: 148240 - DNA, 227 bp, Homo sapiens
accgaatgaagagaagaaggaaggaaaagaaagaaaaagaaagagaaaaagaaagaaagaaagagagagaaaaagaaagaaagaaagaaagagaaagaaagaaagaaagaaatctaattataaaaagagacacatggttcctactaccctcatggaattttgaatttagtgaatgaatgagtgatatttagtaaatcatatctgccttcccttctttctctttcttt

SEQ ID NO: 148241 - DNA, 121 bp, Homo sapiens
tttcattaggtaactataatacatgacattgtcatgtgcacagaaattattcagctcacaattccaaagttttatagagagcttgttgaatttggagacggatgatgtggcatcaagaaaa

SEQ ID NO: 148242 - DNA, 308 bp, Homo sapiens
agtataatgattctctcagactctcagttctcctacttcttggcttctccttagtatcttttgatggttcctcctcttttttaaacatcggagtgcctctgggctcggatctcgtctcaatttgtgtttagttcctaaatcaccttatcctgttgtatagctttaaatactattcagatgtggagactcccaagttcatattgccaccccagcctctcccctgaacttcagactcatttatccatctgcctacctgatacattcacttggtgccaaataggcattccaagtttaatatatccagaact

SEQ ID NO: 148243 - DNA, 205 bp, Homo sapiens
ggaaggtggggtgggtggtgacagatccaccacagatgtggggaaggacagtggcgacaactccctgctgcggtggagacggcacctgagtcgtctttgagtcccagaggcttcctctccaaaatggaagacttgaggccctgcactgggctggcaatcgcagggaagggcaggggatggagggccaccttcttttttttttttt

SEQ ID NO: 148244 - DNA, 301 bp, Homo sapiens
acagtcagttccgtggcccccaggcacagctccagtcacacccagtccctccccatcacctaggccagtggttcgcagcatacactgcagaccatgggggtccccaaaactcctttaggaatctgcacagttaaaatgatttttgtaatcgtactaagatgctgtctgttgctggaaagcaacaatgagtaagactgttggtgccttggtcaaggtggtgatgctgaactgtgccagtagccactatattctccactgctatgtactcccaggtttttgtttttgtttttattttgagata

SEQ ID NO: 148245 - DNA, 339 bp, Homo sapiens
ctgggtcacgccttagagaatctgcatttttaaccagcatctcatatgtgcaggtggtcagcagactacacatcaggatacatgaaccatggaggtgattgctaatattgctagtgccttctctccctttcttccttccttcctcacattgttcccattaatagggcgactaagacagaagcagccaggcacagtggctcacacctgtaatcccagcacttagaaagcctgaggcggatggatcacctgaggtcgggagttcgagaccaggctgaccaacatggtgaaaccccgtctctactaaaaacagaaaaatcagccatgcctagtggcgggcgc

SEQ ID NO: 148246 - DNA, 492 bp, Homo sapiens
cctcttggttgggatggttacttcttgtgtgaactactgtaattaccctttggcttatctacctcaccctgtccctttcatcccatgtaatgcttcaagagtgatttttctaaaccatggtgcactcacttctttgctctgaaacctccagtgatttctccttgtctgctgagtaaagttcaggctactttacactagcatttgagaatcttatgaattaattcctgcctacacttaatcattctttattcctttgttctttaggaaaaatcgtaattggtaagataaaccaaatataaaactatatagtaatgctgtttttcagtcttactgatctcactctattccttatctttaccatgcttttctgactttgtgcttttgcctctggatttcccagtctggaatgcctctctcacatcctagtatgttgaaatctgtccattattcaagtgtgagcttagatgccaacactttgatgaaggcttatct

SEQ ID NO: 148247 - DNA, 472 bp, Homo sapiens
actgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaat

SEQ ID NO: 148248 - DNA, 261 bp, Homo sapiens
cctaagcgtggtggtacacctgtagtctcagctacttaggaggctgaggtgggagggaccctgctttggctgtgactgctttatcacagggagtgcctatctgtgggctgctttctacacattaaagcattttcagaaagggccaacatcagccttggaaaaaaggaggaagagccacggagagtctccctttatcttccccttatgtgatgtgagagtgcacatgactgtgtgcacatacacacacacacaccacacaca

SEQ ID NO: 148249 - DNA, 425 bp, Homo sapiens
tggtaggaggcgactggatcatgggggtgatttctaatgatttagcaccatccccaagtgctgtttcctgataagcgttctcacaagatctggttgttttaaagtatgtagcacttcccccttctctctctctcctgctggccatgtgaagactgtgcttgtttccccttcaccttccaccatgactgtaagtttccttaggcctccacaagagaagcctgtacaggcagcagaactgtgagctgattaaacctcttatctttataaatacctggtctcaggtatgtctttgtagcagtgtaagaatgaactgatacatccccaaatctcagctactcactcacttcaactgtatttatttattataaccaataaccacaacctctccataaatgcagtttcaagaatcccactctcttaaccat

SEQ ID NO: 148250 - DNA, 264 bp, Homo sapiens
ctctatgataaacataatttaataaaaacacataattttacccagattcgagaccttttatgaaaacaagcaagaaaatcctctcttaaaatgtgtaaagtaactttaagtaagcatttattttattattacacaacagtaatacaatacattattaaagagctggcctctactatttggatagaaattaggcttccagtgatttcggtaaacatcatttttatttatttatttttgtcaaaatagaaaaggctatttttctta

SEQ ID NO: 148251 - DNA, 273 bp, Homo sapiens
ggaacaatcttgtcattgtagccaactcccaccacggtttctcaggcaaccaccaacccaagttttatggaatgttctggtcccacggtatgtttggcaagaggaggggctcactctggtgggagagctagaagggtgctgctggctgggagaagggacccaaagcatctccagccagacccaaagccctgccccatcccaggccacacctgcctcctttaccaggggagtccctgggaggtggctgtgagagaggcacacctcagccctgca

SEQ ID NO: 148252 - DNA, 720 bp, Homo sapiens
cagttacttagacatttgttcaattcttaagctgcagttagaagaaaaggaagtggtgtgaacttttcaccttttatctgaattctctgaagaggagttctgcaggatttcaacatccttaaaacaaaacactagcagttactgattggaacatactttcctttgggatctacatggcctttgcaagaatagcataaatagcacatagcctagcccctatctctaaaaaaaaaaatccttactccatggttatttgggagtgatgggtttctggagggctgttttaaactcaaaggacaggcataaaccctttgaatcttcacttctcacaggaatctgatttccatcaagtaggaaagaaatcatgaagcccagtcagctcttaggtagtgttttaagtaaggtgaaggaaaaacaaacattagggaagttcaaagacaaaaaatcctacaagaggacaaccatgattgaaactgtactctgatttctgttatgggtatgtgcacccccacaagctcatgaattctcttatggaagagagggctgagcttccaaggtgatgcagggcctatgacacacccccatgtagacaggtgaactgatttctccaaggtcatagaaaaaactgagaccttttattacccaaacagaagatttctgaaagtacatttcctaccctgtgttttgttatcagactcaactatgtcatgacctcctggc

SEQ ID NO: 148253 - DNA, 526 bp, Homo sapiens
catggacgctttatacttcttctgaatctcaaagttagttataatgcttgtgcatcataaatacataacattttactggatagatgaatgatagataactatgtacttcggctatttaattcatgtagaaaatttaaatattataaaagcagtaatgattctcagatgtttttaaaataaattgtcttccttttttttttttcttttaaagagacaggggtctcaccatgttgtccacctggtcttgaacttctggcctcaagtgattttaatattcatcttttcttccctcttccagtcctgtttccaaaaaggaaggagggaagtataaagcgtggagctcaacgctttatacttcactattacttggtatgggtgaagagtgaagcaaaagtttgtggaaactagtttagtgatgggaagaagaggtattcccgtgactttcatttcctctaggaagaggtggggattatttacaattagggtaaagtcgaagacttagggaacgggaggacagttggtaata

SEQ ID NO: 148254 - DNA, 363 bp, Homo sapiens
aggttgggaggctgacattgcggggaggaaggagctagaatgctgggggctgtctacctggtgccatgtgctgccatctgcccagtatgggggcaacatcagcctgacctgccagcacctgcctggctaccagtatcagctttcaggaataaaaagatctttttcaaaaagcctttgttccccagggaagctcaaggggcagagtgaggtccgtggagggttgtgacagttcaaaacatgctgtccatttatagtatgcagcagtgaccctatatctcaccctctctatagcaactagctccagacacaaactgggcatggcttttgatcatgaagcatgtttttacaaacaaaaaaatactg

SEQ ID NO: 148255 - DNA, 415 bp, Homo sapiens
ctcagcccgtatggatcagctccgagaactccattctgccagtgagagacccggggcccagcagaaggccagactctgagagcgtcaggaggggcaggctggagctccgaaagggataggaactgcctgggcagctggcgacgccgtctggacagctgttaaggaggcccctcagaggaaaggatcacagtttcacaggaatttcccctcatattgccaatatttcttagcgaggtccctggccagagactgttataagcaaatctccatgtcatcgtctgtgaaatggggagaataatcttgcctaaagtccttaaccctgtgcctgggttgcaggagacactcaatatttttgtatttttgttttttcaagccctgaggtgctagcactactgctaactttaaaaagaaagaa

SEQ ID NO: 148256 - DNA, 276 bp, Homo sapiens
cgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcg

SEQ ID NO: 148257 - DNA, 477 bp, Homo sapiens
agtgctatcacaaacagtgtatagccagtggaatgtgtggtatgtggtgtgtgctgtgtgtgtgatgtttgtggtatgtatgatgtatggaagaagtgtggcatgtagtgtgttatgtggtgtatgtggtactgtggggtgtgtagtatgtgttgtgtgtggtgtgtatgatgtggtatgtaggatgtgtggcatgcggtgtggtatgtgatgtggtatgtggtatgtgctgtgtgtggtatgtaggatgtgtgttgtgtgtggtacatgtggtatgtagtgtgtggtatgttatctggtgtgtgtgtgtgtggtgtgatgtgtaatgcgtgtggggtttggagtgtgtgtggtatatagtgcagtgtgtgtggtgtgtttgtgtgtgtgctgtatgtgtggtgtctggtgtggtgtggtgtgtggtgtgtacagtgtggtgtatggtgtacagtgtctgtgggtgtaggtgtgcgt

SEQ ID NO: 148258 - DNA, 336 bp, Homo sapiens
ggagagggtatttgaaatagcagaaaccagaagtttggattccctgtgggtctgcattatttggtcacttcaatcccccagtaatttagagaattgaaagcaggatggcagtggggggaaattgttcaagagaatccccaaacagaaataatgggagctgatattttgatcaaatatttactgtcgggtgtgtgtgttgggtatgcagtgtttgcatagactgtctcctaattacatacttgattagcttgaagaaactttggctttttcttttacctatgggagaatttttaaggccttatctcaactcttttcagcccttagagtgtgctctct

SEQ ID NO: 148259 - DNA, 294 bp, Homo sapiens
ggcactgggggacacagtctggcctagtcaccttcctcctcctctcttgtattcctttattttaaacgttctggttttcaagtacgtttagatgcaggaagatgataaaagtagtacagagttcccataaaccttcaggcagctctccctaggttaaaaaatgtcacataacatcttaagatgaccaaagccactgacaatgtgctagtcactcaactacaaacatgatgtgaatttcaccagccttcccactcttgtcctttctctggcccaggagcccatcctgggtccctg

SEQ ID NO: 148260 - DNA, 445 bp, Homo sapiens
gcaaacctgcatgtttattcaattgatggggctacagaaaggaaaggcaagagagtgaaggaggtaaaacaccaggctgcaatgggtccttcgcccactaattcctttggtgctgctcctggtccaggtcagcaacagccccctccagagcagcagccagaacccccagactgctggccactgccactgccatagcaattggagctcttgggtctgtggcagtgggacctatggtgtctgtggtggctcaggcagcagccacctccctcagagctgcagcaaccacagcccccagagctggagccacagcaggaagagattggaggtgggcatgaggatgcacactttgagggacattttgggggatacttggggataggacacttgggagggggctggcactgctgttggttctgctggcaggacatcttggtggaatttcgat

SEQ ID NO: 148261 - DNA, 478 bp, Homo sapiens
ctccgcattggactctgtgatgctggctccaggggcccccatagctttgtgtctgccatagtgtctcagtgcagatgtggggtcagaccaccctgggacagtgcccatgaactgcctagcaacagacgtcacagaagtgctctgacagctttgaacaacggccgcagtgccagcctttcacccagaactgacaaagggagccctctggggccaggagtgccatggcttctgtggctgccgttaactttgggatgaggccaggtgggcagtttgcagcttagctgggggagagtagggccctttatccataacctgaaatgcttactgcctcctcctgccagagccatgggccttcactgtgttctgttatctgttcgcggttgccagaaaaccatctcatattgacaggcgagctcccttagtaaggtgtgagatctggaagcttctcagatctattctctatggcactttccaccaa

SEQ ID NO: 148262 - DNA, 320 bp, Homo sapiens
cttaaattgcaagtcaggtatttgctagctttgtggtcttggagaaaaaaataattacttaacctattggatccctgattgtcttatctataaaacaggaaatctataaaatgagaatgttggccgtgcacatggctcactcttgtaatcccagcacttcgggaggctgaggtgggggatcacctgaggtcaggagttcaagaccagcctgtccaacatggcgaaagcccaactctactacaaatacaataattagccgggtgtgctggtgggcacctgtaatcccagctactcaggagactgaggcagaagaatccctt

SEQ ID NO: 148263 - DNA, 618 bp, Homo sapiens
ggcaagcatatagagcaattacagtgcattttagggggctcccactgcaggcccaggaccacatccaactgcatcatgtatgcacaagagaccagagcatggcagacacgttggcaggagactgaatacagggaactcagcaacccaagtagtggaccctgtgaggccagtagtccaccagaggcaggaagtgagccaggcccttttctacagagggcagcaggaagaatcatgtggctggcagggggaggaggcaccaagaggagcacagggaagaaagggatggccaccaggagcggaataccatgagcaccctggactccagtccggaggccaagcctgaccagactgcagaaggcagacctgtgagcggcactaggctcagcagccacagaaagagtggggggccagaaagcagttgcagaaacacaagcataaaatacaaggcactcgccagcagggaggaagtcacaggaaatacagaaaaggagcaaatgaccacttcttgaaggacatgatgaagaaagaacaggacatttgtcatgagaaaaaaaaggggaagctgggacgggggcctgcaagaggtttgtggacctcattcggtttaagaccaatccg

SEQ ID NO: 148264 - DNA, 331 bp, Homo sapiens
ggcaagcatatagagcaattacagtgcattttagggggctcccactgcaggcccaggaccacatccaactgcatcatgtatgcacaagagaccagagcatggcagacacgttggcaggagactgaatacagggaactcagcaacccaagtagtggaccctgtgaggccagtagtccaccagaggcaggaagtgagccatgttcatgccactgccattaaaggagctgttttctctgcatctaggccatcatactgccattaaaggagctgttaccatctgagccatgttcatgccacgtgccattaaaggagctatcatgccagctgccat

SEQ ID NO: 148265 - DNA, 411 bp, Homo sapiens
tgctaacattcagtgggagaggctaacattgcaggggagaaactgacatttcagggcagggctgacactctccatccttcagattctacagcctctgcctccttgctataccctgtccctacaagtattggctgagctcatagtaggtgcaaatctctgccaccctggggatttgaacatgcctgaatagaatggagtctgccctcatagagctcgcagcctgggggcagacagttctgaacggaatgattacacagaaagacattcacctcccaggcaggagaggtaatcacgcgctcttaatcactacctccgtttctctcaggcaatacgggaggggaggcggcacccccatcgtggcctggtttgagatgttcccagccgtaggagacagactgtcatcaagtgtcg

SEQ ID NO: 148266 - DNA, 815 bp, Homo sapiens
  misc_feature (28)..(28): n is a, c, g, or t
  misc_feature (47)..(47): n is a, c, g, or t
tttttatatttcttagatatccacaaanaaaaacaaaaaaaaactcntgtactgacagtttctatcattatatctttaagcccactgattctttccttggccatgtctgatttacaggtgatagggaatgaagatcttcaccggaattggcctcttgatcttggactttccagcctccagaactgcaagccaaataaacatattgtgtataaatcatccaatctgtggtattctgttataacagcaaaaagtgaactgagacagtttattctttaggagtggcctgtaagtggtttcataagaggagaaagatacctgaattcactgtataagtcctctcaccatgtgatgcactgtaccacctcaggactctgcagaaagttcccacaacccagaagaatcttaccagatgtggtctctcaacttcagagttctcaccctatataactgtttacagaaggagactctgaactttaaacttttgacttggtactggaacgcgttaagactttagggcaatgagattagatgaatatgaaaagcacatgagtcttgagggactatgggcagaatgctatgctttaaatatttgtcccttccaaaatgcatgttgaaatttaatcctcaatatggcagtattgagaggcgaggtattaaacagataactgtgaagaaatagaaaaaagtggggctcatggcctaaaggtggatctttgcgggcggttccttttagagaggattattaaaaatcatcgcttattgatttcttcagtttgatatttggttaggggaatcggaataattaattaatagta

SEQ ID NO: 148267 - DNA, 706 bp, Homo sapiens
  misc_feature (28)..(28): n is a, c, g, or t
  misc_feature (47)..(47): n is a, c, g, or t
  misc_feature (667)..(667): n is a, c, g, or t
tttttatatttcttagatatccacaaanaaaaacaaaaaaaaactcntgtactgacagtttctatcattatatctttaagcccactgattctttccttggccatgtctgatttacaggtgatagggaatgaagatcttcaccggaattggcctcttgatcttggactttccagcctccagaactgcaagccaaataaacatattgtgtataaatcatccaatctgtggtattctgttataacagcaaaaagtgaactgagacagtttattctttaggagtggcctgtaagtggtttcataagaggagaaagatacctgaattcactgtataagtcctctcaccatgtgatgcactgtaccacctcaggactctgcagaaagttcccacaacccagaagaatcttaccagatgtggtctctcaacttcagagttctcaccctatataactgtttacagaaggagactctgaactttaaacttttgacttggtactggaacgcgttaagactttagggcaatgagattagatgaatatgaaaagcacatgagtcttgagggactatgggcagaatgctatgctttaaatatttgtcccttccaaaatgcatgttgaaatttaatcctcaatatggcagtattgagaggcgaggtattaaacagataacngtggcctcgttggcctcagcggtggagcttctcggtcag

SEQ ID NO: 148268 - DNA, 864 bp, Homo sapiens
  misc_feature (28)..(28): n is a, c, g, or t
  misc_feature (47)..(47): n is a, c, g, or t
  misc_feature (825)..(825): n is a, c, g, or t
tttttatatttcttagatatccacaaanaaaaacaaaaaaaaactcntgtactgacagtttctatcattatatctttaagcccactgattctttccttggccatgtctgatttacagctgtataatttgacatgccttcagctggggaagaggagccaccttattataactaggtgacgatagcaactcagactctccaatgggtttccattgagaccgaaggggatgatgccttgttaccttagacagtgatgggagttcctgttccccaccaggtgatagggaatgaagatcttcaccggaattggcctcttgatcttggactttccagcctccagaactgcaagccaaataaacatattgtgtataaatcatccaatctgtggtattctgttataacagcaaaaagtgaactgagacagtttattctttaggagtggcctgtaagtggtttcataagaggagaaagatacctgaattcactgtataagtcctctcaccatgtgatgcactgtaccacctcaggactctgcagaaagttcccacaacccagaagaatcttaccagatgtggtctctcaacttcagagttctcaccctatataactgtttacagaaggagactctgaactttaaacttttgacttggtactggaacgcgttaagactttagggcaatgagattagatgaatatgaaaagcacatgagtcttgagggactatgggcagaatgctatgctttaaatatttgtcccttccaaaatgcatgttgaaatttaatcctcaatatggcagtattgagaggcgaggtattaaacagataacngtggcctcgttggcctcagcggtggagcttctcggtcag

SEQ ID NO: 148269 - DNA, 655 bp, Homo sapiens
  misc_feature (616)..(616): n is a, c, g, or t
ctgtcggaactgtctataagctacttgtaacacctgattctttccttggccatgtctgatttacaggtgatagggaatgaagatcttcaccggaattggcctcttgatcttggactttccagcctccagaactgcaagccaaataaacatattgtgtataaatcatccaatctgtggtattctgttataacagcaaaaagtgaactgagacagtttattctttaggagtggcctgtaagtggtttcataagaggagaaagatacctgaattcactgtataagtcctctcaccatgtgatgcactgtaccacctcaggactctgcagaaagttcccacaacccagaagaatcttaccagatgtggtctctcaacttcagagttctcaccctatataactgtttacagaaggagactctgaactttaaacttttgacttggtactggaacgcgttaagactttagggcaatgagattagatgaatatgaaaagcacatgagtcttgagggactatgggcagaatgctatgctttaaatatttgtcccttccaaaatgcatgttgaaatttaatcctcaatatggcagtattgagaggcgaggtattaaacagataacngtggcctcgttggcctcagcggtggagcttctcggtcag

SEQ ID NO: 148270 - DNA, 209 bp, Homo sapiens
gggaggtgttggactggccacagcagagccaccaaggggcttccaagagctgagagtcgctgattgtggcagatctgagtctgcagtgaagccttctgtcaggcagaccagcctgaggcctgagaagggagagcaaagccaggtcacagcctggtcagggccattaactcatgtcagagaagtggaaggtggggcctgagcccaatcag

SEQ ID NO: 148271 - DNA, 139 bp, Homo sapiens
agaaaagcctcacctttgtagtatttgtgggcaaagttttcgtcatggaagttcgtatagacttcacttacgagtacatcatgatgataaaagatatgagtgcgatgaatgtggaaaaacatttatccgtcatgatcac

SEQ ID NO: 148272 - DNA, 392 bp, Homo sapiens
agccatactctgccttggaaatttcaacagcgtgcattctaggcagccaacatgaaagaatcagggagacaataattatttgacaactttctttactctcatcgaacactttcttctgagcatttattcaagtaatatgacagagacatgatttgataaggcctttctgacatggggactcttgaattgaaacatgaaaaagtgaaaacaattagttggaacaaggtgaagccatgggagggaggatgaatagtgcagcttaaaaggatgtttaaaagccctgtgtctacatacttattattattattattatttttaagatgccacatataagtaagatcaggcagggctttttttcctttgatctggcttatttcacttaacataatatc

SEQ ID NO: 148273 - DNA, 362 bp, Homo sapiens
gttaattatacataaacttgttaagtaccagaagtagtctaagaggatagtgcaaaaggtaaatttgttcagaaagataatcctgattgtgtcacaagcagaaaatgtctgattacctgccaaggtcacttcactcgaaactcatttgtgggttcagtgaagcaattccgcattttgacataccagcattttaatgtggatattggtatttgtcttatcagtttgcaagtagatttgtttttaaatgcaatttctttacacataaaggaagctatatttgagagctaacttctttaactcagttatccatgtaaatataacataaagagagttaataaaattcagaagtaatttaagaactc

SEQ ID NO: 148274 - DNA, 996 bp, Homo sapiens
agcgacatctgctggtacaatgtaataaagatgactatctcatgaaagtaatttcatagaaaatatctttgtgggtagaattgtttattttactatcatttacacttctaattgaaaatttgaacatttgaccaagagtattatcctgataatgataacattgagcttctttatactttcctgtacatagtatgcgattccaacctgaacctctacagttatttgtgtatttactaagttctttgatattattatgcaacatatttcttttcctccatgtcttttttggctcagttttatatcataatttgccttagtgcagaaccttgcaagtagagattcagtaaatatagactgacttacagtatttattttgtcatttgcatagattaagttgaaaagtctacatatatgagttaaatgcattatttttatgtgcacttgaaaataaaaatgagactttatattagaaaagaatgtgattaggataaatggatttttatttttcttcctttgaagagattttctgcattataagttgtggagaagcaaaatatattcagtccttggacattttctttacaattatttcctgtatgattgtatctagtctcatgcatttaaatactacatataaacaaatcagacctctcccttaatcctcagacttgtacagccagttacttgcttcctcaacattaccgtttaattagttaacacacattttaaacttaacatgtccaaaacaaaagttttgattttctccttgaaactgtttgtgcttagtattccctactttaatgagtggccgtattatccttccgtttgatcaaaccaaaaattatttcagtaatttgtaaattccctctcttttactccacgtttaaaccattgagaatttcagtcagctctacttctctccaccttctacaactatgatctagatgaccacaatcatcgttcccctcctaacttgcttccttgcttctaaccttg

SEQ ID NO: 148275 - DNA, 168 bp, Homo sapiens
gaagcagaaaagtgagtagactgaaagcagggagaccagttcggcgcctgcaacagggttctcacaatcctgctgatggtcctgacactcccaactagagctagatagcccctcccagttgtggctaaggagcacccagccctccctccttccatcccctcacctcca

SEQ ID NO: 148276 - DNA, 245 bp, Homo sapiens
gggccttgccactacccagggcccatgctcactgccacctgaacgttagggactctgctgctggcgactgctaggcactgaatggtaggatctgtctgggagtaggaagtcatcgtgcttctggccagctgcccaagttgatacttttgggctctcctgggtatagaggtaacaggagctgtgtgcccctggcatagagtgaagctgactgtggcggctgttccctcacgcgtctggtcagttgg

SEQ ID NO: 148277 - DNA, 151 bp, Homo sapiens
ttctaatgttagaggagtcttgcacgcttgcctgaaatcaattagtggccctacactgaagtgcgcctgtctgagcaaacaagtacatcagccacagtgccctgagttattgagttatgggggcagaactccagaggtcttctaggtgtct

SEQ ID NO: 148278 - DNA, 308 bp, Homo sapiens
cggagaaggaggctttggactggatgggacaagaggccgttgatggcgtgcggcccacgcaggagagtaaacagctctcaccaggggcaacatttctttgatgtctcctatttcattcaaaatttatgacttctatattctatcccataatatattcatgtttgttttaatacaaaaataacgttcttgtcccatgtttctggagtgaagtcaatgcctcaggaagttgctttcctggtttgagcagcacagaccataaaggggtcatccattcatttctttgttcattcattctccaagtatgcaat

SEQ ID NO: 148279 - DNA, 200 bp, Homo sapiens
tccagatatgaatgagagaacatgtagcctattttcgactactggacaacttacctacaagatgaagccaacaatgttgttagcacagaaagacaaaataaaacctggatccttgatcatattactaaactgctggatcaatgaattctgatacacgctgccaagcatgtgggccaataaatgtactcattgttgaagcc

SEQ ID NO: 148280 - DNA, 288 bp, Homo sapiens
tgattagttttctgtatgtgtagttttccagttttaagaatgttctacaaatggaatcatacattatgtagagtttcatatttggtgtctttagcacaatgaaatacatataagacctctagaactgcaatgtactctttcttgacctcagtactcaatacgtgttttcctcacttcacaatagttcattcacagtcgattggttttctaaacttgtatatatgtgtagtatgctttataaatatcatatgatagttaactttatgtaatttgttatatcttggtaat

SEQ ID NO: 148281 - DNA, 506 bp, Homo sapiens
gataaatgttggaaggcagagagaaggtaatgatgaatgcggtcttgggctaggactatagtgctgggttccagttctaaacctgctattggttacctgatggccccaccctccaatgtgggctcactgtagaaaatgagataactacaaatgtgtgaagtacttccagctatggggtcctttaaaacagagggctttgaattttctaacctttttaggtttttcaactatctaattcttactattgaaatccctagaaagaatttgttcctcacaaaagaaaatgataaaatcaatacccattactagccccgggagtcagccttggggaaaggaggagtttgtgtcccaaaatgcaaaggctgatggtaagaaaacagttcaagaaccacaacaccctgattttatctttaggtctctacggatcactcaagatgtctaaaagctctaattatgtaaagctgtaataataactgactgaaaacagaagaatacaaaatctgcat

SEQ ID NO: 148282 - DNA, 278 bp, Homo sapiens
ctgccatgcaccgcggcggagctgtccatttccttacggagggacaccaggttgcccgagtcctttgctaatcaatgacagccaccatgaatatcctagttcacgtatcccggtaggcacggccggctctggcctagtgaagacacacaggccccatgtactgactgcacagctgcatgtttatcatctgcactggaccctgtgtgtccccatctctgcctgtgtcagatgttgccaactgctgtgcttggtggctccgccacgctcctgccggcggc

SEQ ID NO: 148283 - DNA, 423 bp, Homo sapiens
gagaacctaagaaactcagagccagccaggcgcagtggctcatgcctgtaatcccagcactttgggaggccaaggtgggcagatcacttgaggtcaggagttccagaccagcctggccaacatggtgaaaccccatctctaccaaaaaatacgaaagttagctgggcgtggtggcacatgcctggagtcccagctactcaggaggctgaggcacgagaaccacttgaactcaggaggcagaggttgtatgagccgcgattgtgccattatacgctagatggggaagcatgtgtactctttcccagtggtgctctgggtgctttttcttgcagttgtattttttctttttgtgtatgttttgaggatgaagataatgaaaaagaggaaaaccctagaaaggtcactataactctttctggtgct

SEQ ID NO: 148284 - DNA, 294 bp, Homo sapiens
gtttaaattttttgttgaattaaagtctttgcatgtaacagggaaaaaatttttgcctctttagaaaacatctttcattttatgaaatattttattttgtaaatttatatttctttctgtagaagatactgagactgtaaagtctgatttgttattgaatttctctttaaattagtgaagctttccttcttcacaaaaggatttacactaaatggaggtaaaacttgaaccattcctttcttctgaagattatggcgtttcgaaatagaatctgtgttcctataactaaaatat

SEQ ID NO: 148285 - DNA, 274 bp, Homo sapiens
tactagagaaaaatagagacgtgacatgtagcctgcatagcttttttgaattcttttacaatcactctgtaccagtacgtgttgtcaacaaaatgcagcaaaataaagagttgcatgataattttaatgcatgaccaatgaagattgaagccagcctgttgggttaatcctgttttgtttcaatcctagtctttcccctcaggagctaggtttttggctggactgactggataattgttgcaggaatctctttccatcttcatgtatgaaagca

SEQ ID NO: 148286 - DNA, 317 bp, Homo sapiens
ccagatgcagaagaccttgtatgttaggaaatgtggatattatcctaaggacgacaaaaagggttttaagagaagtagaagaagtaatcctgaattaaaattattccagctgcagcatggacaatgaattagagtggtgcaagactagatgtaagaatatttgtcttggggactcctgttcatcatctagactgtggtaatgatggttctgaacagttttagtctcagcacttctaacaccaaatgtatggggttttgtctccaaatcaaacaatgctccaactttctggacatcgagtgggtggggttctctgcat

SEQ ID NO: 148287 - DNA, 397 bp, Homo sapiens
tcagcctctcaaagtgctgggattataggcgtgagccaccacgcccggcccagacattataattttaagttatcttgttgataatggcttcatttagccattcatttattgttgaatatttggattgtttcaagttgctattattttttaaaatgctacggtggaaacctccctgagtgtgctctgccatctttcaggggactctgaatgttgcacatcagctgcagaagagccattgtgcttgatttaggatagtgtggactgttatccagctctgtgggaggacagtcaagtaatgaattttatatagaagggagcattattctttgcaaaataagaccatgttatccagggagtggcagggaaaagttttttttccccactgcctagaattctc

SEQ ID NO: 148288 - DNA, 364 bp, Homo sapiens
ttttctcatatgtaaaatggggatataataatattggctttctagagttgtgaagactgagtgaatcaatgtatgtaaagtgcctgacatatggtaaggatgtctataagtgtttgctgctgttgttgttgttacatgttacatgaggtgggagatcctagagctcgtgtgttctgatggggagggtagagagggtgtgatgcaggagagaggatagttgctggagggaaggcttgagaagacggagaggagaccagcccaggtggacaggttagcctttggtaggagtaaagtgagtttacttgtcattctagggcatagtgttaaccagcataagccatttaagaagttaaattgtgtggtt

SEQ ID NO: 148289 - DNA, 766 bp, Homo sapiens
cttttccagtgagatgatctttcctgtggaaatctccagaagcgaggaaaaaggttaaattagagctggtcctgagcaagaagtattcttcaggaaaatcttacttggttatttacttagtgtgttagagaaccaaggcccggtttagcaatgagtcttgccccctgtcacagaacccgcatctcctgactccttggtaagtgtgctttgtatcacacacaggcatcatgattgtctcctgtttggtcatgagcctcttgaagagccttctcttccccaaggccaccactgggacagggtgataatagtgaagggaatactcaggttgccttattcgtggctggaggcccatctcttagagccctacaatagtgagcagaaactaggtgaaaaaactccgtaactgtgggagtgtgggggaatgcagaaaacagactgttccatgttaaaaactgttttaatgctcagccactgactgtcataagggtgatagtaataatagtgaaatcatgggatggtaataataaatcctttcagatactgccagaactacatatcgcaggctttagatgccagtgggcagctgcttggctaaatgtggaccccagttgtcaaggagagacccaccccaatacaggagaaacaaatcaacaagtatttgcagggcacacacagggcagagcctcttggaggtgaagacttcagtttagacaccatctctgcttttaaggaattagcaatttgaaaatgtgctcagaatgtcaag

SEQ ID NO: 148290 - DNA, 259 bp, Homo sapiens
gaaagttgaattggttgctctgtctccaggaactggagtacactcttcttctgcccttggacatcaggctctctggcctttggactccaggacttataccagcgcccctctgggttctcaggcctctgtacttgaactgagccacactgccagcatgccagcttctccagcttgccaggcctgctgtgggacttctcagcctccataatcatgtgtgccaattcccctaataaatctcctctcatctgtccacgtatct

SEQ ID NO: 148291 - DNA, 2121 bp, Homo sapiens
  misc_feature (197)..(197): n is a, c, g, or t
  misc_feature (501)..(501): n is a, c, g, or t
aaaaatccatcatggtaaagaaactgtttttctgagtgccttagacattgacttcatttccttgcaatcagtgttaagcattcagaatgatgtttcggttctttgaggcctgctggggaaagggagagggccctataagcctctggtgttccctccttctactaacacacacacacacacgcacgcacgcacgcacncacacacacacacacacacacacacacacactttggcctgaccattcttagccaaaaactcttgttctcctcacattctctctgcaacaaaaatccagtctttcaggaagaacaaactgacacgggagctagcagcaccctaagctctgtgctatcgcctcaatactttagcaaatcacttgtggggaaactgaggcccagatgatacaacttgccctgggtcacatagttggtttggggtagggctgatacatggacctgggatttccaattccagctagcaccctttccactaaggactcangcgccaaggtcaacagcaaatgccagcaattctttctccgagcctatcacactcttctcactggcagagtgtgccagcccttcattctcttcaatctctcactcatcttttggcaatagtgttttcctacagaaaagtggaaggcccagcagggaaactgtgtgcattctactgtcacccatctggagcagcttagcctctgaccctcaagaacgggacagagcagctgcccagagtcattcccagtggatggcacagcacagtgtgcactgctcccacagtggccagttttagtctcttcagcaccctcagccttcactgccctgagtattgtagtttacatacaggagtcccatccactgcaccactactcccaagcctagggatgaagatgctgtaattcaccttttcctggggagcctgcctctgtttccctggagtggtcacttgtagttcaaaatgagccccagatttgctgcacatcctggccagcaccaactgccaacgagctccgtgtaacttatagcttatgttgcacctgctctcaggttgtgtggaaagaggaaatattggtgttcataataggctctggttgttaccaaggtctcccactggtggccagagtgtatcagctattaatctctctagtgctgtcgaagagacttttctaggctcctcccaaggggctgagtctagtactgccagatgggctcacagttcatggatatgtgagagggatgaggctggcagatggacagggcttgtactttgcactttggagctctcagaaagagccctccaggcctggacaggaggatcactcctgtggcctaagaaaatgaccaaggctataaatatccaatctcaaatctcaacaaagcaatttccaggttttaccttatatgcacatgtgaggcattccattttatttgtaaatgttggtggcattggatattcctctgtttccttctaatttcagtatggttttaataatgttggggtttaatggtctaacagtaatataatacatgttaatctcagtcatgtaagaaatgtcacattttatttaattcaaatcctactctggaccctattcttgctttggtgggaaatgtggcctaagtaattattggaggaccctctgcttctttggaatctctgaagtattaggaggccaatctggtatggggaaaatgaaggaggccctctctccttcagttcatcacggctgctgctaacccattcctgtcccagctgatagggtatctgagaagatgggtgattcttctccctccaagccaagcttgacaagactagaagctgtgaggtatctgatctggcctctgtagatgaacaattgagccacaccctgaagttttctcacctccccaatgtattgccatgaggataaggacaggtccctattggtcatgacatcccttgctgcctcacccctgaacagagagagcctaaagtcctagctactttcttgaaaaaaaaaaaagggtagaaaaatacacagagagcaaacaaacacaaattaataactgaataaagagttgaactagcctgggcaacgtagttgagaccctgtctacaaacaacaacaacaacaacaac

SEQ ID NO: 148292 - DNA, 325 bp, Homo sapiens
ggtagtactggcaggggctgagctggagacctgggcagagggcaggctggctccagaggcacccacggagccaggggcccgagggcaagagatgtgaggagagccattcacattgctcccgcctcccagagcatgctggagatgtcaggaggccaagagaaaacgcccaaggaaggctgtgcctgccaaaggccccagggcacaggagggaggggcctggggtcacccatggcccaggtgtctgcttctcctctttctcttggggaagagggtactgcccacaccatccccagggcacaaacccgagcagtgtccatgtctgact

SEQ ID NO: 148293 - DNA, 375 bp, Homo sapiens
ctgtggtgacacatgaacaccacgagtctctacttatcctttactgaactatcagtgcacacccccagccacacaaccgccagacctgccaccccgagccgagaaacaccgcgatatcatcatcagactcatatgtttaacacatgttaacaactgcaccaagaaatgttagagaccccccccccgcaaactgcagaactacattcttgactaatgccacacacatgagagactcagctatgggccagcctaagggactcctgtatctccacgtgtcttcctcctttctactctcagaataaaatgttttctatgctcttcagggcaacgtatgccctactctttaaaagtttctgctatcaaaagtgaccttag

SEQ ID NO: 148294 - DNA, 311 bp, Homo sapiens
gggctggtgccaacctggctcagacatcacgacaccgatgccctgacttcctggacctcatgacccctcctgccccaacagcctcactgtggaactcacagctccaaacagctcagagaagtcacagtttgcacttgatctcggccaaaaggccgagaagtgatgaaaactcacactttgaacgcactaactccccaaacagcccagagacctcgcattctgcacacagtaccaaaacagccaggtgacctcccatctagggatggggccccctcaaacctccccaagccatgctaggacctcacacctcg

SEQ ID NO: 148295 - DNA, 810 bp, Homo sapiens
gtctctcatgaacatggttcttgtaggtctgttcccaagagtccaatcagctctggatgcactaacggcactgagtttctggacctacgaggctgatgacaccatggagccatgaattccaaaaaccgttcacctgtggccagcagcagaagaaggtatgcaaagagaagagaaagaaggatgcaatgtccacacatgctaaaggaaggagctttgggagccatggcttacggtgcagacatggccaagtccaagaaccacaacacacatgaccagttccaaaaacggcacagaaatggtatcaagaaacctcagtcacaaagatcggtgtctctaaagggggtggatcccaaattcctgaggaacatgccctttgccaagaagcacagcaagaagggcctaaagaagatgcaggccaacagtgccaaggccatgagtgcacgtgccaaggctatcaaggccctcgtaaagcccaaggaggttaagcccaagatcccaaagggtgtcagccgcaagctcaatcagcttgcctacactggctaccccaagcttgggaagcatgcttgtgcccgcattgccaaggcgctcaggctgtgccggccaaaggccaaggccaaggatcaaaccaaggcccaggctgcagctccggcttcagttccagctcaggctcccaaaggtgcccagtccccctacaaaggcttcagagtagagatctctgtctgccaacgtgaggacagaaggactggtgcgacccccccgggctgccatcggcatggggctggtgtcctcctgtgctatttgtacaaataa

SEQ ID NO: 148296 - DNA, 836 bp, Homo sapiens
gtctctcatgaacatggttcttgtaggtctgttcccaagagtccaatcagctctggatgcactaacggcactgagtttctggacctacgaggctgatgacaccatggagccatggtaaacgcactcttacactgccccagaattccaaaaaccgttcacctgtggccagcagcagaagaaggtatgcaaagagaagagaaagaaggatgcaatgtccacacatgctaaaggaaggagctttgggagccatggcttacggtgcagacatggccaagtccaagaaccacaacacacatgaccagttccaaaaacggcacagaaatggtatcaagaaacctcagtcacaaagatcggtgtctctaaagggggtggatcccaaattcctgaggaacatgccctttgccaagaagcacagcaagaagggcctaaagaagatgcaggccaacagtgccaaggccatgagtgcacgtgccaaggctatcaaggccctcgtaaagcccaaggaggttaagcccaagatcccaaagggtgtcagccgcaagctcaatcagcttgcctacactggctaccccaagcttgggaagcatgcttgtgcccgcattgccaaggcgctcaggctgtgccggccaaaggccaaggccaaggatcaaaccaaggcccaggctgcagctccggcttcagttccagctcaggctcccaaaggtgcccagtccccctacaaaggcttcagagtagagatctctgtctgccaacgtgaggacagaaggactggtgcgacccccccgggctgccatcggcatggggctggtgtcctcctgtgctatttgtacaaataa

SEQ ID NO: 148297 - DNA, 928 bp, Homo sapiens
gtctctcatgaacatggttcttgtaggtctgttcccaagagtccaatcagctctggatgcactaacggcactgagtttctggacctacgaggctgatgacaccatggagccatgatatgacaatttgtgcttctgttctgaggcctttgaattgcactccaaatatcctcagggcagaggtgttaagtgagaagcaggcactatttgataatgggccaggacattcctacagaattccaaaaaccgttcacctgtggccagcagcagaagaaggtatgcaaagagaagagaaagaaggatgcaatgtccacacatgctaaaggaaggagctttgggagccatggcttacggtgcagacatggccaagtccaagaaccacaacacacatgaccagttccaaaaacggcacagaaatggtatcaagaaacctcagtcacaaagatcggtgtctctaaagggggtggatcccaaattcctgaggaacatgccctttgccaagaagcacagcaagaagggcctaaagaagatgcaggccaacagtgccaaggccatgagtgcacgtgccaaggctatcaaggccctcgtaaagcccaaggaggttaagcccaagatcccaaagggtgtcagccgcaagctcaatcagcttgcctacactggctaccccaagcttgggaagcatgcttgtgcccgcattgccaaggcgctcaggctgtgccggccaaaggccaaggccaaggatcaaaccaaggcccaggctgcagctccggcttcagttccagctcaggctcccaaaggtgcccagtccccctacaaaggcttcagagtagagatctctgtctgccaacgtgaggacagaaggactggtgcgacccccccgggctgccatcggcatggggctggtgtcctcctgtgctatttgtacaaataa

SEQ ID NO: 148298 - DNA, 979 bp, Homo sapiens
gtctctcatgaacatggttcttgtaggtctgttcccaagagtccaatcagctctggatgcactaacggcactgagtttctggacctacgaggctgatgacaccatggagccatgggcagaggtgttaagtgagaagcaggcactatttgataatgggccaggacattcctacagaattccaaaaaccgttcacctgtggccagcagcagaagaaggtatgcaaagagaagagaaagaaggatgcaatgtccacacatgctaaaggaagctggtaactgcaacagtcacatgaggatggagagtctcttccttgtacagagcaaatagcacggcccctggagctcattggcatgggttgtccaactccccactgaagggagctttgggagccatggcttacggtgcagacatggccaagtccaagaaccacaacacacatgaccagttccaaaaacggcacagaaatggtatcaagaaacctcagtcacaaagatcggtgtctctaaagggggtggatcccaaattcctgaggaacatgccctttgccaagaagcacagcaagaagggcctaaagaagatgcaggccaacagtgccaaggccatgagtgcacgtgccaaggctatcaaggccctcgtaaagcccaaggaggttaagcccaagatcccaaagggtgtcagccgcaagctcaatcagcttgcctacactggctaccccaagcttgggaagcatgcttgtgcccgcattgccaaggcgctcaggctgtgccggccaaaggccaaggccaaggatcaaaccaaggcccaggctgcagctccggcttcagttccagctcaggctcccaaaggtgcccagtccccctacaaaggcttcagagtagagatctctgtctgccaacgtgaggacagaaggactggtgcgacccccccgggctgccatcggcatggggctggtgtcctcctgtgctatttgtacaaataa

SEQ ID NO: 148299 - DNA, 465 bp, Homo sapiens
ggtaactctcttcgaagaagtgtgtgatttgctgctgcttttatgtatttgattcaacctcagaaatatgatcattttttagtccatgaggatcttgtcacacaaaacttgcacctgcctttaccagagcctcctggtcattcttatcttatgattccggttccatttaaaagaaaatactcatggacaataagtgagaaggagcaacatagctttttgccctctgaactttttccctaacgccccttcacttgataaccaactggcctctctgtccaccaagtaccacactcactccactcttggcctgaaagccaagccccctacacacacacactccattcaggactcacagcctatctctcaagaagaacctaaagtggtcggtgtgagttgcaatcccaatgtgtgcattcaggaacacagcaaggctaagccacttagaatgcagtgataagagatgcc

SEQ ID NO: 148300 - DNA, 496 bp, Homo sapiens
tgaaaaatggttacaaagttcacaaaaaccatacaaactcacatttcttcaactgtaatgttcttaaagagcttgcagtagtcctcattccacacagccatatcactccaaaccttggaggcaagaagaatggctcccaagacaatcctcttccagttagttggacaaatgtcgatatcagcataacttacaagtctttctatgtaaatctgcaaaacagagcactggcctttgatttagctcagtttaagtgccaagaattcttatgaatgacagatttcttctggttttgaccagaaagtaagtgcttatgttctacagagatttgcttgatcagaccaaacaagtggccatatcacaattgtaggtcagatacttctgctacctactctgctcatagaaattcacagcccaattttggtcacaagaatgaccgtatatctcagccaagggcatcatgaagacaggcagtgctgtcaccttcacactcataaaa

SEQ ID NO: 148301 - DNA, 289 bp, Homo sapiens
taaaaatagcctaagccattttgtgttcatattttacaactcattttgagaattaatattttataagaaaattattttgattcaaaatgtgacttttaaaaggcctgtggtcttcttaagtgtaacttttattatgccttggggccggcagcttttctagagaaatatactgtagttatcgatgtattgtaccctttgtgaatttcccttcatgttctgaggctggaacatgagaaattatttcctttccttttttccgcctctacccctcctttttcctgcctgattt

SEQ ID NO: 148302 - DNA, 239 bp, Homo sapiens
acctgttgtttcctgactttttaatgatcgccattctaactggtgtgagatggtatctcattgtggttttgatttgcatttctctgatggccagtgatgatgtgagcattttttcatgtgtctgttggctgcataacgattattcttatgtttacagcaacatggttatttgcatagattcaaaaagaatctgttctctggccaggcacagtggctcacacctgtaatcccagaactcc

SEQ ID NO: 148303 - DNA, 459 bp, Homo sapiens
tgggggttctttaagaggccaggattgtgccgaatgctctttggctgacgatggccgtggcgggggctttgggaggggaggtcctggaggagaggcttgcccagctcactgcctgcgtctgtggccagaattggcacctgcatggggcctggaaacgtcgtgctcacctggggcggaagcccccctccaggactcagctcccaacgtcactgctaccgaggcagagactctgcagcggcatcagagagaagctgggccccagaacagcaccaggcatgggacgggccctccgtgccttccacggaggatgcaagcgtgaggcctgggtctgcggggacggtttacctgtcagctctgcacgccgctgaccactgcgcgccgcctccacagacagtccccatggacgctggggctgccgtggacgatggggcagccatcatggacaacgggactgccatg

SEQ ID NO: 148304 - DNA, 380 bp, Homo sapiens
tgatttacactgacctgcacatcttccccccaacaacgtaaactttcccacacccaaccttcatctcttcaagctctgaccctgccctcatactcccatctccaactccctcctaataaggagtgtggttcccgatctcaacctctggggagagaagagtgagaaaggcctgagtgagctttccatgaaggccaggtctggggtgaggaaggagacaaaactctccacaggcagcccaatatcctgtctcccttctcctcctctggggagggtcagagcctcacaaagcatgtagctctactgtgagtgggcagtgacgagttagtgtgccagggagggccagggaggcccagccaatgacaaaagcattggccccagaa

SEQ ID NO: 148305 - DNA, 309 bp, Homo sapiens
atgaccaaggaagggattatgacaaagcaaaaaggtctgagaacaaagtcccaggacattgcaacatataaagatgaagagtaacaataattgaaactgaaatgttgttgtcaaacaggctgaggatttgacataattcttacagtactataaatactatagtcacttaataaatttcctacagggaatgatgaggaaaccagaaaagaaacagcctatatgtaatatgttggggaataaaaatgctaaaaattaaaaataaggcaggtaaggatgagagtgaatacaggaagaaactgagggagaggt

SEQ ID NO: 148306 - DNA, 115 bp, Homo sapiens
tgttttggtttggtttattattatactttaagtactagtggttcttaagtggtgctcccatagtccccgggcctcacccaaggaggtccctgggctagaatggaataatagaggg

SEQ ID NO: 148307 - DNA, 169 bp, Homo sapiens
caggagtgaaactccatctcaaaaacaaacaaacaaaaccatggactcaaggtcaaggtttagcttctaattctggctccatcacacaatggctgtgacaccatgggtaaaactgcttaccctctcttagccttagtttcctcatttgtaaaatggaaataataacaca

SEQ ID NO: 148308 - DNA, 450 bp, Homo sapiens
cctgagaagcagaagcggagaggctccgtcagcccctggggggagccctgagttcacaccatccgcatgcagcagcctcccaccccctgctacagagacagcttccattccatggccaagtcacagtaagaaggaaaaaggacaaagcccaaggcctggagaggtgagattcttccaggaggtgagattgggagctggattgtagcgtggtgatggctggtggcttccatgggttggagcattggctgagcctggccctggccacacaggctgctgggagacaaccatctgctgtcattgctggaaggtctagggttctcctgaaactcatctgtcttttccagaaaactctttctcagccagtgcaaagattagcttgtcagggccttcctagcctccagctctcctccctagtcaaaggccatgccttggccatcctgaggcagctga

SEQ ID NO: 148309 - DNA, 349 bp, Homo sapiens
tatcattgtcgttatccccctcagtcctctggtaaggtcgataaaatgaatgggatacttaacctcagaatttccaacttttctgaaaccactagccttctttggcctaaaattctgtctctggctcttatgactcttcagagccacagtgctggaaaacacaagttaacttcttatgaaattactgcttgttactctatatcgttgactattactccaaatgtagatccctaatagacctatgttgaaatgacccaatactgtacattcttaatgcactatgccaaaagttatcaccaacaggtaaaggaagactttcaagacacagaaccaaaaaggcttgttggaa

SEQ ID NO: 148310 - DNA, 277 bp, Homo sapiens
tgtaagtgcatgaaaatgtaaacaacccaaatgtccattaagaggtaaatggataaataattgtggcatattcatacaatggaatattatatggtaatgaaaacgaaccaaaacaatatgcaacagtatggataaatctcacagatataatgttgagtgaaagaaagtcaatgtgtaagagtatatcctttataatctcatttgtataaagttcaaaatcaagcaatgattcctgtggtgttagaagtcaggacagtggttacctttggtagtggtg

SEQ ID NO: 148311 - DNA, 417 bp, Homo sapiens
aacgggtgatgcggttggaacgggtgatgcggttgggcacctgtcgtaatcccagctactccggaggcagaggcaggagaactgcttgaacccgggaggtggaggttgcagtgagccgagatcctgccactgcactccagactggagacagcgagagtctttctcaaaaaaaacaaacaaaaaaacaaaacaaaaaacacacaaaaaacaaagcagctcaggcaggctccagccagaagtgctggccggtcaaggtgtatccattctgtcctcccaggaggccatgggtctcgggaacgagctctgcttccgctctggactgggaaggcaaatgggggaggctgggctgcgtgccatcccgcctcctgatcaaggccggggagttcctaagctcctggggcagccacggaggatgtc

SEQ ID NO: 148312 - DNA, 322 bp, Homo sapiens
gccacagtgtatgttgttcccctctacgtgtccatgtgttctcatcggctataagcgagaatatgcggtatctggttttctgttctgcttattctcacttataagggagaatctgcagaaaaccagcagtatctggttttctgtttctgtgttactttgctaaggataatggcctctagctccatccaagtccctgaacaggatcccattcttttttatggctgcatagtattccatggtgtatatgtaccatgttttctttatgcaatctatctatcattgatgggcatttgggttgattccatgtctctgctattgtgaa

SEQ ID NO: 148313 - DNA, 566 bp, Homo sapiens
  misc_feature (120)..(120): n is a, c, g, or t
agtcgacggagactctcaatagctatatcagtattggcttgattcatgtttcaatatgacaacagcatgtctagttaaatactgctcgcagctggccatgggacatattatgaatacctntgcttcccagatacatttataattgtttagtttttcatttgcttacttctctgggccataattcaaccccaaattatttgccatttgtccagatctctccacatcctgatggatcaggttgtggagagtctccgtcgaacatcatttcaatcttcatatatcttcctcctgtggttagacttaaattgagggctgtgggctcagccacagaacatcatggcctctgttaccctaagtttcttcctgttcttgaaattgtgacggtttggaaagagatggggagaatattgttacccacgtgacaggctgcagcaaccttgaccactaaggtcaaataagcagcattgatgaattttagcatgtgggcacccctggagggggcgaggcaagtctttctgttacaaagatgcagatttcagtgcaactgaaggcagaactttctaatg

SEQ ID NO: 148314 - DNA, 463 bp, Homo sapiens
aaaaatgctcatcatcactggccatcagagaaatgcaaatcaaaaccacaatgagataccatctcacaccagttagaatggcgatcattaaagagtcagaggatgtggagaaataggaacacttttacactgttggtgggactgtaaactaggtcaaccattgtggaagacagtgtggtgattcctcaaggattagaactagaaataccatttaacccagccatcccattactgggtatatacccaaaggattataaatcatgctgctataaagacacgtgcacatgtatgtttattgtggcactattcacaatagcaaagacttggaaccaacccgaatgtccatcaatgatagactggattaagaaaatgtggcacatatacaccatggaatactatgcagccataaaaaaggatgagttcatgtcatttgtagggacatggatgaagctggaaaccatca

SEQ ID NO: 148315 - DNA, 263 bp, Homo sapiens
aacttttatttagactttaatacacaggttgacagcatgttcattttgtgatgacaacccagttgtcttattaggtaagtgttattagcctcagtttacaaattgaaaaaccaaagcccctaacagctctgcagcttttccaaagtaaacagctggttccgcacagaaccatgcacgaggcctagctccacacactcatactgtcagacttctgaagcagagtctctccttttctgtacctgagtacccgagcaggttgtacg

SEQ ID NO: 148316 - DNA, 481 bp, Homo sapiens
agcactcattcaagtagcaacagctgaaaccagccttattgtgcccctcagtgactccgttaccagccagttggaggcctctcctcaaagagctgagcctgagctcctctttcaaattcagtaacccaatactagccaaacagcactcccttgtcagaggtctgagatttgtgagaacttaaaataagagctaaaaataggtaatatactttatggtagcattttttattcctcatataagcacttcacaaggttaaattcttctacttagaatgtaatcccattcacaacaaccacaaaaagaataaaacacctaggaataagctaaccagggaggtgaaagatttctacaatgagaattacaaaacactgctgaaagaaatcagagatgacacaaagtaatggaaaaacatcccatgctcatggataggaagaatcagtattgttaagatggccaccctacccaaagcaatttacagat

SEQ ID NO: 148317 - DNA, 439 bp, Homo sapiens
taccacaggaacactacaagtggaggcctctacgtacgtcgagctgagcgtgtgcacgctctggtcactagtgtccgtcgtccaactactgatcctgactggaatcccttgtcagaggtctgagatttgtgagaacttaaaataagagctaaaaataggtaatatactttatggtagcattttttattcctcatataagcacttcacaaggttaaattcttctacttagaatgtaatcccattcacaacaaccacaaaaagaataaaacacctaggaataagctaaccagggaggtgaaagatttctacaatgagaattacaaaacactgctgaaagaaatcagagatgacacaaagtaatggaaaaacatcccatgctcatggataggaagaatcagtattgttaagatggccaccctacccaaagcaatttacagat

SEQ ID NO: 148318 - DNA, 672 bp, Homo sapiens
atacccaattcaatctttagaaaaaacaaaattggaggcatacatttttctgttttcaaaatattttccaaagctccagtaattaaacagtaggtactggcataaagataaacataaccactgggactacagacatatgccacatgcctggctaatttttcaaacattttgtagagatggagtctccctatgctaggctgatcttgaactcctggactcaagcaactctcccacctcggccttctgaagtgctgggcttatagtcatgagccaccatgccaagccgagaagttggtattttatctttttggcttcctatcaattgggtctgaattcagggaagagttaagatgtgtgagcagctatcactgcctaagccccattaatgacaggatagtaatacattttttaataggtaactctaaccaaaagtagttgttttatgagaacctaggtctagcaaaagaaataaacttaaatcttgccagtctaacaataagggaataaaatatcccagcagccaagtgtggcagcttatgtctgtaatcccagtatcttgggagtccgacacaggaggattgcttgagcccaggaggtcaaggctaaagtgagccttggttgtagcaccatgttaaagcctgggtgacagagtgagaccctgtctcaaaaaaa

SEQ ID NO: 148319 - DNA, 505 bp, Homo sapiens
gcaggcatctgccttcctaccttgggtctaactctggaaactaccagagcagtgaggagtattctgctccacacagtcctttctctcctattgctgggaagaatgtgaaagcatccctgctctaagccctgctactgccagaaaggagacagcctcccagaggccacagacagacaactcagtggggaagtgttcgtgctcccgcaggctcttcagagtgaggcccagggagctgccgactgactcgaaggtgaccttcccttggaatgaggaggccatagcactgacctgtgcctggactgatgacagaagaccagatgcgactgggtgactcaggaaatgcctgcatgatgacatgattaaataaccccctctctctttggcctcaggtaaaccctgggaataggcagagagacactgaattcatggaaagttcttgcctactaggataatgaagacttctgatggaaattaggttgaattcaaataaaactgcatggatggc

SEQ ID NO: 148320 - DNA, 100 bp, Homo sapiens
gaacttggcacctagtaaaactttgattctgtttgctaaggaaggaagcgagtcctagaagccaggtggtgcctggaccaagctcttttggcaggctgtt

SEQ ID NO: 148321 - DNA, 439 bp, Homo sapiens
ttatattattacctatcatccctctaactgcccagtggaaaagcattcatgggtgtctagctcacacactatcagcttccaattctcccacccatttcactagccccatctcacttggccatacctaaaagagtaaaaacattttaaaaaatcttttcactctcaaaatgattaatgcacattaatggatggcatgaaagccctggacatgaatcatgtcgagtgctttcatgccagataattattttccttaaaaagtaaaagcaccaactcttgaaccttagagcaaaaaatctgcttactatcaaaaacaaaaagttcacccaaaggtaaatcagagtcaattgccagtcttttcaggcaaaataaggaacagaggcataagtcactggcttggttacagtataatgtttataaagggcatgaaagcagggtaccg

SEQ ID NO: 148322 - DNA, 220 bp, Homo sapiens
aaaaaccgcacccggacagcagggtcagcaccctaacctgtgaagagaacggccacacagacgggcaaactgtgcccgggacagcagggtcagcgccctaacctgtgaacagatggccacacagacgggcaaactgtgcccgggacagcagggtcagcgccctaacctgtgaacagatggccacgcacatggaaaaaccgcgcccggacagcagggtcgg

SEQ ID NO: 148323 - DNA, 365 bp, Homo sapiens
cctgctatcgtggacattcccattaaccctgttagttttaaatgttaaaaacagagaactcaagacatctacttttttaatgtcaagaaatgcaaagtggcctatgataataaacataaacacatacataatagcccaggacttaaaaacaaatcccttcatttcttagacccacagccacatagatctcacagtttaaaaaaaaaaaaaaatccacagtgaaacgtatcagcgtacattctctttcagatccaatacacagaaaatctttacacttataattttacagggaccaggattagagagagagagagagagagagagagagagagaaggcacgcatctgctttatgttctcagtgacc

SEQ ID NO: 148324 - DNA, 314 bp, Homo sapiens
tggggaggtgggtggtggcacaatgcctctggcccatgctgcaggttctgagcctttatgatgtctgatgattcactgcactcagtacttcagtacaagtgattcttgtgagagcagataatactgagcagtggaattagagatgtgtgtttgcttcattgttcaaggattctttgggtatagctttggaacagtcagtgttaagctttctgcaaatgagggtgtaaaaggcttttttctaagctatggcgcagaaggcattagagtagctggcagcagataaataagcagccacaatttgtaggtaattactt

SEQ ID NO: 148325 - DNA, 291 bp, Homo sapiens
tcatcccagtgcctcctctgcagacaatcttgtcctcagtctttcaattgttttcttcccatgccctgacaagcgaaccagatcaggaatttaggagcagcttacctaatggcacctggttacctaatggcaccctcaacagcttacctaatggcaccctcacttggttctggctccgggcctctcacaagattgtacacatgatgatggccaagtttgcagtcatctgaagtcttgactggagctggagactacatttccaagatggctcactcatattgctagtaagtt

SEQ ID NO: 148326 - DNA, 366 bp, Homo sapiens
tggtcttgcaaacaaagagagggtccctagttggcaggattggagagtaggatttcactccctccctccaggccattgtcttccacctgagccaccacagcctcagggcggcttcagaactgtcctggatgagctagggacagccctgtctcaactgcgccagcaaggagatgtgctggggtcactcacagttcttagagtcagggtgggttttaggaaagagatcacccaggagactcgaaaggtccgtttgctttaggcatgtccttgcctatggggccaagacctcactctagccacccacagcttttcctaccttaccactcactgcacccacattcagccttcactctcacccccacccca

SEQ ID NO: 148327 - DNA, 453 bp, Homo sapiens
ggaagaggcattttcaccttggagaacgctcacatgactgataaatatatgaaaagatcctcatcttcattagtaatcagggaaatgtaaatcaaatccatgagactggcaaaaattaagaaatctgaaaataccaagtgttggggaaaagataaattaataagaacacatgtggccgggcacagtggctcatgcctgtaatgttagcactttgggaggccaagctgggtgggtcacttgaggtcaggagttcaagaccagctgggcaacatggcaaaaccccatctctacaaaaaaatacaaaacttagccaggcatggtggctcacacctatagtcccagctacctgggaggctgaggcaggagaattgcttggacccaggaggcggagcttgcattgagccaagatcgtgccactgcactccagcctggtgacagagtgagactccgtct

SEQ ID NO: 148328 - DNA, 349 bp, Homo sapiens
ccaagtgggcggaatgaacccagtgggcggaatgaacccagtgggcccgagcaaaactcagacaaaggcaccacctgtcaaagaggcttccggctagaaaagcgacaccctaaggattctgtgaaattagctcatattagtctgtttgctctgttttctagttttcttcaactttatgctccagatttgaacattttttcttggtcattattgtatttttatttagcttgtctcactctttttataatttttggcaaacaaattatttcccaaagcagttttttaatctctaatatacccattattatagcaatataatctcaattcaaagcagcaatggcccttttca

SEQ ID NO: 148329 - DNA, 387 bp, Homo sapiens
actattattgttaggcaaacctaagggccaaggagagacaggagggaaggtgtaatattacttcttgacatgacattattattatttatcttttgaggcagagccttgctctgtcgcccaggctggagtggaatgacatgatctcggctcactgaaacccctggcacccaggttcaagtgattctcctgcctcagcttcctgagtagctaggattataggagctcacctccatgccaggctaatttttgtatttttagtagagacggagttttgtcatgttggccaggctggtctcgaactcctgaccccacgtgacccacccaccttggcttcccaaagtgctgggattataagcgtgagccacctcacctggcctacttcttgac

SEQ ID NO: 148330 - DNA, 342 bp, Homo sapiens
tctgtctaagtccagtatttactggctcaaattggtcacaacccgctcccttttagttgcagccagaaaaaattaacaattgaaatatagaggcttttatattaatttttaatgctgattatcattttccaaggtttcctttggagggaatactctaaatattgttgatatgtgattttcctctgaagataataaagacataggtatttgactaacttctgaattccacctttcccacttcctcaaatatttaaaatatcttatttgagtgtacttccataccaccctgaacacgcctgatctcgtcttaaaatatcttatttgaaaaaaaatctcctaaat

SEQ ID NO: 148331 - DNA, 499 bp, Homo sapiens
agcagtgggcataccaaattctctgacctcttggagcttatattttaccagaggagacagataaatgaagtgatgagtactgtgaagaaaaataatggaaaaaaagggaatgcaggagtgatgttgtatgctattttacataggaatggtaagggaaggccaccctatgtaaagtagcatctaccccctcctcccactgctacactactctgtctttgcttttgttcaaagcatttttgttgtgttcttaacttaaaaatgggagaagcaaaataggaaaccttgaaggaatcctagataaacttatttttttttagaattgcccctaatatcttctaaaatttattacagaatgtaaaatgcttattacccatcaaatgtatctgttatgttttgatttatttttaaacaaccatataaagaactttggaagagatcagctggaaatatatctcatttattttatgaataaatatgaaaattctctttagtatgaaaa

SEQ ID NO: 148332 - DNA, 282 bp, Homo sapiens
tagaggctgacaggaggcagaggctgggcctggagaggctgccaagatgcaggagctgggcctggagaggctgccaagaagcatgagctgggcctggtgaggtcgacttgagaaagctcagggcctggagagaaggctgggaggcaggagctgggtctaaagaggccattgtaacggtggagctgtgcctgtggaggctgttgtgaggcagtagcctcatctgcagagactgccgtgaggtagggtatgggcctaaataggccattgtgagtcatgagcttg

SEQ ID NO: 148333 - DNA, 186 bp, Homo sapiens
agatagccaggtacgttggccaggaaaggctaggactcagctggaattaattaacttcttagaggcatagaaaaaagaaaccaacacgttcctgggcttgatcatgggtattagagttcatttctacttgagggaacgctggcctgcaagttgcctgttagctctacaatcagttctctaaactct

SEQ ID NO: 148334 - DNA, 351 bp, Homo sapiens
gctatcttccttttcttttccccacattagcaaagttaaccaatgacatgggcataggcaactcactttcctccttgacccagattgttaagaaacccaaacatacttttatggaagtaaatcattgcaactcagcattacccagctattaatgttacagtataagagtaatgaaggtcaccggctagggccatccttgtgtattgtgccattcttgaatgggagtaactctgctatccaaagactctcagcaccatgtcaaaccggctggcttctagtaatgctgaagaaggcctatgtctaagcacatgtggagatgagcactgaggtaagccctaaaagcaagttttt

SEQ ID NO: 148335 - DNA, 727 bp, Homo sapiens
taccattacattatgtatctgtctgttcagatttatttgcagatcccactgtagtcaatttcattatttctaaagagagaatcatctacacttatgtttaaaagaataacaagtttcactgaagagatattattaaaaactatcattttgtgattatacattaaaaataataattgcaccattattaaaataataataaatgatgatataaggaaaaaggagaacagacaacaacagtgcagtgtgactttgccaagagcttctattaccgcatgagtagaaggcaggcccagggcctgggtgctgatagagacaaactaggaacaagttaccccaatcctagactcacatgcagtatctggaaaaattactgcctggggtgaggcaaatttgggaaactatcttctattcttgtagtagggggttttgtgtgtgtgtgtgtgtgtgtgtgtgtgtgtgcatctgtgtgtgtatttccccttgggaaactcagtggcacataaagttattcagggttttctttaaagtgattatttgctaaaaattgccttagcatttccacatcctcatcgaggatgtcatacgctcctccggtttttcttcacagctttatacaacttaatattcaggctagggaaactggaaatttcctccaggtcaaacaactccttaaatctatctacaaatttattttccttctccaacctgaatttcatggcccacagga

SEQ ID NO: 148336 - DNA, 415 bp, Homo sapiens
tgagggctgaaataaacatgttattaataatccaaaactggcaagggatgttgactggtccccctcccttgcccaaggagctttctagaacctgagttatcattaccaaactgtactgccttgagtaagaaagttagaaggaatgggaaggatggtggcaggtggaggaaggcggattggtcatcacctccttgcagcaagaaacagccccagatcgtgggaaacctacagacctgctagacagactaggagcaaaagctggggctttaagaatccccagggaggttctcctgagagagtagccagttggattttgtaagcagagatttgtttggggaggaggtgacaacgtagggagcagaggggcaaagctgtcgggaatcctgccttgagggcagggatgtgtgttgggggg

SEQ ID NO: 148337 - DNA, 199 bp, Homo sapiens
ctaggacctttgctgctccaccgaagggccagggactatggttaacttatcaacatcaacccattaactagtcactgtgccagagagtatctgtcaggctgtcaggttgtagcaacctcttcattccagagctggcccagggaccggggtgggacaatgggtttatgcgtgtccacagtacaccctccctctcccagcc

SEQ ID NO: 148338 - DNA, 209 bp, Homo sapiens
ttgaacgctttattttcctccaccactctgctctaaattttatcaattttcagtttagatctgttaaacgacacatctttcaaaaacattgaaagtacttaacttgtctaagcctcagtttcatcatctgcaagatagagatacctacatctcataaggctactgaagatttaggacaggcacaggtgctcacacctgtaatcccagca

SEQ ID NO: 148339 - DNA, 464 bp, Homo sapiens
ctttagtacagaaaccaaggtgaatgacctttaaaaaacatattagactgttgacgtgtcttctatgttgtactctaggtaaaaacgataaaccaggaaaaagaaagtaaaattcaaccttaggctcatggatccagagtggataattatgagtctgtagtatctacatgcatgtgatgaggttcaaggacaataaccataaagcaaagacttaaaaggttttatcattagaataattgtaattcacttgatctctcaatgtaacaatacttcggtctactgtctcaagccattattatgtcttacactcagcatattggtttgtctaccattaaatatttattttctacagtgctttctggaaggcaaacaaagcagccactctgctactttatattgattcctgagttgtccttcggaaacgctttcaggaagtttaataggtttgaaagatatttagacct

SEQ ID NO: 148340 - DNA, 581 bp, Homo sapiens
tcaaaaaggttaatgtgacagaaattctccacctgctcaaaaaagacagcagacatgatctctttaaaaaaaaaaagttcaaaagagattaagagatgaaaaataagattggtggagtttaaaggccttatactagaaaccacaaaacataaaacagcacagagaaaataggctggaggaaataaaaaatggaaaagagaaatatgtagaataaagaaatattctgatggtttaaaaagaattggccgggtgcggtggctcacgcctgtaatcccagcactttgggaggccgaggcagacggatcatgaggtcaggagatcgagaccatccaggctaacacagtgaaacccgtctctactaaaaatacaaaaaattagctgggtgtgctggcgggtagagctactagggaggctgaggcaggagaatggcgtgaatccgggaggcggagctttcagtgagccgagatcgcgccattgcactccagcctgggcaacagagtgagactccgtctcaaaaagaaaaaagaattaaatggggtcaggatggtctcagatcttataacaagaaggcaatgaagcaa

SEQ ID NO: 148341 - DNA, 252 bp, Homo sapiens
ttgtctaccttggagaaactgaggaacacagtggcttcactataagttacatggtccataagggaagaatctaggattagaagaatctcatggaagatgaatgacagtgggtccttgggaacatgaggtcacattcaaaagttggaagtggctggattcctggaaaacttcactacaaaacaggcagaaagactcctagatggatagatctcagcattgagtgtcactctgcagacctcatgaggtacttca

SEQ ID NO: 148342 - DNA, 246 bp, Homo sapiens
gagctgaatctcagctgtgactcagtgccagcaccatcatcacccttggtctccagagagcaaaacaccgtgcaggccaaagctcccacctgagccgcaagaatcctgccagcctcactgaaagcaccattcccacgcggggccctgtatccctgacggccaaccacaccacccttggcttcggctttcagcaaaaacgtcgctgtcaggttgaacacgttactgccccaccagcagcaggagcaa

SEQ ID NO: 148343 - DNA, 762 bp, Homo sapiens
  misc_feature (133)..(133): n is a, c, g, or t
acccacgcacacacacatcccctcacgccgctactcttaaatcttccgaccacacaaacacacacacgctgggtacctttggattgtttgaaaccagaacctaagaaatcctccacaatgaaaattcaacatntggaataaaaatcagaatagaaatgtcttttcaaattgactgcaaaaatcatcagctggctatagtttagacgtaatccgtccaagtgaagaggcaacaattcaaatcttccaggcccattattttgaatatatggaggttacaatggaaatatttgcatcaaataactttattaaaatggattagcaatttttagttatagtgcacatctcccttaaaagaaaaactgttcacagaaaacatgtcactttgtactcattatctgtttttagcaaacattcaggactcaatgttgtcctcaatgttagaatttcttaaattgaaaagtatcacaataataatccttggaacctgttctacaatattacaaagtgtcaatatgggatgtgactataaaatgataataatgaaccacattttcttgcactcagatgaacactagtattatataattagttgggaaggcaagcaattttgctttcacattaaaagaaatgcaaaggccatttcttggagtgaggattatttattctatgaagctaactgggaaaagtacataagcagataccgcttatatctcaatagaaaattcacatcatacaaatattaggatatcaacatttccaatt

SEQ ID NO: 148344 - DNA, 744 bp, Homo sapiens
  misc_feature (115)..(115): n is a, c, g, or t
cgataatctctccataatttatatcgactattaatcccacgcccgcaaatcagggtacctttggattgtttgaaaccagaacctaagaaatcctccacaatgaaaattcaacatntggaataaaaatcagaatagaaatgtcttttcaaattgactgcaaaaatcatcagctggctatagtttagacgtaatccgtccaagtgaagaggcaacaattcaaatcttccaggcccattattttgaatatatggaggttacaatggaaatatttgcatcaaataactttattaaaatggattagcaatttttagttatagtgcacatctcccttaaaagaaaaactgttcacagaaaacatgtcactttgtactcattatctgtttttagcaaacattcaggactcaatgttgtcctcaatgttagaatttcttaaattgaaaagtatcacaataataatccttggaacctgttctacaatattacaaagtgtcaatatgggatgtgactataaaatgataataatgaaccacattttcttgcactcagatgaacactagtattatataattagttgggaaggcaagcaattttgctttcacattaaaagaaatgcaaaggccatttcttggagtgaggattatttattctatgaagctaactgggaaaagtacataagcagataccgcttatatctcaatagaaaattcacatcatacaaatattaggatatcaacatttccaatt

SEQ ID NO: 148345 - DNA, 351 bp, Homo sapiens
gaaaacaaagcgtgattctgtctgggtagtgatgaaatactagtcagctggaagtagttctgctccttggaacttacatctcttctgtgtcctgaatcttctttaaatattgctctcttttcttcttccttgtttcatgttccattctcaagtataagatccttgaggctagaactttgttttgttcatctgggtatactctataacacagactgactctctgcattagtaagggtttatcaaatacttacggagaggaattgatgagaaatttccaaagatttaagtaactcaggtgtaaagaatgagggtaaagctcgtttaccttgatttctgcagataggtagctgt

SEQ ID NO: 148346 - DNA, 385 bp, Homo sapiens
tgccacatatttgcagaatgaagaaaactcaactggagaagaaatggaatgtatgtggccgactggaacagtgctttactacagcatcaccataatattgcacatcagtagaaaaccacatccagcataaacttcagagaaggcaaatgtgtcatggtggagacacaggctgtggagccaagtaggggtgggtttacatccctatttgtcagtggagcaaacttgtgcccatcttgagttcaaggccatacattttaataaaatatttttgtctgagtagatgtagaaatattatattggtcaacatctgcacaattggtattaattaatttgttgataactaattattcaaaactcagtggcttataacactaagcatggattt

SEQ ID NO: 148347 - DNA, 580 bp, Homo sapiens
ctactcgagaggctaacgtgggaggatcacttgagcctaggaattcaagaccagactaggcaacataatggacctcaactcaaaaccaaaaaaaaaaagataagtcatctttaatttttttaatgatatttgagatcattttatacaatcttatcatttgaatgacttcaattacttaaattggctctattaaatacaagaatataatttgctttttgatatatcattttttcttctgtctttgcaaggatttacacagttttcttatgctttaaaaatagtaaccaacaaattgttgtgcaattgattttgaaaaattgatcttttaaaaatttatgtaggagaattatatgtaagattcctgacactacctgctactgagttgttttcaaatcaatggttcttaatttattgtgaatctcatatcattgtattccttgaaaatataatgaaaactaagattctcttctgagaaaaaacatgcccccataaaaatttccaaaaattttagtgggttcaaggatttcctgatgtccatcaaagcattttagtttaagaagtccagccctaaactgtgaga

SEQ ID NO: 148348 - DNA, 434 bp, Homo sapiens
gaaaaaaacaatgcggcaagtcaagatccttggaacatgaagactctgcaatttccaacaatactcactggcaggtgcaggtgaaggatttaagatgagcaactgaactgggaagaggcattggcctcttcaataggaatgagggtaggcagttcatggtaaggtctgcggggcaggagcaatctaatcctatgaattttattttattttattttatttttgaaactgatcagcagagctgccttccaaaataagaactcaatttgaaggaaaactaccaagcttgaaatcacatttgagcaaaacaacagaaactaaggataaaagaacatccacagaaaagcagggaaggagaacagagccagaaaatcttagaaataagcagccaaatgtttttgtagttttgtgaactgaaatttttattgagatcattg

SEQ ID NO: 148349 - DNA, 411 bp, Homo sapiens
tctcagaccggctgacacttagggaaaatagaaaagaacatacgttgaaatattgggtgctggtttccccaataatgctgtattttatctttgtgttttaaattgttacagataatggtgacttcaaaagtaaaagtagtttctgggattggtggattctctgcatgcataaatgtttaaaaaacacatcagctcttgaattttctgcttcagtttaatcttacttattgtttaaaacaccaatgtatttttctgtattttaatcaagatttagttagatttaacaagtgtttaaatttgaaaaacatgtaagtcatataggatatacagaagaaaatgtaaaatatggagtcttctttatgacctgaaaagaccaaatattttatcttttttaaatatgaattttgactt

SEQ ID NO: 148350 - DNA, 383 bp, Homo sapiens
cagtactttattaaatatgtcttttacaattatgctctccccaaacatgtggcttgtcttttcattctcttgactgtgtcttttgcagggcagaaatttttaattttagtaaagtctaatttatcaattctttctttcatggatcatgcctttggcattgttgatatttactttcaaaatgtgtgtcagatgatatcagtctttttttttttctttgagagtgacagcctgaagaatcatcgatatcatctttaggctgatttatcagattggtttgccttgcaagcaaatgtgatcccaaagctagtctctatggaataagcggcatgaaaagataccatttactggatttgtttgatagtctagtggagatgatactatag

SEQ ID NO: 148351 - DNA, 265 bp, Homo sapiens
atttgccttaatttgcatccactggatgagacaaaataaaaatgccccatttggtgggttgatttcaaaacagagaataatgtgtgatctgcttttcactacaaataatgtgaagaaaaaggaaaattgcaccccatcacccgtgactctcctctcctctctgtctcctctctgtcttctctcttccccatctccttctctctccctctcctcctctcttctcccccactgttcccttctcttctgtctccctcctttttctcct

SEQ ID NO: 148352 - DNA, 482 bp, Homo sapiens
gggatgacagcggaaacaattgggacctgacagtaaacggtgagtgtaagtgatagcaacgatgttaccctaaatctagaggcgggcaggtccttggcaatcactattgccaaagaaggtgaaggctatcctccaattaggccccgtacaccaccaccctggcacaaggattgagagtgactcaggaccttagtactcaaggtcctgtgtcccaaccctcaccttgagaagcaggcagggcagcacaaaaggaaggtacacgccaggattgtcatgggagtgggggctgggggagggcataggttccctcaaggatagagctccccatctggcacaagagggttctgccagatggcagaacctcttccttggcaggatgaaggccatcgttaagtggtctggtgtgtgtgtctggggtagcgatggggtcttatggagagatttgggggggacatgggaggcgttgacacggatggtggaaa

SEQ ID NO: 148353 - DNA, 320 bp, Homo sapiens
catttatgtaaatttttctaatgtgtacagtgactttttaaaagtaatatgctaaaaccaatccattgagtgaaatgacaattggattaaattataacaacaatattaatgcagacaactctattttctagttacacttatcaagagattagtattgaattatttacttgctttgcaaataagaaaatgtaaaattttaaacttttctcttatttaaagacctaagatgaccaatagacactttttctcatgtacctcaagtccttaccaagtataagaagcagaacagtatctgtatcttcgaagctctcagtgtactt

SEQ ID NO: 148354 - DNA, 217 bp, Homo sapiens
aaaaaaaagaatggctcatggccctcctccatttggaatggcagaagctggagtgctatctccaaactcaagacagtgggagattcttgtagagcagattttctgagtaagacaatggaagattcttgtagagcagatttcctgagtagcaggaagaaaatcggttcaagagccagaaggagagaaaccaggcaatgaagtgggtacacttggtgat

SEQ ID NO: 148355 - DNA, 601 bp, Homo sapiens
aaattggttgcctggcagtacctattttatttgtatacagattagctgttcaatcattaacattataaaacatgacaaatgaaccaaaagatataataatactgagggtaaaaaaaacgatgtcaaacttcctgaatttaaaatgtctccttgagcaagaatctgcctcatatacatatcatagaatcaaaaacgtctgtcatcctaaagataagtaaatgtattgaaagtaatttaaactctgtaaaaggaaatacaaaaacttagtaatttctgaagtaggactcctatagaaaggcataaggaggaactataataatgcaaaaaatgatataatcaaattatagttatatactttctagttactctgaccacagatctatcctaacagagatagataacaaaaataatgcaaaatcacatcatccaacttttcctctaagagccaagagaggcaggtaataacagaaaagaaactggacacagtaaatgtggctagcagtggataaccagtctagtctagagctgagacctttagtttagccatatattgcaatggattatacaacaaaaatatattctaattactactggaaagaga

SEQ ID NO: 148356 - DNA, 354 bp, Homo sapiens
agactgtatgtctgtgtgtgtgtgtgtgtgtatgtgagctgtgtgtgtctgagtgtgagtgtgaacgtgtgtggggtgggtgcaagagtgtgtgtgtgcgtgtgagagtgtgtgtgtgcgcgtgtgagagtgtgtgtgagagtgtgtgtgtgtgtgtgtgttctgaaggaccttcactaagtccagaaccatcagcctctccattacccagggtgctgcagggaaattcatctctgctgcttgcagggaaggaacaggagagagttccaactcatttcaaaacaaatctgtaggaattgagaagccacttacaggaaagaaacaggcccaggccattcaagcctccctgactcc

SEQ ID NO: 148357 - DNA, 352 bp, Homo sapiens
tgagattcaaacccacgtctttcccattctactttttgtgcctttctgttttaatttgcttcttggtattcctgtgtattattaatagtctgaagcttggaaatagatgcaatagtcattagagtgaagaaaatacagtgccgtgctctctgaaggataacaaggacatttttgttgtaattactattttgatttttcttttaagaatgttgccgaggaaggaaaacagagggaaaaaccagcaaagctcactgtgtctaacttttgccacatgcatggacctaatttcttacttgccaagcactagagcctttatttttgagactctgtgagggtggctgagttctgtgtg

SEQ ID NO: 148358 - DNA, 406 bp, Homo sapiens
ttcaccactagtggaggcggtggggaggataggccataaagaaacacacagcaaatgttcagtatagaaggcagaaagaaacacacagcaggccccggggaggaagaatgggtgccggtgagggtttcctgtgttagacaaggctttctgaaaggtgacctttgtgcagagtcctgagtgatggggaaatgagggaaacagcatcccagccaaggcaacagcatgtgcaaaggccctgagggaggcaatgtgtgtcatgccacaagaaaagcaaggaggtcagaggggctggtgtggaatgaggccagaggggctggtgtggaatgagcaccagctcatgcagggacagatgagaatggagaggaggtgagagccagatcccacagggcagtaggtgggagcgagg

SEQ ID NO: 148359 - DNA, 357 bp, Homo sapiens
  misc_feature (33)..(33): n is a, c, g, or t
gtgactctacaggattacagttaagcgtcaggnatctcagggatcccaagcctcctgggacattgacctctcatataatcttgccaggtgaaaccagcaaagtccttcctgatgtctaacctcggcccctcctgggtgtgatctcctctccacccagcagcactatcacagtcctaccgttccatcatctgcgtggggtggaagtgaggccagtgaatggcccagaaatccagcccattgaaacctgcatgctgaaaaggaatgacttcatcctgggacaggccaggtggcaggcaaaacagtcaagtagatcagggttgtttgtagtgccacctgcccctgcactttccactggct

SEQ ID NO: 148360 - DNA, 668 bp, Homo sapiens
ggtagaagaagagggccaatgatacggagggatgttaaccaattctctacacttaataaatttaaaattaatattctgacttttaaaggcaaccctttggtcctccaaaagattaaccataattcataatgctagatgagcatcttggagcaagtacttctctttcactctcataacattcaacatactttggccttgcaaaaaacaaagttcaattaactggatggggtggcatgtacttgtagtcctagctcctcagaagggtgaggtaggaggatcacttgagctcaagttcagggttgcaaagtgatggcactgctgcactccagcatgggtgacagagtaaaactgttgaaaaggaaaataataaataaaggttgactaagaaattatctatgctttgggcctgaagcgatggctcaccctgtaatcccagcactttgggaggccaaggtgggtggattacttgaggtcaggaatttgacaccagcctggccaacatggtgaagccccatctctactaaaaatacaaaaattagtcagttgtggtggcaggcgcctgtaaccccagctactcaggaggctgaggctggagaattgcttgagcctgggaggcggagatcctaccactgcactctagcctgggcaacagagcaagactctgtctc

SEQ ID NO: 148361 - DNA, 791 bp, Homo sapiens
aagatgtgcctgcttcacctactggcgtgaatgtaaactttctgagaccttcccagccatgtggaactgtagttgggagccagggaaggagtgacactatccctagatgtagtgatatgttttacaggtccacagctggaaggagctttccttgattctcaaatgagactttggactttggacttttgagtcggtgctgaaacaagccacgctcttcatgcctgtgtgtttcccgcacccctgggaaggcgaagggaaggagctacattgtcaagtgtggtccagcaagtaagcaggtcctgagcaccaaacatatcacaggcactcactgcttgggcccaccagtcaacaggagcctgctagatacagccatgtgccactccaacctccctgagggcatggcctatgcactatttgattttcagcatatcatcacgaactccacgggcgtcaagaagcaatgggtgtggatgtagaagcagcccggattgcaactgtggtggtgtattcttgaactatattgttctattggtggtttctagctttcttgcctttctgaccatgatacgagtagctcccttgatgggttagttctgaaggttcagagagtctctcctcaggcctacacaagctcactactgctcactttatgtgatgtgggcctacacaagctcactgctgctgtctttctaacatgtctatatgttcttcattaactctattagatcactttctgctgaaagagatcagtgtgctttctgtttcctgaactcaaccttgggaaaaataag

SEQ ID NO: 148362 - DNA, 270 bp, Homo sapiens
gaaaaccactaacaacaactacagaagccctgctccttctgtgggctaaaatggcactgctggctgtgtgttcagagcagctaagaaccaggaggaacagagcccttgcctctgttcctagtccccgggccctggccttgccggagtcaccggaggcaaccaagagcccctcgttcagaaagcagccatgaggtagcctggccaccctttcaccttttacaccagggagcccagaggtttccagggcttgctgaagggaatccaataaga

SEQ ID NO: 148363 - DNA, 465 bp, Homo sapiens
caagtttgattctcaaaaaaagaaaaaaaaaaaagagtttctgattttggagcatttcagatgtcagatatttggattggggatgctcaaagtatatagttttggagtccttttggccccactgaatgactcctgtaaactcagatgctgtcttaccaacctgttttgcactctcctgatttttagtaagctttttaactgtagaaatcacataaaaagcttaaagattttcatgaagaaaatagaatttgccttcattattttggtttttttccccatctttttatttcaagcttatagaaaagtcaaaagaagttacagtgatctcccgttatacctttcatctagactcactattaatgtctggccatgtttggttttctctatacacgagtgtatataggtatgcatctgtatacgtgtacatgtatgtatgtgtgttgtgtgtgtctttttttttcctga

SEQ ID NO: 148364 - DNA, 333 bp, Homo sapiens
gtttaatccttggttctgctacttgctttggaaatgtcactccctaatcactgcttactttatatgtaaaatgggatggtaatgccagcctttcagggctattgagaagattccatgagacaatgtttataaagcacttacaacagcatctagcacccaacagacctaataaatgggagttatgatgattgttctctcaaagatccaagggacacacacaaagaggtttgctattttctcccccagaacacaccccaaaatgctgaaccaggagccaactcatatcaccactttatcacgctcctgtatgaccctgggcaaatcagatgccca

SEQ ID NO: 148365 - DNA, 266 bp, Homo sapiens
agtaaacagattggcagaggctgcttcaaacacgttatctgtctaactcattacatattaatacttccaaagtaaatctctccattctgtaactttatttaaatatttttattaatatacagtaatacttttccagatggccttatcagaagttttagtgagaataagcagctgaaaacacaacagctgctctgctggcagcctgagagccctgcgctgtgatactgccaggccccccatggagtcagccaggcctgggggccagg

SEQ ID NO: 148366 - DNA, 288 bp, Homo sapiens
aaccactaacctctgtgccccactgtattatttcctagagaatactatatttaccatttcatctataaataggactatatgtatctaaaacagtgattctcaactgaggacaattttgccccccaggggacatctgtgaatgttactactcagggcaggatgtggaatgctactggtatctagtgggtagaggccagggatactgctaaacatcctacaatacccagcctcagaagctgaggaccatcgttgagctgaggaccatcgttgagctgaggaccatcgttg

SEQ ID NO: 148367 - DNA, 128 bp, Homo sapiens
caggcatctgcatggtcatggtctggcattatcttgaccttaggcgacttggaaattccatatttggccttcactaaacgaggcatagaagagcaatcatggacgatctggaaatggagggcttagag

SEQ ID NO: 148368 - DNA, 266 bp, Homo sapiens
tctagacagaaacacaaacccttgtccttgtggggctgacattctagtgagaggagctagtccctgcatgagaggaaatgcgtgctaagtcagatgaggggtcagggcagaattaagcagggaagggaatgtggtagtggaggaagatcacactttcagaaagggtggccagggaagaccttgctgagaaggggacattttagtgaagaactgaaggaggggttgggtgaggtcgctcacacctgtaatcccagcactttgggagg

SEQ ID NO: 148369 - DNA, 446 bp, Homo sapiens
atgatgttgcttttagacaggcagagtagcagatgcaaaggctggactgctccctgaaagcatcaatgagggaaggtgaacagaaaacaaataggacctttccagtggataggatgttatcgtgcagaagcagccaagtctagccagtgggctgcttctgcggtcagagggctcactgaacaagctgcccgctcctctgacagacttgtttgtccagtcctgcctcccagccctgtaccgcagcccctttagtactagagccccacagggggcctgcagctgtgggtcaggaggcctgtgttccagctccagccctgttactagctcaactcccacaggggccttgggctagtcaccggccattctgaaacataatttcctaagctgtaagatgaggggctgtagaagagggatctcttctagctctcggcctctgggtacaggtg

SEQ ID NO: 148370 - DNA, 499 bp, Homo sapiens
acagaaataacaactaagtgtcatctgctaactttaactgagggcttcctgaagtgttgtgctgagaatgattctaaggcatacacagggcttagccagcaaaagatgtgataaattagtgatgtttactatagactctggctacaaatttactatcctggtcaggaggataaagtgtctgttgaagaagatgaaagggaaggaactcaaaggatctgttccagaggaggaaatgacctgcagaaagatgatgaggtacaaggtataatatcagtgctgtctgtttaatatctgtctatggttatttgtcaaccctgattacctcatataccattgactgctgagccacaatagccttttaaaaagcttaataagtaaatggtacgtatctagactatagtcctataatttatctcttagccagaaacacttttgttgttgtttttcgagacgaagtctcactctatcgcccaggctggagtgcagtggtgcgatcttg

SEQ ID NO: 148371 - DNA, 256 bp, Homo sapiens
acgtgagaagaaaccacccaggggatatctatggtgaaagtaggccctgccttgagatggaaatgagttggctggagacaccatgggctgagttttcacttgtacctcactggtcagacaggacaagagagccagggtcagggtgggtgcttggtcccccaccagtcacagaagcctcaggctggaaggctctttagacaagagtcaagcgtccgggttttgtcccggctccagtgctggccactatagccatcta

SEQ ID NO: 148372 - DNA, 290 bp, Homo sapiens
ctcacatcacctcattctgatgaagtctcatctactcagatatatcgcctcactctgatggagacagaacccatgttcactggaagaagtcgtctcatctactcagacacccagatggtgctctgccttctggctccttcatcctccgagctctaaaaagcccagatccaacaatccatgcaggacaaagcaggaccctccttctgaccctcgccgcgctagaaacaacggcccctcagtgtccagtcaggactctccttctgaccctcgctgtgctagaatcaatggcc

SEQ ID NO: 148373 - DNA, 322 bp, Homo sapiens
gatttaagtaccatttgtagaaaatacagaaggtagaggaacatgtgaaatgataccaaggacatacagtcatcagaattttatagactattagaaattttatgggaccaatgaccacctttttcaacaattaaattgaaaggtaggggcaaaaaagacaagggagaaaacgtatatattaagagagacataagagacaggaaagctgggcacagtggctcacacctgcagtcctagcactttgggaggctgaggcaggagcatcacttgagcccaggaattcaagaccagccagggcaacataggaagaccctgtctctcc

SEQ ID NO: 148374 - DNA, 129 bp, Homo sapiens
aaatgtttatattttaaaaacacctaactgaagtattctaatggagaaaaaatggcatgacaaagaaatatggaaatggcttacagttcttggctggctgtacgactggacatggaatttgagcacgaa

SEQ ID NO: 148375 - DNA, 722 bp, Homo sapiens
agaaaaagtctccatcttggctgaggcctcgaagccccttcatctatttagcatccaagctccccaacccttggtggccacctcttctctaaaatctttgctggtttttagccttctcacctggggggaaaggctttctcctcttagtttgctcatctgtggtatggggatacactagtacccaccccagagactgtggcgaggactcagccaggtcagtgcgcagagagcagagtgttgggaggagagagaggactgtggtgggaaggcagggacacctgtgctctggtggttacaggttataattctctccacatgagaagatcgcaaaggtcacaccttctagggtgaaaatgaactagggcctaagcttgagaggattcacaaaaatgaagtttggcctatggctccagtttaagcagctgcggcctcaagctcctgtgggccaggagggagccgttgctgcacttgtggtcagggcttcctgggccgtagggacactggccaggtgctcactcatagctcccggcagaggccctgtcaggccctggtggtctgaccagactgccagatccacctccccactaaaccagcatctctgatctgtcttcttccctccagggtcctggctttcaggctctgggagggtgtttgttttgcttgtattttttttttttctgagacaagagtctcgctcggtcatccaggctggggtgcggtgg

SEQ ID NO: 148376 - DNA, 245 bp, Homo sapiens
tccgttaggtatccaagtctgggcccctcagactcgctctattttggccttaatttgtcagctggattttgttagtgactatgcaagacagaagcaggaacacatagtttacctcaactttatgctggacatgaacttcagtgtttcaaagtgatctttggttctgataatatggcagagcaaacttgtacaaaggatgaataaaaaatagaaatagaatttttaaaaatattccggcataaaag

SEQ ID NO: 148377 - DNA, 375 bp, Homo sapiens
gagacagggtcttgctctgttacccaggctagagtgcagtggcatgatcatggctcaatgcaccctccacctcccgggctgaagagactctcccacttcagcttcctgagtagccgggactacagatggataacatgctgatgttgtaacaaggctggagcgtgacacatctcacacatgcacgtgaacacccaattaccacgcctatgaactacaaaagcatctaagcagattttaaattagccagttgtttccctaggatcctccaaaggtgatcaatacagtttgtttttttcttggtggagggatctcatgatgaactaatgaatcttaacatgaatagtaagcaaataaataaaatgggatggtttaagc

SEQ ID NO: 148378 - DNA, 189 bp, Homo sapiens
caatccttgactaacaaaattactttgttactgccagcaggtgtgcttaaaacaataaaacaaaattcatttggaaaaccagacttacagatattaaatagaaaataaaacatcataaacacttaattgccgagatttcagtgatggtacaagagaacctaaagatcacagtgtaggtttagggctcaa

SEQ ID NO: 148379 - DNA, 532 bp, Homo sapiens
acatctgcaatatgggtaaagaaagatggctcaacctcactaagttaactttcacccaattctgttttccacagagtacgcaagctctcaactgtgccagatatcctcaagtctaaagaaataaaactctgaagttccttccagggggaaaagagggcacttgccagctgtgcagagtagaaaagagagtttggaatctaatagtttcttgagcagattttcaaccaattatcatgcttctagcctacaatttaccccgtatttctgaaagcacttgttctgtcaaatcctaaggttaaacagtataaactggttgatttgtagcttttcccattgctgcctaatgataagctttctgtgctgtgtatcagttgggttcatccagagaagcgactactatgaatgcgtatgagtgactatataaagatttgttacaaagacttggacttgtacaactgtggaaactggttaggcagtctctataaggcgttttcttcatgtctggtctgattctagagctgaggtccacagg

SEQ ID NO: 148380 - DNA, 191 bp, Homo sapiens
cattggtttataaagcctaatatgccaaaatgattcttttttcctgactcatctatataggatctactcctatctagaattctaacatttacataatcacttgcttcatatcataccaccacccctaacatgtatgcctctatcacctccccttctctctaattctcattcatagatctatccccaagtca

SEQ ID NO: 148381 - DNA, 197 bp, Homo sapiens
gcctctccctctctctcgctccctttctgttacactctctctctctctctatttctgactgttctctcttttctctctgtctctgtttctttctcctcccattctctccaaccaacagaggctccaactgctgacttttcactgtctttgaactctaggttacaatgtgttggactgggtgggggggaagcaaggga

SEQ ID NO: 148382 - DNA, 402 bp, Homo sapiens
ctctggtgtgctcaggtccagtactgtgcctaatatatggtaggtgtctcgactagtatgtttgtcaaagtcgataatagttaaaatctgaaggtttattctcctttaagttgtacagtttaagcctcaccttattttttgctgctaagagaaggtatcacctacaatgacccttcacattctagacaattaacaaagtctatgtggaaaaataactattccaggaagaatgtgttcagacctggtttgaaatcacagcctgttgctgtggggcatttattacccaccatttagctagattactgaatagatggagttaaccaaaatgctgacaagacacacaccacaaacacacacacacacacacaaacacacacacacaccccaaaaacgaaacctcag

SEQ ID NO: 148383 - DNA, 150 bp, Homo sapiens
ttgaagcattttcagcactaaaacagaatttgttaacagcaccttttagatatgtttaggaagttggattttttaaaaatagcacatcattagaagtattcaataaatagagaagtattcaataaatagaaaactatttgagggagattt

SEQ ID NO: 148384 - DNA, 377 bp, Homo sapiens
gtctcgtcctccccagctcaagcgatcctcctgcctcagcctcctgagtagctgggacacaggcacgtgccaccatgcccaactttgcattttttgtagagacagggtctcattatattgcccaggctagtctcgaactattaggatcaagtgattagtccatctcggcctaccaaagtgctgattacaggcgtgagccaccgcacctagccagaccatcttgagatcaacatcttgagaccacccttaactcctcactttttcttataccccatatctaacctatcaaactctggtctctgtcaccatctcctcttgtctggaatattctaagtcttctaaagtggtctcaccgtactctgcactttactttcaac

SEQ ID NO: 148385 - DNA, 1098 bp, Homo sapiens
gaaatcagggaaacaataaatcaacaaaacgataaatttaacaggttgaaatcactaaaagaaccaaacaaattttggggctaaagaatacaatgaatgaaatgaaaaatgcaaaaaggagaatggcagaactaatcaagcaggagaaaaaaatatgtgtgaactctatttcaaaataatatggtcaaaggagaaaaaataatgaaaaggaatgaagaaagactacaggatttatgagacatcatcaaaagagctaacaaatgtattatagaaataaggatgagggtttttcaaaacctgatttgaaaaaaataatagctgaaagcctcccaaatctggggaaagatataaatacacactattatgaaaaggtcagaggtctccaataagattcaatctaaattatatgaagacatataatcaaacttcaagacaggattctgaaaacagcaagagcaaagaagcacattacattaagaacaatatcaataagactatctgcagatttcccaggacagaccttacaggccaggaaagggtgggatgatatattcaatgtgctgaagaaaaaaactgccaaccaagaatatttcacctggcaaagctgtccttcagaaaccaaagacagagaaagattttctcagacaaacaaaagctgagggagttcattaccactagacctgcctgaaactaataaatgctaaagggaattattcaagctgaaaataaaggacactaaattagtaacatgaaaacatatgaagtataaaactcactggtaaaagcaagtacatagataaatacagaatactcagatattgtaatggtggtgtgtaaatcacatctctttagtaagaagattaaaagacaaaacttttataattataaccacaatactttctaagtaatatacaatataaagagatttaaattgtggcatcaaaaacataaaactacaaaaatggtagtgtttctatatgatcaagtttagttattagcttaaaatatagcctgtcattgctgttattttatgtaagtcccatggtaaccacaaagcaaaaacctatagtagatacacaaatgattaaaaaaaaaaaa

SEQ ID NO: 148386 - DNA, 262 bp, Homo sapiens
ccatctttccttctgtctgtctcctctgctgagctccatgtgctgctccttctcctccccattctcccgtttctctgtcctcagaacacttcctcatatccttccctggtccctggctctctgagtcccttttttttttttttttttttttttttgggggggggggagaaaaaaaatttttccttggggcccaagccggggggaaaggggggcattttggctttttggaaccccccccttctggggcccaaggtttcccccc

SEQ ID NO: 148387 - DNA, 164 bp, Homo sapiens
ctctgcttctgtaagaatcccgactttaggattttcaactgtcactactccaacttctatttctgaaggtttgaaatcaattgatagaacagtagacaggcatgtaattgcagtttccactgtctgttcaaatgtccaatcaaatttcttttgcactttttttt

SEQ ID NO: 148388 - DNA, 918 bp, Homo sapiens
tttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtattttaactaaaaggtccaggttagaatcttttaaacagaagtagaagaccttggtggatttaacggggggaggttaaatcgtaggaagagaaaataccatgtttttgcagaatagctgtcagttcaaaggaggggttcagaaaggccacggggagagtgaatgaaccaaaagaagggtgtgacaaaaaagattacggagatgc

SEQ ID NO: 148389 - DNA, 511 bp, Homo sapiens
tgaaaaagacttaatagctaggtttagtgaggatgtggagcaattggaactttcatacattgctggtgggaatgtcaaatggtacaaccactctagaaaacagtctagcagcttctgagctaaatatacatttaccacacagaccagccataccacttaggtatttacctatgataatttaaaagagattcacccagtgacctgtacacaagtgttcctaactgcctttttgttaacattatctgaacatttttatttttaaattttttttcagtttcattgaggtatacttgacaaataagaattgtacagtcaggtgctgcataacaacattttagtcaatggcagactgcatgtaaaacgctggtctcctaagattataacaccatatcttactataccttttcttttttttttttcactctgtcatccaggctggagtacagttgcagtgagccgagatcgcgccacttcactgcagcctgggcaaaagagcgaaaccctttgtctc

SEQ ID NO: 148390 - DNA, 382 bp, Homo sapiens
  misc_feature (47)..(47): n is a, c, g, or t
tgcatatgtatcaaatgcttttaagaaagaagaaagcaaaaaaaagncaaaaatttgttcaggttttacggcctcctgctaattccaatttatacattccaagaaaatcttccatttcatccaggtgaaacagtaacctactggaatgaagctggcctcccgtctccttgatttgaagcagcttctccacattggttattatgccatttttctaaatctaacgttttaaaatttgtgcctttcctttctcttttgcttgacttcccagaggtttttttaaccgtcttttcaaagaagtggttttgggttttatttatcaagtctacttttattatggctgttttaaaattaaatatatttatttcttgtttcccttaaaaaa

SEQ ID NO: 148391 - DNA, 229 bp, Homo sapiens
tggcctgtagtgatcgcctttaaaaacaagtctctttgcttctggtattgtatcctttctaaacttcacactgccatcagttatttttctacaacacagacttgttaatgacaccatccctttttatgagtttaacatgatctaaacctttcttaggatcttacacaggactcttcatgtactgatccttaaatgacatatccagccacatttcacatcccctacattg

SEQ ID NO: 148392 - DNA, 181 bp, Homo sapiens
gcttagaatttacattctcaaaagaaaaaacagttatagttacatgctctttcttaccttttgctggattaactgagacctgcaggtatcctacaatgatgctgatcttctagcccgttaattctcagacctctcagattcagtgccctcttcttataagtattttgaaatactctcttta

SEQ ID NO: 148393 - DNA, 360 bp, Homo sapiens
tctgtgcagcttgcaagtaaggtgtggtgccagctccaagtgttctagttcgctcttctcacccattacagcatttgaacatctttctttactgtacatgagtttggccgtgagtcctggctttttctagtcccacagaagccaggtctagagctcttaggagcaaagcagctgttttccctatcctagcaccccactctcttccagaggggtgcttattcttagcaggagtggcaaacactggcgtcaaacccttttgccccctgctttccctttgaggcagcttcctggtaaaagccttccctgtatttactcattcaggggtttctgtgagaatccaaggtgatttttttgctattc

SEQ ID NO: 148394 - DNA, 195 bp, Homo sapiens
tgcttcctggagaggacttaggaccttttaatggcagaaatgatgaatgtgttggcagcagttcatcagtgcccagtactcaagggtccccctgagaagccagtggttgcacggatctaggtagaatcaggcacagaataagtcaggtgatgtgcctttctagcactggcctcaggctgatttataagggaagtt

SEQ ID NO: 148395 - DNA, 505 bp, Homo sapiens
aaaaaaaattagctgggtgtgttggtgtgcgcctgtagtcccagctactctggaggctgaggcagaagaatcacttgaacctgggaggcagaggttgcagtgagctgagatcatgccactgcactccagcccgggtgacagagtccatctcaaaaaaaaaaaaaaaaaaagttttcattacagaattgtaaagtaaaaccacaatgcaattccacaccatacacactaagatagctgtattcaaaaagagagacaatgccaagtgttgacaaggatttggaaaaactgggtccctcatgaatttctggcgggaatgtaaaatggtacggccaatttgggaaacagtttggcagttctcttcaaagtcaaacataaccttgccataggatctagcaatttcattcctaggactctacccaaaagaaatgaaaacaagccgggtgtggtggatcatgcttgtaatcccagcactctggaaggccaaggcaagaggatcacttgaggc

SEQ ID NO: 148396 - DNA, 513 bp, Homo sapiens
taaatatgggagttctccattatacaaagacctcaagccaggatgaacataattcactttggctttgggagtagcccatagaggaaatgcctaacaccaggagtggtgttctggtcagtaaggccagccatccttgtgaccaaacagatattttgaagagaaacttgttttcaattcttgtattgctttctaagaggagaaatgtgtgagtcagagtgaaatccaaacaaaactctcatctaatttaggacactaatgaacacatttttgttttctttatccttgattagaaacattttaaagtaagaggatgtattttaaagacaaaggggttttctggcaattttgtaatgttacacaatctccttccctgtctactaagaaagaaaacagaattctgcagcaccttctttaggaaaaatagatgataattaactgttaaccattttcatttcatgtgagaagtgtgggtacagctgcagggaacttcctgagggtatgcaggtatttttc

SEQ ID NO: 148397 - DNA, 107 bp, Homo sapiens
ttcctctgaaagtactaactggagacagtgcaaaggttgctgcttcatacaaaggtgcattatgacatgggtctttccagagaaaatgcgctgccctttgagtcctg

SEQ ID NO: 148398 - DNA, 508 bp, Homo sapiens
ataaaaatctttgaggagggtaccactttaacccacgttttttatttgaggaaattgaactcagagaatttaggtctcttgggcggggccatgcctggtgagtagttgggctgggaatccaaggcagtgactactggtgtctttaaaactgggagatggagtcctgttcatgattaggggacgggaggacagctctgtgtggaatgaacacagacatagggcggctctctgcgctgtcatgtttttccttccaggtatgcctcatggccttgggttttgcttggaaaagaagagctgacaaccacttttttactgagtctttatgtgaggctaccagggatctggactctgaattggcagaacgttcctggactcgcctccccttctcttcaagctgcagtattcctgactgtgcaggcgaggttgaaaaagtaaaaaaaattacctatgcagtgcaaattgagatttaaaaaactactttatattctatcatgcatatctgaatgta

SEQ ID NO: 148399 - DNA, 315 bp, Homo sapiens
gctactcaggaggctgaagtgggatgatctcttgagttcgggaggttgaggctgcagtgagccatgatcatgccactgcactccagcctaggagacagaatgagaccttgtctcaaaaaaaaaaaaaaaaaaaagtgacggtcacttagccaagatcacagagatagttagtggaggagctggaatctgaacttcagcatgtttgattccaaagttcaaactctcttctactacaccacaggtacctggtggacgctgcaaaccctgttcactgattgattgacagaagtcaggctggtactcgtgagctgggga

SEQ ID NO: 148400 - DNA, 211 bp, Homo sapiens
tataaaggtgaatctgagtgtatctgagtatatcataaagctaactagtcagacttggacagcccttgaatgatgtccaaacatttgtgaacagtctgagtaaaccactcaggttattcttacacaaccaaggtaactttactgcctgccatgggcaagtaagtgctctctagattatagttgtaaacaattctcaagtgattaatgacac

SEQ ID NO: 148401 - DNA, 390 bp, Homo sapiens
gataaacaggatttaactttttctgttatagcaaaccataatttgttaaaaataattatttgactgggcacagtggcttaagcctgtaatcccagcactttgggaggttgagaagggtggatcacctgaggtcaggagtttgagatcaacctgaccgacatggtgaaaccccatctctacttaaaaaatacaaaaaaattagctgggcttggtggcgggcacctgtaatcccagctactcgggaggctgaggcaggagaatcgcttgagcctgggagatggaggttgcagtgagtcaagatcatgccattgcactccagcctgggcaacaagagtgaatctccatctcaaaaatagtaataataataattcttcagtgatggggtgaggg

SEQ ID NO: 148402 - DNA, 378 bp, Homo sapiens
ttcttgtttcaggtctcatgccataaacaaatgtcctgttcgtggcccatttagtgccatatttttctcatttttgtgctttttgctggtgatttcactgttcaaaatggcccacaaatatagtgctaaagtgttgtctggtgttctaagtgcaagaaagctcttttccttagggagaaaatacctatgttagataatcttcagtcagtcatgagttatacaggcatgaattatagtgctggtagccaggagttgagtgtcagtgcatcaacaaaatatattaaagtgactttaaacaatcacacgcacacaaaacaacattatatattgatctgttaatgcaaatgtggtgagcacaggcttatagcaatctaacct

SEQ ID NO: 148403 - DNA, 166 bp, Homo sapiens
tcacctcagcttctcaagaggaagggactccaggagtgcgccactatgcccaactaatttttaaaatttttttgtagagactaggtctcactatgttgccaaggctgctcacaaactcctggactcaagccatcctcctgagaagctgaggaccatcgttggggta

SEQ ID NO: 148404 - DNA, 304 bp, Homo sapiens
cattctgtgtccacactttccctggcggctggaggttggccagcactggaagcaggcccaagacacaccttctggacgtcggcctgcctcatattccagctctggccttgccatccctgcccaggctctggttctagcttctgtgcttccacgtcggctctcccgcacactgccagagtgacctccataaaataacttgcttttcgcctacaaagtgtagttcaaactcctcacctggcaatgaggcctttccttccaaggcctttcagaatttgcatctttaccctcgcctctccttgccaga

SEQ ID NO: 148405 - DNA, 120 bp, Homo sapiens
aaccccttttccttgattaatttcttgctagcatcctatctttctccttccctttcctatttcctcgtctctaacatggcagagataatagagttattgagggaattaaatgaaataata

SEQ ID NO: 148406 - DNA, 205 bp, Homo sapiens
gacagaacactgctgcccgcctcatcaccccagcccaagaggacagaacactgctgcccgcctcatcaccccagcccaagaggacagaacactgctgcccgcctcatcaccccagcccaaggggacagaacactgctgcccgcctcttctcctcccagctacctaaaacttccccggcaaccacccacccttccccgaaggtcaa

SEQ ID NO: 148407 - DNA, 379 bp, Homo sapiens
ggctgcgccgccaggaatgacggccacggcatccgatcacgaacacctattgacacgaaggggatggatgtttcctcgaaaggtttatctttgctccttttcacttttctcactgaaacattcatatatttgtgccatctggttaataatgaatttgtttttttctataaatgtgttgccgccatgtcctgagcgggtgtgtgtctgtgaaattccaagcaacaagaccgctgagccagcatgcctaatatctggcactgtttctcagctgagcgagagcaaactgttaagaaagatgcaacatctaattaggacttgcttcaaataccagaacctccagttaagtggcacaggcctgtcgcaggatgttttcgcagga

SEQ ID NO: 148408 - DNA, 538 bp, Homo sapiens
cacctatggtcccagctacttagaaggctgaagtgagaggactgcttgagcctggaaggtcgaggctgcagtaagctatgattgtgtaccattgcattccagcctgggtgacagactgtctcaaaaacaaaacaaaaaacagcaataattacagataaaaaaagaaatttctaaatttgatttatctggagaggaatatgatgtaatattttatcttatagtacaaagttctctaagatgtattactctataatgcccagtttggagaacattctacttggtaaggagttagaggcaaaaacaagagacttttaccccctatttaagtagtctgtatgaagaacacaaaagacagcataaagcatcgtttctgtcatacttagcagttttgaaaggcttagctcatttggaactttatccttcctgccttgattattttttataccactaatctgtattatttgttgcaaccaatgatcttttcatgtcttgtatgtcttcctaaaatctgaacatagtttcttagcaaccacacaga

SEQ ID NO: 148409 - DNA, 481 bp, Homo sapiens
ctttcttttattcttccatgtatcatttactcagcaaatggtattgggtgctactatctgccaggaactgtgccaggagccaggaatagcatggagagcaaagccaggcaccattcctgaagcctggagtggggagacagatttaccaaacaatattagacatgagggtgcaattctaaatgcggccacgagacaaatgctctggaagaaaggaatgcagttccttgagatcatatcactgaagagcctgtcctagagttggatgtgtggttcagggaaggcttccctgagaaaaggatgcttgtgttggcacctgaagctgagttgtaaactaggcgaagataggggtgaggagaattgcagagaggaggaacaacacgttcaaggccctatggcaggagatggcatggcttatttgaggaaccataagaagccaatgcggtgccacatggagcgtcaggagcaaggaggagggagtgaa

SEQ ID NO: 148410 - DNA, 1548 bp, Homo sapiens
ctttcttttattcttccatgtatcatttactcagcaaatggtattgggtgctactatctgccaggaactgtgccaggagccaggaatagcatggagagcaaagccaggcaccattcctgaagcctggagtggggagacagatttaccaaacaatattagacatgagggtgcaattctaaatgcggccacgagacaaatgctctggaagaaaggaatgcagttccttgagatcatatcactgaagagcctgtcctagagttggatgtgtggttcagggaaggcttccctgagaaaaggatgcttgtgttggcacctgaagctgagttgtaaactaggcgaagataggggtgaggagaattgcaaaaaaaaaaaaagaaacaaaaaaaaacaaaaacgtgttgtggggcggcctctgggcccctagaaaagagctttctcataaaacacatatcggttgtggggggcccgggcaccacgggggaagcgaggacaagtgtgggccatatgacgggtttcaccgaggaggaaacatcggggagcccaacaacaacagcggcacgggagaacgtatgacaaacaaaatatacaaacacgcgcccgcgagggaaaaaacaacagaggagactaaggagaagaaaaaaccacaaaggggagatatctaaagagcgacacaaacacacgggggacaatcagacagcaacagaggagaagaaaccaagaagcagaaccgaagcaaattaaaaagaggagaagacggaacacgagagctggggaggaaaccagagagaaaaaaagaaaagaagaagcgaaagagaggacaggaggagaaagggagagcaaggacaggagagagagagaaagaagacaaaggaacaaagacaaggaaaaaagcagaaagaaaaagaagaagcaacacagaaaaaacgagagaggagaagaacagaggaaaacaaaggagagagaagacaaaaaagagagaacacgagaggaaaaaggaggaaaaaaagagacgagaaaaagaaaagagaaaaaaagagagaagaagaaagaagagcggaagagagagatgacaagaagggaaagaagagaaaaaaagaggaggagaagagagagagaaagaggaagagagagagagaagagacaagaaaaaaacagaagagaggcgaacgagaagaggggagtgagaacgagaaggagagaagagagagaagaaagaagagaagagacgagaagagagagaggaggcagagaagggagaagaaaggagacagagagagaacagagggaaaaaaaggagagaggagaagcgaagagagaaaaaagagagggaaaagagagaaaagaaagagaggaaacgaaggcaggagacagaagagaaagagagaggagaagaggaggaagaagagaagagaggggaggggagagagagaggagggcaaggaggagaagaaaaagaaagaagaaagagcgaaaaggaaggagggaagaagaaagaggagaagaggagagagggagagagaaggaagaggataaaagaagaagagagga

SEQ ID NO: 148411 - DNA, 310 bp, Homo sapiens
  misc_feature (1)..(1): n is a, c, g, or t
  misc_feature (22)..(22): n is a, c, g, or t
nccatcgagctcggacccctanttttagaagtttcaatagcataggtaaaccacagctaaaatgaccactggaggaaccttaaaaggagaaagaggcccccaaagggtgacctttataagcctctcaatttgccctggagtgggcgagaattttgggataagtcatttgttggatctataaagctctggtcttcacagcaggagcttgatgaaactctcatcctcctgcccttgttgtctcttccagctcctggctttgccagacactgtaaagtcccaggccgtgagagctcacttgtcactgctattg

SEQ ID NO: 148412 - DNA, 408 bp, Homo sapiens
gggaagtcctctttagtgccaaactgagacagctctgtgcccctatctcaggcagatggtggagagacctaccttcaggcagaggtaataccaagtcactacatctaaaagaaaacaggggacacggtaaaattcttttggttggtctcttgtcagttggcactccataagttttacctcactaaattaaaaaagaataaaaggacagtcttgtccatacaggacaggctgccttaattttggcaagtcccaaaatagtgaaccagcgtaacaggcagtgttctccagggtcaggacttgaagagcctattagaaaggaagaaggtggtgaaacaagcaggtgcttgaactagactgttgaaagctacaaacccaggagaaatggactccagctacgatggaccacat

SEQ ID NO: 148413 - DNA, 361 bp, Homo sapiens
  misc_feature (23)..(23): n is a, c, g, or t
  misc_feature (195)..(195): n is a, c, g, or t
  misc_feature (200)..(200): n is a, c, g, or t
  misc_feature (207)..(207): n is a, c, g, or t
tagaggatcccccatgtggggcntcactgcaaaaaaatattcaaataacacagacatatgcagagttaaaagtgaaagttccctccgcatctctactcccacccagcaaggaacctacaaaaatactaagatgagctgggtctggtggctcacacctgtaatcctagcactttgggaggccaggctggtcttganctccnggcgtcnagtgatccacccgcctaggcctcccaaagggctaggattacaggtgtgagccaccgcgccctgccagaatatggaatcttaagactccctagtatgtctcttctaaggtcgatcttgactctccttagacctatgtgcgctctgggaattctac

SEQ ID NO: 148414 - DNA, 506 bp, Homo sapiens
ctaagaagacagcagatgtattccatgggtttccagagaaacatgaatgtacacatgaatagaagctgcaggaaggcagagtctagttagcatgtggaagaatatttggccttcagagacatccaacaatggagtgggcagcctaaggacatattaaccctcctcagcttgaacaggattttagcagaagctgcagcgtcatacactaaaacaaaagaaataaccttctccccatactttcttttaactccatctaggtaacccccatctcagtaaataatagcaatatccacatacttgctgaagacaaatattttaatcttctgtttcctttgtcagccatatctgatatatcagcaaacaacatcgcaaatccatccacttttccccatccccacggccaccatcctggcccaagtcagaatcatgtctcctgttgaccactgaaagagcctcctcaatcatccacactctttccagtaatgcactctctgcatggccgcctg

SEQ ID NO: 148415 - DNA, 357 bp, Homo sapiens
tagctgggaccataggcgtgcatcaccatgcccggctgatttttgtatttttagtagagacggggtttcaccatgttggtcaggctagtcttgaacttctgacctcaggtgatctgcccgcctcagcctcccacagtgctgggattacaggcatgagccatcaagcctgagccggctgaccgagtgcttttttttttttttaaagcaaatattgcctttgggcttctctctaatttcattttaaagtttcagttgcattttcaaatggagattttattttaaactggagtgcagtgatttttacagtctttttgaaagcaacaaatgagatttttagaagacctcttgcttgaagac

SEQ ID NO: 148416 - DNA, 838 bp, Homo sapiens
aaaaaggacccaagggttgaattttgaggaacatcaatggtgatgaagatatatctataaaagaaaaaaacactgttttaaaagttttcttcctccctcctggacacatgtagggctgcattttctgtactgcttgtggttggatggcgaatgaaggaaagagtcagctgatcttaaatgtatttactcacaatcctccttctagaatctgccaccttaatgcctgtcagcatctttttctgcagacgacccatcccagcagtactccttctcaagaagttgtagaggcatgattgtgttcttccaaccctacagcttagtgagagaagttgcatcaatttggtgctaaattacagtggaaatgataactaccataagagaatgaaataatcccataaagtgttggtgggaggagtaatctcagagttgcaatacctttgtgtgtggtagaatagtgacaattgcatctttttataaaggctattgaataaatccactaatcataaaaaaaaaaaaaaaaaaaaaaaaaaaaaaaaaaaagaaaaaaaaaaaaaaaaaaaagaaaaaagaaaaaaaaaagaggggggggaggcgaaaaatatttgccgggagggggacaaaagattataaagtgacatttttgtaaaaaggggtccatgaaagaaagactatataaggaagcggcagaggagataaaaaggtgtcggggacaaacgtcgtcggtattattaagagaccgctgctgggggggatcattgggacacgctgcaaaaatatacacagggaataaaaatagggttgggtaccaactttttcataattttcggattaaatatgc

SEQ ID NO: 148417 - DNA, 780 bp, Homo sapiens
agaaactctgaacagaccaatcagaagcagcaagattgaaaatggtaatttaaaaattgccaacaacaaaaaagtccaggaccagatggattcacacctgaattctatcagacattcaaagaattggtacccatcctattaacactatttcacaggatagagaaagagaaatcttccctaaatcatttgatgaaaccaaaatcaccatgatatggtttggctctgtgtccccacccaaatctcatcttttagctcccataattcccacatgttgtgagaaggacccagtaggagatgattgaatcatgagggcgggtcttttccatgctgttctcatgacagtgagtgagtgtcacaagatctgatggttttaaaaacaggactttctctacacaagctctttctttttgcctgctgccatccacgtaggatgtgacttgctcttccttgactccaccatgactttgaggcctccccaaatatgtggaactgtaagtcaaataaacctctttcttttgtaaattgcccagtctcaggtatgtctttatcagcagtgtgaaaatggactaatacacaccctaatactgaaacagactaatagacaccctaataccaaaagcaaggaaggacataatgagaaaagaaagctacagaccaacatccctgatgaacagagatgcagtaatcctcaaaaaaatactagctagctgaatctaacaacatatcaaaaagataatccatcatgatcaagtgggtttcataccagggatgcagggatgg

SEQ ID NO: 148418 - DNA, 166 bp, Homo sapiens
agagaaagaggtgtggatatacagtataatcctactttaaagcctttggtgagtccttccttccgtccctccctttcttatttccccttccttccttccttccttccttcccttttcttcttttcttcctccctccctcctttcccttccttctttctctttcttt

SEQ ID NO: 148419 - DNA, 283 bp, Homo sapiens
aatccgggaggcggaggttgcagcgagccgagattgcgccattgcactccagcctgggcaacaagagtgaaattccgtctcaaaaaaaaaaagttccccgtcccttttttcccttaagctgtttatttgtcctgagaaatggagtcatttgtcctgtgggatttttcacattctgcatctgactgatcatgccctggtggtagtttttgaggggctggcaagggtcccctctgtgtgtccctgtgcattgccttggggggctctgactctgggtccacatgtc

SEQ ID NO: 148420 - DNA, 902 bp, Homo sapiens
agtcatctttgaaaatgaaaatcacatcatgttatttcctgcttaaaatctatcagtggcctcccactgctctgagaatgacttacaaggcccctagggcctagttcctacccctctgacctcctctcaccctcacttgacatactgcagctttgcaggccttctttatgttctcaagtaaggtcagcaaactatgacctgccagtcaaatccaacccgccacctgtttttgtaaataaagctttactggaacacagacactcatgcctttgtgtctgcgtgttatctgtggcactacagtggcagagttaaggagagagacactctcactatgaggccctttaagaaatagatgcacaccactgttctaaaatcatgcccagctttttcccgtcacagggccgttgtacttgcactacccactgctctagtctttctctctccttttaccactacctaaaattatatgcttgcttattgcttgattgtcctgccgagcaaaatctggtctgcttgttctgtgctatgtgcaaggacctagcatggtgtctagcacgtggtaggtgctcagtaaacatttgttaaatgagtgaatgtactttaattacccaggggtctgcacctcttttagttaagacttcttttggggacagtcagccattagagaccttagtcacacacttgctccctgtccatggtgagtgaaggagggcagaagacatgagttgtgtacacagggatgtatggtgtacatgggtagagccgagagaaagtggttggcaggaagctcacccatgtccccagcagcttatatttagtatatgctgttgagctgaagagccactcaggcagcttgtggcaacaccttttgtgtttgtatagcatgttggacactggtgcag

SEQ ID NO: 148421 - DNA, 579 bp, Homo sapiens
  misc_feature (560)..(560): n is a, c, g, or t
ataagtcctaggacctgcctcactccaactctccgtgaagttccttgcccacaccgagatacaactggctcctccaggtgtgaaatgaccctgtgcacaatccccgtggcacagcctacttcgccctgcccgtcggggaaccaggtgatgtagcctgccccctggagagatagggtacagccttgtgtcttcctacaagcccctttctggcagctgtagcctgctcacctgccagtggtgtggcaatgcctctcccacaagtggcagagcccacctgcccagagccctatgccaggtagatggcagggttgaaacgttcagctcctcacccttgaagatgtgaaaggtgagcagaccaatcttcacagccactctcctccccaaaggtgtccagctcgcatagcacagcctccatgtccccttttcccttaggagggcatagtccccccacccccgcaagcggtccatccctcatcctcctcctcggcaatcctgccaagtggttggtacagcccccatacccttctctccctagtagggggtagttgctcccctcctanggagagtctccgtcgaact

SEQ ID NO: 148422 - DNA, 210 bp, Homo sapiens
aaatgggactatgttgctctagaaatcaacatcttttccacactgcattagtagcaacagagtctagaacaaaggaggccacagccccactgaactctcttctgcttgaggtcacatctgccacatcaggggtatttacctctttcaacacatatttattagggcacctgtctgggccaggcgttgtgctaaaacccccaaacgctgtca

SEQ ID NO: 148423 - DNA, 577 bp, Homo sapiens
gagatttgaacctaagtggtctggctccagagttcatgcttttaagaatgacaatacagaccaggggtggtggctcacgcctgtaatcctagcactttgggaagccaaggcaggttgatcacttgaggtcaggagcttgagacgagcctggccatcatggcgaaaccctgtctctactaaaaatacaaaaattagctgggtgtggtggtgtactcctacctcaggaggctgaggtaggagaatgtcttgaacctgggaggcagaggtttcagtgatcctagatcgtgccactgcactccagcctgggaggcagaggtttcagtgatcctagatcgtgccactgcactccagcctgtgcgacagagcaagactccatctcaaaaaaaaaaaaaaaaaaaaagaaaagaatgacaatacacctgggtgcggtggctcatccctgtaatcccagcacttgggaaggcgaaggtgggaggatcacttgagcccaatagttcgaggccagtctgggtaacattgtgagattctgtcttcaaaaaaaaaatttaaaaatattaataaaaaagaattataatac

SEQ ID NO: 148424 - DNA, 276 bp, Homo sapiens
gatgacgggggcagacctccagggtcaggcagatcacaggctgtgctgctggaccagcagggaggtgatggggaggactcaaggaagcctctggggtttctagtgcaagatgagattgcgcaggaaatcagaactcagcagagactcagagcagctcccggggcagggctggcaggaggggctccatcaaggcagctgccttgtggcgctggccggtgtttctgggcagtcacctggcctggtctagctgctcctggatctgtgtgcgctgtgggc

SEQ ID NO: 148425 - DNA, 843 bp, Homo sapiens
cactgccaaagactatggatctcatcattgcctgtgcccacaaggaccctctgttccctctgacctcaggcctcttcccatccaacaagcctctctgcacttctatgttcccctactggaacaaagtcagaactggatctgctgacgccacatataggtatggaatctgagattgctctattgggatcatcattctagacacttccctctgccatggcaggcttttgcttccatgccagattgacatgatgctatactgagtgaggacaactctgagagacccacagtcttcccaagctagacccagggaagcagtttgggggttccccaaatatatttggctgtttgcatggacccagggggatttaacctcaagggcaaaataagaactctcatctcagaatccctgccaccctctctgtgccctactcttcatgactggaagaagttttctcttcccttaggggtgggaatgccaagtcatatcctgcttctctcaataccgtgcctcagagtagaaccctttgctcagacccctcaggtctgctctggatatataaagggaatctttggaaacatacaaaaccctttctctctcaataaatcctggctttcaaggtgaattcctcttcatggacccaaagagtctaatttcaaatggaaagctcaggaatgatctcttgttctggaccagttctacccaggctctgatctctgtgtgtgaactgtttgttactgtctgcaacaataaagtataggaattgagaatatttggaaacttttatagaaatttggcagagcaattttatgttgttgaatttaattaaaatcttgtacctctta

SEQ ID NO: 148426 - DNA, 382 bp, Homo sapiens
tacttagcagcaagggtggtttcttagaaactgagtcttggcactggtctgttttgcatgaagatggtggtaaatgcagtcgtgtttctaggtagatggcacatggttacagattacagtttcccttttctgaaaggaaaagcctgttaaccattatgttgaaccaagccccttcatagtcaagaaaatatcacacagaactacttttaaaagtctccagcagatcatgaacaggtattcatttttattgtgttaaaagttttctatgtttgtataagtttagattaaaaactgtttacaaatgtatgtgcttgaattttgttatttttgagaatgtctcctagagaaggagagacggaagcttgataaagttttaaaacta

SEQ ID NO: 148427 - DNA, 1133 bp, Homo sapiens
tctgcatgtaaaaaccacaatcctgaaacttaccctatctcctttttctgttttattttccccctcaggatgtactatcttctaattcaccatgagtctaagctccagaaagacaggaatttttcttctgttcattgctggaacccaaatgagtgcctgccacaaagcaggccctcaaaaaatatgtcaataaattaataggacttctgctggaagggaggagggcagggaacacttcattgcagaccttttaaagctattaaaccacggataatactttcacaaaagtcttttttaaataatgagtacatatttaactgtcaaggaaaagagacttaggaagacagctagtagataatgtgggatcagaagcagcttttggtttaagataggagagagttgaagattttttcaagttgacaggaaggatccaatacagacagaaaggctaaatacacacaagaagagagagtacacagtatgtttctgagacactgagagaggatgagatccaaagcaggagtgacacaggtggcctcaggtgaaaggaagggcagcccccagtcagagcaggaagaatgtgacagacaaaatggctgccattgtagatttgttttactggtaatggggaaactggaggagctcccatctgagttcttctattatctcttgaagcaagaaatcaggttatatgaagagagtgagttgtaaggaaaaaggtaaggggttagaggcttgagtgaaagttggaaataatcctttcagagaattatccagagaaattccataggattaccaggcagttaagcaagtccatttgagggaggtgctcaagtactcacagtgctaattagtcctgctcagtatctgctcaggggcaggggcacagaaggatgagctacatccagtaattatatggctttatccaggagtggggtactcccacagggtgtgacatgaagactgagaggtctgggattttagagcaccagtaaaagtaaaaatgaaataacaaccatggaattaagctacataaaagggaagacggggtgggagatgagataaagtaatgttctagggagcagttgcacgggattaccatgttactctggaacagctctggcatgatacgg

SEQ ID NO: 148428 - DNA, 307 bp, Homo sapiens
gactgagggaggaggatcacttgtgcccaggagtttgaagttgcagtagactatgattggacactgcactctggcatgggtgacagattgagaccctgtctcaaaaaaagaaaaaaaggataagtaataatagtgggcaactaagtggcctagactgtagaagttttggcagtaacagcagtcctgtggttgttgatgtcctcagcgtcaagggcttttggagtctcctattctcattttccccacaatgggggtaacagctgagggtattcctcttggcatcagatctgacattgtctacactcag

SEQ ID NO: 148429 - DNA, 393 bp, Homo sapiens
gttttctcagggccgagcaaagtcttggtctcacagaatttaactgtgaatagcctcagaattttcctacctcccgagagcctgcattctagtggcagaagatggtgtaattacagactacataaatgctctcagtaaaataagtatgattatgcagttgaatgtaatgaggaggcctaatctgataggattgtcgtttagccacaagccaagacctaaaggttgagaaagagccagccatgcaaacaatgagggaaaaacaatcctgtcgtaaagtagctttctctgcttcacagtagagtttattcagctagatccagaaatgtacatgcaaaagggtatttatgttcttattagaaagtagaaatcacatttcattatatacctatcttt

SEQ ID NO: 148430 - DNA, 437 bp, Homo sapiens
tttccagaagtttctccaccagcaagagaagggggcagagcaaagtgtgtaggcttggacttccttggaccctggtctgagtcctgactgccacataccagctgagccaagttgcgtagttttcagtgcctcacctttctctaaaatggggttagcgcctgcctcagaattgttctgtgcaccaaattatgtaaagttcttagcaaatcacctggcagtagtgtgtgataaggggaggagggccttactaaaacacttgggtagagtgtgtgataaggggagggaggccattgttacctggccatgaccttggcctccagagccgtagagctatagatgactgaggcaggtcatgtgtggaacagcccggctacttcctggtggagctgggactggaaacctccagactcccccctggggctctcttaactgctcca

SEQ ID NO: 148431 - DNA, 445 bp, Homo sapiens
tacgttatgaggggtagccctttcaaaatgacttagtatgatgatgtgattgtacaggatagaaatacaaaattatctttaccttacactacttaaaatctaaaactgaatcaagattattcatgctggagtcaaggaaaagcaccgtattctcaaagaaaaacatatgcaaacatctgtggcagaggctattttaaagtatccatcttgttgatcttttagtcttcttagcctactatgtattttcagttaaaaatcattaaagtccaccatatatgaacccagacacaggacaaaaacaacaacaacaaaaaaccacgtatttttttccatgggggcggtaaccagatgtcaatagctgcagctgtgactatataattacctgtttgcattaacatagaccacagtttagatttaataggttagatgacaatgcagcaaaatg

SEQ ID NO: 148432 - DNA, 371 bp, Homo sapiens
aagaggtgttgcggaaggcaatggattttaatccctcagaagagggtcccaacaaacaggcatttacaattaggttcagagcaatcacttgggcaaggaagagctgagccaaccattatgctgctggggtaactgcttagagaaggctcagctttccagttcatattttgcaaagtgagtggaccaagtactgatgaaaacgaattaaagtcagaagagaatgaactggggaaagaatgcatctaatggtacccaagtgaattcagatctcctggctcaaataaattatgtctcagagtgctgagagactataagaatagtgaaacagctttcctgtggtctttgaaaaaatatggagaatgagaatgagg

SEQ ID NO: 148433 - DNA, 182 bp, Homo sapiens
gggctctgaaatcatcagcacaatctaattttgttccccctaaagaaaccgagtctgggttcacagtgagtccctgtttcctcctccctcccagcctctgtcatttctcctgcattgtacttgatggaaagagtgtagtttccacactcgttcattagttcagacctgctatgttcttgcta

SEQ ID NO: 148434 - DNA, 180 bp, Homo sapiens
tcaccctgtatctgctggactcaattctagtggtgggactagagttctgtgtttttaataaagactaaggtcatgttgataagcacaaaggtttggaagtggcgatccattgccttgtgagtctgtgagctgccacttctaatctgcacttcggtcgctctgccacccctaccaccttct

SEQ ID NO: 148435 - DNA, 235 bp, Homo sapiens
aaaccccagtgcccgccgcagagcctaggggcacccaaagggcccagcagagaggagaggaacaaactcaccttgctggtggctgccctcagtctcagatgccactctgtgaccctgccctgggctctgaccacctcattcccctgcagcaccccccatgccctcttaggtctcccagctcccatctttcctggggagcttagcaggtaccatgctgcgtgcttgactctggagg

SEQ ID NO: 148436 - DNA, 249 bp, Homo sapiens
tgaattatgagatcctagaaatgtatgttaaagaaggttacaaggaaaagaaaaactgatagggaatacttctgcctgaaaagaaaaagaactaagtgataccttgaagtttctgcaaagatatctgaattgcacgcaggtaggtcatcattaatctggtgatgtatgttaaagattcaccataaaatttcctttaattatatctgactttagtagattttacaagttgtgagatcaaggtaagtatat

SEQ ID NO: 148437 - DNA, 293 bp, Homo sapiens
ggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctg

SEQ ID NO: 148438 - DNA, 401 bp, Homo sapiens
attagatctgaaaacagttacatgagttatagaaaaaataaagctcagaaaggaaggattgataggttactaaaaatgcctatgtggttttatttttggaatctgtaactttgtctccccaggaaggttttcactaactagttcaaagtaaatcttgggccaagtgtggtggctcattcctgtaatcccagcacttttggaggccagggcaggtggatcacttgaggtcaggcgggcgtgcacctgtacctagctacttgggaggctgagacaggagaatcacttaaaaccgggaggcagaggttgcactgaggcgagatcgcaccactgccctccagcctgggcgagagagtgagtctctgtctcaaaaaaacaaccaactaaccaacacccccgccacc

SEQ ID NO: 148439 - DNA, 548 bp, Homo sapiens
atgggaagacagaacagatgaagtttggtaagctactaaataacagttgtgggctaacagccaggttatcagacaagcaaacgcaacccaaatgaagcttcttacctgcatttctacatcagctacaatggtcttggtgtatctctacattccaagccttcatgcatcctttgtaaatactaagaatcaggggtatttaggttgacaaagtaactacattaaccacataatcatacctctacatcattatcaccaagaacaacagtattccaaatattagactcataactctaaagcaacaatttcctcccctcactctctgggaaaaaagaaagaaagaaaaactttgcagaggaataaagtgggaagccagtgttctaatataaacatgacaagcccaattctatcactgcaatatactttctgacttcagtacaaaaatcttttctgaccatctggagctactccaggcatgaggccaaaactttgtaattccttttcaaagtaaatgacagatcagtaactgccacgttgctaatgcacagcca

SEQ ID NO: 148440 - DNA, 500 bp, Homo sapiens
ccagttcacagctcagttacaacagctccagttacacagctccagttacaacagctatgaaatattcttatgaaaaaattgaaccagaatctgatcaagtctctacatttagctaccaattttaggaactagaggacacagaaacatgttgaatgataccacaagaatacaatcaacaaaatataattttagaaaatttaaaagacaaatgacttaggtttttaaacaaataaactgcaagaaaaattagagcagataagaacttgtagatttaaagaagcttaaaggacatatcaactaactgcaatgtgaggattctagttagattgattcaaaaaactgattaaaaaagagagagacagacagagacagacaatccagaaaatttaaacacattaaaatatttgttgatattaagacattatcattggcttatttgtatgtgataattgtatggttatgtttaagacatccttgcccatgacagagacatactaaat

SEQ ID NO: 148441 - DNA, 1006 bp, Homo sapiens
catggtggctcatgcctgtaatcctaacactttgggaggccaaggcaggcagactgcttgaagccaggagtttgagaccagcctggccaacctggtgaaattctgtcactactaaaaatttaaaaattagccaggtgtggtggcgggcgcttctagtcccagctactctggaggctgaggcacgagaatcacttgaacctgggaggcagaggttgcagtgagcccagatcacaccactgcactccagcctgggtgacagagtgagaccctgtatcaacaaaacaaaacaaaactatatggtttcaggcacctatggaggtctgacatatccctagcagataagggggagttactgtttaatgtggaatagagtggggatcgcagcagcatcatcttgctcctaatttcaaagaggaggtttttagcattagagtatttgtagatacccttttataattttaaaagaagttattttctatttctattctattgtcaaaaaatttttattgctcgttttaaccataagttgatgttgaatcttaatcaactacctttcctacatttgaggattttataagttctatcttttagtctatcattggggttatattacattaattgattactaatattaagccactttgcattctaggagtggcataaatctaattatgatgtattatcatttgaatatatatatctagattctgttgctaatatttagtttatagttcttgtatctatgttcatgagtaaaattggcctgaaaatttccttctcttactatctttgttgactttctgatcaaggttataaattaagctgaaaattactctctttttctatatatggttggaattatttctttcttgaatcttgggtgaaacttagttaacttttaaaaaataaataatgtaattacaccgaagtcagaaaaatggtttgtataatttcaagtctttgaaatttgttgagacttgttgcatagcctagtatatggtcaatt

SEQ ID NO: 148442 - DNA, 788 bp, Homo sapiens
gtttagatcaagaactggcttctagtctgtgtgacggaaatgacgacccgtgtgtctttataaagaaaacaaaactatatggtttcaggcacctatggaggtctgacatatccctagcagataagggggagttactgtttaatgtggaatagagtggggatcgcagcagcatcatcttgctcctaatttcaaagaggaggtttttagcattagagtatttgtagatacccttttataattttaaaagaagttattttctatttctattctattgtcaaaaaatttttattgctcgttttaaccataagttgatgttgaatcttaatcaactacctttcctacatttgaggattttataagttctatcttttagtctatcattggggttatattacattaattgattactaatattaagccactttgcattctaggagtggcataaatctaattatgatgtattatcatttgaatatatatatctagattctgttgctaatatttagtttatagttcttgtatctatgttcatgagtaaaattggcctgaaaatttccttctcttactatctttgttgactttctgatcaaggttataaattaagctgaaaattactctctttttctatatatggttggaattatttctttcttgaatcttgggtgaaacttagttaacttttaaaaaataaataatgtaattacaccgaagtcagaaaaatggtttgtataatttcaagtctttgaaatttgttgagacttgttgcatagcctagtatatggtcaatt

SEQ ID NO: 148443 - DNA, 132 bp, Homo sapiens
ccctgtctcaaaaaaaaaaaagaaatatttgttgcatgtgtatgtatttgtgggcatgttgtctgtgtgtgactgcacaagacgggtgcacgtgcaatgcatgcgtgtgtgatgatgtgttcttggacgttg

SEQ ID NO: 148444 - DNA, 407 bp, Homo sapiens
ttttatgggttaatgtatcactttcaattccttactccagctgttgccagcagataaattagctaaattaaaagcagacagactggaggagttttccgaaataaatcacttctcttctgttataccagtgttggttatactagccatccccattcccagcagtgagaggaacagggctggtcttcaaatccaacatgcccccttttctgccacacccttatagaaccaaagctttggactattgagggcctattatttttgttaaaagactaagtaatgtttccagaaaattgttgggagttacaagcagctggttttctggggtaactagatactaagccacggtctatcacaagccacggtcaacccacaagccacggtcaacccacaagccacggtcaacccac

SEQ ID NO: 148445 - DNA, 501 bp, Homo sapiens
  misc_feature (493)..(493): n is a, c, g, or t
ttttacgtatgaggccacagaaaattaagtttattttaaaatactttttcaaaatctcatctctgtgaaaaaatccaagaagattaagaaccttttttttcttcaaacgaattcaattttgtcctttagttttgcagtgcacagaagaataactttcaagtttctattacatttgaagtggatttttcccgaaattgtaaaatatcagtatcaacaagacaaatgatgtttgaagtgctttacacatgataatttagctttgtgcgggttttttgtttctgctgttgtttttgtttgtgtgggtggttttttgtttttgttttgctacccaatgtcaataatagcatccagttgacttgagactttttatagttctctgcaagccttccacacttttctggtctcagttatagctatctccaccatactcatcaagactcctagctcaccaccttgctctctcaattcatgaagtcttgatgagtatggtggnctcgataa

SEQ ID NO: 148446 - DNA, 456 bp, Homo sapiens
tctgaacctgcggttcctctcgtactgagcaggattacaaacatcatcagtagggtaaaactaacctgtctcacgacggtcccctatcgtcaacgatggtcctcagctgtgaagcccaaacactgctgccgatttctggtttagacaaacagctcctgcaggactggaattgggcaagactggagtcaggaaagccatcaggagcttaaaggaattcaggcaggcacagaacggggttgttagaaataatgagataacggtatcttcaggtgttttgagaatcattattttaccatgaaataagagcatgaaacaatattccgcataacttgctacactctaattgtttcctggactctcttcagaagctgtgtgtgcctagtgaatggaaaccgtaactacttcttgctagctgtcactttatctcacctttcatgtgaagtctgatgccagaca

SEQ ID NO: 148447 - DNA, 495 bp, Homo sapiens
ttggctgcatgctgtaatcacggaggcaagcttggagaacggtgttggccctgcaagaagagcttcagcagggcaaatggtctttgcacacaggaaccatttcccagtgttggccttgaatcactcatgtgccttccagaatttcagaatcttatctataactctcagaatgagtctcaggatagagttaaactcctgtcggaatgtagtcatttggggttctcttgccaccataggaactgggaccatcatctgtgatgctgcaccagtgaagtctgtgctgataacccattaggacttgatgacaccagggctgtatcatgacaaagactgcatatgctgagacctcaagagttggatatggtgtgtggacgatggcaatatttataagagcttttaatgcactgaatcagtatctgcaggcctagagtccttaaataatacaagtatactttggactgcatgatgatctggaacacaggatattggagaaac

SEQ ID NO: 148448 - DNA, 732 bp, Homo sapiens
cgcatcgcatggccagaaggcggggagccagaggcgccaggaccctagcgtggcgctccagcaccccagaccgtggcggcgcctcgccttagggaagagcaagggaagaactttatttgaaccgcgaacattttttggtcactgagatcgagtctcccagtgctttggcttcccgcctctttatcgtgggtttgatccctgagctgctctcctttccctcgctgccccgcagatgcggatggccagccagtagcgggcggtggccccgcgtcccgggagcgcacagcaatgcaggcgcttaacattaccccggagcagttctctcggctgctgcgggaccacaacctgacgcgggagcagttcatcgctctgtaccggctgcgaccgctcgtctacaccccagagctgccgggacgcgccaagctggccctcgtgctcaccggcgtgctcatcttcgccctggcgctctttggcaatgctctggtgttctacgtggtgacccgcagcaaggccatgcgcaccgtcaccaacatctttatctgctccttggcgctcagtgacctgctcatcaccttcttctgcattcccgtcaccatgctccagaacatttccgacaactggctggggggtgctttcatttgcaagatggtgccatttgtccagtctaccgctgttgtgacagaaatcctcactatgacctgcattgctgtggaaaggcaccagggacttgtg

SEQ ID NO: 148449 - DNA, 496 bp, Homo sapiens
cctgagagagcatggagagctggaacactgtctatttcagaatttggacacaaagtcagaggacatatgtggtataaacaagcctgaagaagcagtcaggttgggcatggtggcttatgcctataatcccaacactttgagaggctgagatggaaggattgcttgaacccaggagttcgaaaccagcctgggcaacatggtgagacccgtgtctacaaaaagtttaaaaaacaaaaaagaaattagccaggcaggatggcatgcacctgtagtcccagctacttgggaggctgaggtgggagatcacttgagcctgggaaatggaggctgcagttagaaacacaccactgcattctaacctgggcaatacagtgagacctcatctctaaattaaacaaattaattaaattaagttaaaattaaaataaactaattcggaagtacatggagagcaatgaattttaagacagtggttattatgctcagacttgccttt

SEQ ID NO: 148450 - DNA, 561 bp, Homo sapiens
ctctgccttttcatctcctgaaaaggtagatttgctagtgcaagaagatattaaagactcacaggcaccaaactaacattttctccaccacataatcacgcccactgaatgtgacctgcaaagggtctgtctcattgcaggatccaaagccatttaatgccacaagtgtgaactgctcccaatgccctcacccatcacaggtggtcccacactggaaaacattgcttcaagcagcattaacaactaaggatgtcacaaatgcagatttatttgccaagaaatcagggtgcttctgtaggttttttacataatgagaaatcaaagctatcaatgtaaagtactgcttttaggttcaatcaatcattggtaaaatgatacaatgaggaaaacctggcttggctgcagttcctgtggaaagggactgtggtttgggctgaccacaagatcaacatcagccaagagtatgacagggttctgaggtgagagaagggactcttaggctcattcctaacctgtcagggattgaatcaagggaagggagatcctgtcctcacagtgagc

SEQ ID NO: 148451 - DNA, 478 bp, Homo sapiens
aggtgactctagaggaccccgctgcgcctactattaccagctaatttttgtatttttagtagagatagggtttcaccgtgttggccaggctagtctcgaactcctgacctcgtgatccgcctgcctcaacctcccaaagtgctgggattacaggtgtgagccaccacatgaggaggtttttacaagtaaattttatcattgtcattaaaaatagatgaaaaaatacttagcatttcctctagctggtttcccatagccatgaatagatataaataaggatgctttctgattagcaagaaatagaatggatcatacaatgttgacgattctctttcttttcattctaaaagaaaatgtttcatgtttgttaaaaaggagaaggacaaaattatagaaaacattttcaaacattttaaggaaaacatgacataaccacaccatgtttaaaatgtttctcattgtcagtcattataccaca

SEQ ID NO: 148452 - DNA, 407 bp, Homo sapiens
agcaattctctcctgcctcagcctcccaagtagctgggattaccagtgtccaccaccacacccagctaatttttgtgtttttagtagagagcgggtttcgccgtgttagccagggtgatctcgaactcctgacctcaggtgatacgcctgcctcggcctcccaaagtgctgggattataggcgtgagccaccacacccgacccatcactttcaactacatcatgaaagttcttttgaaaggaaggggcatttaatggtagaagtgacatttcaggtgaaaagtgaaacactttgtttatacattttaggggtgaaattgcttggaaacataacccaactgggattgtcttaacctaacataaaagtaacctgtttcaacacagaaacatgaatatcattttgtcctc

SEQ ID NO: 148453 - DNA, 241 bp, Homo sapiens
tttattggttttcaaatgtctaatctttcatagtattttcctatctgttttatgatttattttatttgtacttcttaaagaattctacttttatctgctggcttttcctcctgtagatggtatgtatgtaggcttaatctttccttctatgataatcctatgggaccctattagaaactctccctaaagggcagtttttgtatttgtttctgctggggtgccagaattgattttattttct

SEQ ID NO: 148454 - DNA, 297 bp, Homo sapiens
cctaacttctttaaactcagtatcttcatctgtaaaataggtatgataaaatgcctaacttgtaagattgccacgacaagtcagtaagatgctttgcacatagtagatgctaaataaatagtaaaatcaattttttttcttctccttctcttttcctgtctttattttttttggggggcggggtaagctttccattctttccattcctcctctttctctttttcttcctctatcaaatggaaaggtgaggaaaggcagacattggcccattccacccccacctgcagtgtgctcctc

SEQ ID NO: 148455 - DNA, 422 bp, Homo sapiens
aagtaccagaaactgggtggcttataaacaacaaatagatctctcatggttgtggaggctggaagtccaagatcaaggtgccagcagatgtggtatctggggagggcctgtttgctggttcatagatggcaccttctccctgtgtccttacatggtggaagaggtgaggctgctctctggggcctctcttacaaaggcacgaatcccattcataaagggctccaccctcataaccataggctctttaaaatgccgcacctcctaatatcatcatcttggaggttagcatttcagcatatgaatttggcagtggggagaggacacaaacattgagaccacagtagcaagcatttaggcatgaagaatgtcacgggaacaaggcttggcttctcattctgcctcccaccccccttgcccttctg

SEQ ID NO: 148456 - DNA, 365 bp, Homo sapiens
gcagaactgcaaactggtcaggacttgcacgttacactagaaattcagggcccatcatgaaaagagcctaggagaactcataggcattgaaagctggtccccagaatctgggaagttataaaataggggtgaatgggggtgaaggaacttgcattatttgatctacagaggagaaggctaaggtatgctcagaaaatatgtaaacacataaataactgagttatttttataacccggcatttaataactgggttttcatcttagctcagctttaattatggccttctggaatatacaaggctcttacccagactaggaggtatgctttggagtcagacagatctgagttcaaatcctaatgccag

SEQ ID NO: 148457 - DNA, 1148 bp, Homo sapiens
tgcactccagcctgggtaacagagtgagactccatctcaaaaaacaacaacaattaacaacaacaaaaaccaaagctaaacaagagcagaatccagattattaaaataacaatttaaaaagcatgattgtcacaagcttcaataattacctgcctgctcttgagtgtttaggttggtcttggaatcggcctgtccctgtgcttgaggagtggaccctcagggtgtcactgcccttctttgtgatctctttttagcctactgtccttcctttggtgcctaactcagaaataaacattcttaatctgttcagcttaattgagattcaaacctcttaaaaagtagttttgtcaagaggcgtgtgaaccagagcaactccattttgaataggagctgggtaaaatgaggctgagacctactgggctgcattcccagacggttaaggcattctaactcactggatgagatagttggtcagcacaagatacaggtcataaagaccttgctgataaaacaggttgcagtaaagaagccagctaaaacccaccaaaacaaagatggccacgagagtgacctctggttgttctcactgccacactcccacaagccccatgacagtttacaagtgctgtggcaaagtcaggaagttactctatatagtctaaaaaggggaggcatgaataatccacccctcgtttagcatatcatcaagaaatagccataaaaatgggcaatcagcagcccttgggctgctttgtctacggagtagccattcttttattactttactttcctaataaacttgctttcactttactctagggactcgtccagaattcttccttgtgggagatccaagaactgtcatttgaggtctggattgggacccctttcctgtaatagtttgaatgttaaagtttgtgccattgcattctttggtgtgattgctttattctgaactagaggtgaagaatgtggggaatgtggaataaaatgaagggaatatatcagtacagatggagctcataatttatggtgaatttctcattcctcacaattggagggtatatgtttgaagtgagtcaatttctgaatttattacctaatttgattgtatgccttatacattatatttttaagaaaaaaattaa

SEQ ID NO: 148458 - DNA, 315 bp, Homo sapiens
tggctctctgcgtcggggtgggccctcgggcctgggcactgcgcgtctggcccgacgctcgggcggaaggcatggctcccaccccggccctcctccgcgtcgcccttcccctagagctgatctcccgcggcggcctgagggtcgacttttccacagcttgggccgagagagcccggcaggccctcggctgagggttagggctcggtatctcagggctcggggtccagtccccgcgccgccgccccccacgggctaagccactttaactctccgagcctcagtttccccatctgtacgatgaatgggcctcgggag

SEQ ID NO: 148459 - DNA, 225 bp, Homo sapiens
aaccttttcccagtattgtcaaatgggaattcaaaaatccaataaacctgtaaaattgcttccaaaacagggactatgaaaaatgaaaatgtctaccattctccctgaagtccattaagggattcaaatacctataatgacttaaataagtttctttagtccggatttaggaaattgaaggttgaagtacaaaaaaagaaaaagaaaataagtaatgtatgcatt

SEQ ID NO: 148460 - DNA, 1032 bp, Homo sapiens
gctctaattttaaagactaaggggcaaattattaaatcttaataaagtgttgaatgtgagaggtgttggctggggagtaagtttgcctaggagttaggagaaatagattttaatcctccttaggcaaataaggggacttagacttttttttaaaacctatttgaatttttagtttctaattcaaattttttgttgccagaagcctaaaaactgtacagattgagttttattaaaagcagttttgtttttttttttttggaaacggagtctcactcttgtggccctaggtggaggttgcagtgagccatcgcaccactgcactccagcctgggcgacagagtgagaccccatctcaaaaaaatgataataattgattctaaactggggaatagagagattcccaatttaaaatcttcacagtggttctcaaacgttagccaacaccagaatcaatagggctagttaaaacagattgctatgatctctaccacaagggtttctaattaagtaagtctggggtgggccctgagagtttgcacttctagtaagttccaggtgatgatgctcatgcatcactcattctgagaggtgcccctttagaagaagggatccaaacctcaggcaggttttgacaaagaataacctagagatactttttttctaaaactatctctgagctttaggtaaggatactttttttctttgagagcctcacactgtcacccagattagagtgcagtagtgtcatctcagctcactgcaccctctgcctcccgggctcaaggggtgccctcagcctgctgagtagtgctgctaattttttgtatttttggtagaggcagggtttcgccatgttgccaggctggccttgaattcctgagctcaggtgatccacccgccccaagcctcccagagtgctgggattacaggtgtgagccacgccgcctggcctcaaggaatattcttgattgaaaatggtgctaaagttggtctttttatgagtggtagctcttcagtttaacataaataaca

SEQ ID NO: 148461 - DNA, 901 bp, Homo sapiens
cgggtggatcacgaggtcaggagtttgagaccagcctggccaacatggtgaaacccccatctctactgaaaataaaattagcttggcgtgctggcgctcgcctgtagtcccagctactcgggaggctgaggcaggagaatcgcttgaacctgggaggtggaggttgcagtgagccatcgcaccactgcactccagcctgggcgacagagtgagaccccatctcaaaaaaatgataataattgattctaaactggggaatagagagattcccaatttaaaatcttcacagtggttctcaaacgttagccaacaccagaatcaatagggctagttaaaacagattgctatgatctctaccacaagggtttctaattaagtaagtctggggtgggccctgagagtttgcacttctagtaagttccaggtgatgatgctcatgcatcactcattctgagaggtgcccctttagaagaagggatccaaacctcaggcaggttttgacaaagaataacctagagatactttttttctaaaactatctctgagctttaggtaaggatactttttttctttgagagcctcacactgtcacccagattagagtgcagtagtgtcatctcagctcactgcaccctctgcctcccgggctcaaggggtgccctcagcctgctgagtagtgctgctaattttttgtatttttggtagaggcagggtttcgccatgttgccaggctggccttgaattcctgagctcaggtgatccacccgccccaagcctcccagagtgctgggattacaggtgtgagccacgccgcctggcctcaaggaatattcttgattgaaaatggtgctaaagttggtctttttatgagtggtagctcttcagtttaacataaataaca

SEQ ID NO: 148462 - DNA, 287 bp, Homo sapiens
aaagtgctgggattacaggcgtgagccaccgcgcccggccttcatttcttaatggaggagtagcaaggttctaaaaagtcttgaagataaatattgttgcaatcatatttggcaaatacagtctgccacagtctgaatttataaatgcttcttgagatccaaacaccaaacaagtgcctgtgtggcataataagtattacactctacagaaagtgcaaaaggagcctagatgagaaagctggggattaaagaaaactctggaaagccttttgaaaaggagaggattg

SEQ ID NO: 148463 - DNA, 218 bp, Homo sapiens
atactaaagagcttaacttaaattcaactaaacactatcatttttagatggggtaagattttgttcaaattgttttaacgtggttaaagatatttttaaaacattctaatttgcaaccagggtatataaaattttaacaacagtaatttatagttaaaatgatagcttcagagcagttcaacaataggttttctagaagctcgtctctagtaggttat

SEQ ID NO: 148464 - DNA, 473 bp, Homo sapiens
cagggcaagagacagttcccagaccaggaagaggggagtgcccaaggacagatgagggctcagaggggaggagtcagtgagccccagaggtggggcccgagagccaggggtagaaggatttccacaaatagagtgtggaatttggggaggaggtggaaaggggagacagcaaggtggtaaataagggctgtggctctggaagagatagctttttaaatttaccatgttcactgttttttttaagatacagggtctcgttctgtcatgcaagctggagtgcagtggcacagtcatatcttactgccgccctcacaacagacgcccaccatcgcagtcctgttggacatatggatatgaactgggcctaccgactgcaccaaccacttccctgagctgtgtcccttccttgtcacagcaacccctgaaggaagcgctgttcttcaccccactgtacagtttgggaaatggaagcc

SEQ ID NO: 148465 - DNA, 327 bp, Homo sapiens
ctcttttagaattatggatatcgcaaacattgaggagatgcaaattagcgtatgttgtcatctacaataaaggaagaagatatgcaaagggtgcatttttaggtgagatgataaagaaatctatctctgaagaggtacgaatttgagatgtgattaaaggtaaaaaagaacatgttggaatatcttagagaaaaccgtttccagaagtctgaagaacaagtgcaaagaccctgctgacagatcacgccttatgtgtttaaggagcagcaagatgtctactaggtctggagaaaaataaaccagtgggagaatttaagagatgagaaa

SEQ ID NO: 148466 - DNA, 232 bp, Homo sapiens
gatgagggcaagacccctctaaggcactcccccacaccctatcactcctgctcttaaaggacccctgaagggcactgaaggggttggacttctcagtgcaagccaacacccacacctccgagtaccaacagccccagagaacagcaggggtcctcaatcctgagcacccctccaaggaggtcaggagaacaagccttaagccagagagtgaagaggatcagtgtctcggacc

SEQ ID NO: 148467 - DNA, 516 bp, Homo sapiens
gagacactggctgctgaaagtattttaaatgatgtagatactgacaacctaatattaagtacaactgtatacacagcatgaaaacaaccatgccaagtgtacacacaccttatacacagaggaaaaacaggaagaaggcatgccaagagattaacactagtcatccctgcactgtgggactacagcggctattttattctttatttttcagatattcaaaattgttttataattttttttcttttttaaaaagggcatgtttctttttctctctaaaatcaggctgtggggccaaccctggagacaaaaactatctttcgcagactactgcctttgcaggcttagtttctttcctgggcaaactaggataatagccatgaatcaaatggaataatagatgccagagctcacccgaatgtttcagatgcttgcaaatactattgcacaaaaaaactgttacttatactgctgttgtggtgttatagtttatcatcaaaaaacagacataaacatcat

SEQ ID NO: 148468 - DNA, 854 bp, Homo sapiens
cgctcgcgcccgtgcccgcgcaacctagcctgctggccggggggcggggcgagcgagccgcggcgcttccgctttacacgccccagccggcgaccggttccatctggctcgggccactctgacacctttagtttcggcaagggatatggtggcgaaggggaggcgggggcccgaaggcttcggaaaacgatgggggagggggcagaggatacccgtcgaagcccccccctcccccaacatttcgatattggaatcactttccttcttcctcgggccagcctttgctctgtcccctcaggtcaactcaaggtagacagtgtggcgactggagaggtcggggaacaagctttgtttcagctaaggggaaaacaagcgttcacaggagtcccctgacacctcccactcggaagatagctaacgggggtcctgccaacccttcccatccaacttccatctgaaaaggattttctgctaaagttgggtccatggccatccagcacctgtaaggccggcaggagcgtctgccctctactcagttaaagcctgaagtcgtttcctttcgatggcccttaggaggcccaaaagaggggcgacagaacatgatgttgacacgggctgggcgcccccagaagcccgggaacaaacgtttctactttccaggtccactggtgtttggtgtacccatgtgactaatttgtccaaagagagatttacctcagaagacacctgtataaaaggaagaggtccctatgaagtggtgatggtccatgaggaagaggcctggaaatctaagcagggcttccagctccctgcttcctgtctaagtccaggtacttaccccacctataggtgag

SEQ ID NO: 148469 - DNA, 918 bp, Homo sapiens
cgctcgcgcccgtgcccgcgcaacctagcctgctggccggggggcggggcgagcgagccgcggcgcttccgctttacacgccccagccggcgaccggttccatctggctcgggccactctgacacctttagtttcggcaagggatatggtggcgaaggggaggcgggggcccgaaggcttcggaaaacgatgggggagggggcagaggatacccgtcgaagcccccccctcccccaacatttcgatattggaatcactttccttcttcctcgggccagcctttgctctgtcccctcaggtcaactcaaggtagacagtgtggcgactggagaggtcggggaacaagctttgtttcagctaaggggaaaacaagcgttcacaggagtcccctgacacctcccactcggaagatagctaacgggggtcctgccaacccttcccatccaacttccatctgaaaaggattttctgctaaagttgggtccatggccatccagcacctgtaaggccggcaggagcgtctgccctctactcagttaaagcctgaagtcgtttcctttcgatggcccttaggaggcccaaaagaggggcgacagaacatgatgttgacacgggctgggcgcccccagaagcccgggaacaaacgtttctactttccaggtccactggtgtttggtgtacccatgtgactaatttgtccaaagagaggtctcagctgaaatgaaacctcctcagaaaaatttgttcctgacaaattataactcaaaaatcaaaaatttctaaggcctttgttattctctttatcacagcattgtactcattttcttcttagtacttagaaacgtctataattgttttacttctttgtttaccattaaatgtctgtatcctttaaaactgtaggtcctatgagttcat

SEQ ID NO: 148470 - DNA, 466 bp, Homo sapiens
gcaactcttcatcatctatttccaggtttctactttccaggtccactggtgtttggtgtacccatgtgactaatttgtccaaagagaggtgagtgaaagtgatgtgtcacttccagatggaagctttttgggcaagtatgtattttctagctcttttcttctgtgttatagaaactaggaatattccagttggtgactgaccccttagttgggttcctagagtgagtttgatgtggaggagcccaaaatgacctgcagtgaagttggagtgtgagcaagaaataaacttttgttttttaattttctgaggttttggaagttgtagattataactgcataacctatcaatattgatatgtttcaattcttaatgaaaatttctaatattctttttgattatttctaacttattaacttaaaatgtcaaatatctataatttcagtatattctgtatcctacatttaa

SEQ ID NO: 148471 - DNA, 1040 bp, Homo sapiens
cgctcgcgcccgtgcccgcgcaacctagcctgctggccggggggcggggcgagcgagccgcggcgcttccgctttacacgccccagccggcgaccggttccatctggctcgggccactctgacacctttagtttcggcaagggatatggtggcgaaggggaggcgggggcccgaaggcttcggaaaacgatgggggagggggcagaggatacccgtcgaagcccccccctcccccaacatttcgatattggaatcactttccttcttcctcgggccagcctttgctctgtcccctcaggtcaactcaaggtagacagtgtggcgactggagaggtcggggaacaagctttgtttcagctaaggggaaaacaagcgttcacaggagtcccctgacacctcccactcggaagatagctaacgggggtcctgccaacccttcccatccaacttccatctgaaaaggattttctgctaaagttgggtccatggccatccagcacctgtaaggccggcaggagcgtctgccctctactcagttaaagcctgaagtcgtttcctttcgatggcccttaggaggcccaaaagaggggcgacagaacatgatgttgacacgggctgggcgcccccagaagcccgggaacaaacgtttctactttccaggtccactggtgtttggtgtacccatgtgactaatttgtccaaagagagaaactaggaatattccagttggtgactgaccccttagttgggttcctagagtgagtttgatgtggaggagcccaaaatgacctgcagtgaagttggagtgtgagcaagaaataaacttttgttttttaattttctgaggttttggaagttgtagattataactgcataacctatcaatattgatatgtttcaattcttaatgaaaatttctaatattctttttgattatttctaacttattaacttaaaatgtcaaatatctataatttcagtatattctgtatcctacatttaaaaataaaaaatagaatgttgaaaatgaaaaaaaaaaa

SEQ ID NO: 148472 - DNA, 756 bp, Homo sapiens
cgctcgcgcccgtgcccgcgcaacctagcctgctggccggggggcggggcgagcgagccgcggcgcttccgctttacacgccccagccggcgaccggttccatctggctcgggccactctgacacctttagtttcggtcaactcaaggtagacagtgtggcgactggagaggtcggggaacaagctttgtttcagctaaggggaaaacaagcgttcacaggagtcccctgacacctcccactcggaagatagctaacgggggtcctgccaacccttcccatccaacttccatctgaaaaggattttctgctaaagttgggtccatggccatccagcacctgtaaggccggcaggagcgtctgccctctactcagttaaagcctgaagtcgtttcctttcgatggcccttaggaggcccaaaagaggggcgacagaacatgatgttgacacgggctgggcgcccccagaagcccgggaacaaacgtttctactttccaggtccactggtgtttggtgtacccatgtgactaatttgtccaaagagaggtctcagctgaaatgaaacctcctcagaaaaatttgttcctgacaaattataactcaaaaatcaaaaatttctaaggcctttgttattctctttatcacagcattgtactcattttcttcttagtacttagaaacgtctataattgttttacttctttgtttaccattaaatgtctgtatcctttaaaactgtaggtcctatgagttcat

SEQ ID NO: 148473 - DNA, 731 bp, Homo sapiens
agcaggagaagatcagagaaatctgctacaaaaccaaggaggtgagggagaagaggaccaaatactgacctagcacatgctcactcttctcacaggatcaaggccatcaagctacagatggtcttacaaatggaaccccaaatgagctcaactaacaacttctaccaaggacccctggactgacctgctggccctttcactggcctaaagagttcccctctggaggacactacaattgtagggccccttcttcgcccctatccagcaggaagtagctacagtagtcatcgcccaattcccaacagcagttggggtgtcctgtttagaggggggattgagaggtgaagccagctgggcttctgggtcgggtggggacttggaaaacttttctgtctagctaaaggattgtaaatgcacccatcagcactctgtaaaaaatgcaccaatcagcactctgtgtctatctaaaggtttgtaaacgcaccaattagcactctgtaaaaatgcaccaatcagtgctctgtgtctagctaaaggtttgtaaatgcaccaatcagcactctgtaaaaatgggccaatcagcactctgtaaaatggaccaatcagcaggatgtgggcagggccaaataagggagtaaaagctggcctctcaagccagcagcagcaacctgctcaggtccccttccacactgtggaagcattgttctttcactcttcacaataaatcttgc

SEQ ID NO: 148474 - DNA, 592 bp, Homo sapiens
agtgtatgtgtatgtatgtatgtgtatatatatttgttaaacaaaagccaattctgaatccttttcccccatgacatggatggagatatcctcagttcccatgggattattcaaaatttgagtgctcatgatttttgatattcctccttatctccccaagaatatgctgtctattctacctctcaacaggacaagagactcatagattatatctctgaaatgttctatctccaataacactactagagtccaatcttcattgcagtcttagaaatcttaacatttacatgttagagaactataacagctaagtgccccaagtagaaaaatagagattttaatctgagaaattatatataacaatttaacaattttctgacttccttttctagcctgttttctctctagtccaggggttagcaaactccagcttgtgggcaaaatccagcctgttgcctcttttttgtatggccccgatctaaaaatggtctttaaatgactggacaaatcaaaataatattctgtgacatgtaaatattaaatgaaattcaatttcagggtccataaataaagttttattggaacacagcca

SEQ ID NO: 148475 - DNA, 466 bp, Homo sapiens
aagccggtggagggttgataaaattctttggctgctgtgcagagcaagagtggaagcaaggatttcagtttaaaggctttgcagccgcccaggcaagccgggatattgttctctgcaaatgaacactctgtcctatctggttcatactgacattctgattgagccttacatgaattaaatgcctagtgtgtgtttggctagatgattttcagtctaaattagatcattatgtccttagaatatcaaggttccactgacctattgttgagaactcttgaagcgtttgctgtgatctagctactccgaatgtacccctttggaaacaacgtcaggcatttgagaaatatctgactagggccagaatcagaggcccatgaaatggaagaattcactggtaaagaaacagtacttagttcacagccttgttcatagctgtatccccagccctcagcatagaggctgacac

SEQ ID NO: 148476 - DNA, 209 bp, Homo sapiens
aaggctcaccctgtggggtgcaggatgcgggatgttgctgctgctgctccctccccttgagcctcctgcctcctccctcacccttcacaaccagataggacagtgactttctgaaatgtgggtctggtctgttgcctccctgctgcaggacttccctattgctctcaggaagaaggccagagtcttcgcccttctcctcaagaccctcc

SEQ ID NO: 148477 - DNA, 329 bp, Homo sapiens
ggaccatatagcataaagtagaggctacaaaatgttagctttggaatgatcagctagagtcattagtcctgtcaaaccagtggctatgagggcaggaagtctgactgattgtttaccattacagacccacttcctaagtacctaagaaaaatgcctggcacataccagatagtcaataaatatcagttagaagcaactcaataagctaggccctgaaggaatccaaatcttggagaatccccaaaagaaaaggtctaagaagctagaacaatgttatagttaatatgggtacctatactgggcctcaagaccaccttagtttttttttt

SEQ ID NO: 148478 - DNA, 239 bp, Homo sapiens
ggaccatatagcataaagtagaggctacaaaatgttagctttggaatgatcagctagagtcattagtcctgtcaaaccagtggctatgagggcaggaagtctgactgattgtttaccattacagacccacttcctaagtacctaagaaaaatgcctggcacataccagactgtatttttatttttattttttattttttgagatggaatagtgctctgcaacccggctggagtacgtgg

SEQ ID NO: 148479 - DNA, 280 bp, Homo sapiens
tcccaaatcctgttgtaccagaggcttagaaaggcttaaactgttaaatgcataaacttcctcaatcaacgggcctctcttgccagattctaaagcccagccagatgaaaaggcagtggctggagggcggggaacttcccagctgtttatggtcctgctggagtgatctggaggcagcctatgtgttttcagggtccagatgagccagtctggggccgagagaggacagtgcagggctccagggtcagatgccctgggttctaaccctacttcttcctag

SEQ ID NO: 148480 - DNA, 396 bp, Homo sapiens
agctggggcacagggaaagcctcgacatagctagagacttgggcacataaaacgcgtatactttaaatatattcagagaacagagaccatgggtaatgaactaaaagaaagtataagaaatgtatttcaccaaacagagagtatcagttgggatagaaattataaaaaagaactgaatagaaattctggatttggaaaaaacaataaccaaaatgaaaaatcacttaagagactcatgagcagatttgggttggcagaagaatccataaacttgaaggtaggctgattgaaattatttagtttgaggaacaaaaagaaaaatgaagaaaaaagaacagacctgtactatagaacaccatcaagtatatggataagaggagtcatagaagcaaagga

SEQ ID NO: 148481 - DNA, 210 bp, Homo sapiens
tctgtccacaactctcaggtcatcactcttattatcttgagcctgggtggcgggtagatgagagcttacactttggctagtaaggttgtttccattctcatacgtgctgggtgttcagctgatcatcgttttgtgtattgtgggcaggagggggacccaaatctcttctgcatcctgcctctgcctcctaactcacctggtctgtgtctc

SEQ ID NO: 148482 - DNA, 409 bp, Homo sapiens
ggctgggattacaggcgtgagccaccacgcccagcctgcttgaacggtcaaacctaactggatgccaggaagcaaggagagccgggtgatatcacctgaaacccacagcaatcagcttcatggagcaccgagcacagtcaggaggggtagaaaagggatccaaggtgggtgacgtgcttgaagagcgaacattaaccaacccctctaggagggtgtggagcaggaactggaagggtctgggccttgaggctagctgggaaactaatttggaagttgagacaagaatttataaaagccggaatcagggctgtagcatagagatgcgaggaagagctaaatgcatgaagagccaatgagatggatgctagggtctgtggagagtgaaggagaggagtctaggacaatctca

SEQ ID NO: 148483 - DNA, 148 bp, Homo sapiens
gactctagaggatacctggcacatagctcagttgggtggcgggggagatggggcacgaagggttggtgtttctggacccagagattgagacgccccaggaggcctgaggcgagtgtcaggctccagtccagccgcccagagctcctgc

SEQ ID NO: 148484 - DNA, 285 bp, Homo sapiens
tcatgtagtccagctactcggtagctgaggaaggagaattgcttgaacccgggagacagaggttgcagtgaaccgagatcgtgccactgcactctagcctgggcaacagagcgagaccttgtctcagacaaaaaacaaaaaaccctaaaagaaaacaaaagaaaataaaacaaaaacaacctctgagataatcaagtgagagctatacaaatctccaagttatgagggaggaaagccaggagtgagactgaaggcagagggcttggctgctctgaatgaggttaa

SEQ ID NO: 148485 - DNA, 110 bp, Homo sapiens
gccaaattggggaggtcattgatgatacataggactgtggtagaatttcaaatggcagttggagtagaagatttgggagctatgggatttctatgctgcatacaattatc

SEQ ID NO: 148486 - DNA, 379 bp, Homo sapiens
actgtgaggtgttctgaaccaaatccagtttattaaaatgggactcaggtgtttgaatgtgatcccttctggcatgaaaggttaattgaaacttgaaaggtggggaaaacagatgccatttaatgtgaggagctttgatgaattgcttcagcccaacggttaaataactcaagacttgatgttccattttagtggctttgattgtttttaggtccctgtgtgttttttgcatctgttttattttgcagtaagtatctgactattgtgttgaagtaggctgaaccttgaaaacactgatggctgtttcagcatttttaagcctagtcacttatggagacaggcctaaaacaatcccgttcatcctccccattctcacatt

SEQ ID NO: 148487 - DNA, 460 bp, Homo sapiens
gacctcaagtgatccacctgccttggcctcccaaagtgctgggattacaggtgtgagccaccatgcctggcctcatatcatttataaataagagtaatttgactagttcctttccaatttggatgtctttatttcttccttatgtaatcgctctagctaggactttcagtactatgttgaataacagtattgaaagtgggcatcctttttgtgtttcatatcttagaggaaggcttttaatataatactaaatggggaaaacagtctgttatgggtctgttgtatatagctcttactgtgttaaggtatgttccttctataaccaatttttgagagtttttgtcatgaaaggatattgagttttatcaaatgctttttcaacatcaattgaaatgatcatatggtttttgtcttttattctgttgataggctgtatcacattgatcgatttgtttatttg

SEQ ID NO: 148488 - DNA, 112 bp, Homo sapiens
ctctgttccttccaccttggaattgctttaaaatatttccatccattatcctaatactatcttagtattctagcccttcccccttaccatgtagacctgacaaagcaaaaca

SEQ ID NO: 148489 - DNA, 576 bp, Homo sapiens
aatccaggaggttgaggttgaggtgagctataattgcacactgtactgcaccctgggcaacaaaagagtgaggccctgactaaaaaataaataaacaaataaaataaaaggatggttaggatttcaacaggagtctagtaaagatgcttaatataataaaaaaattatgtcaaatattacagccccagattgactgttcagtcaccagttgtacaaattcagccagattacttaatccctctgattgtcagctttctcatctataaaatgggaattgagtaatagttatcatagaaggttttaggaagatgaaatgagacactgtgatatgaacatgctttgtaaagtataaagtattgtataaatgttagtaaattttatagtaagtaggccaggcatggtggctcacacctgtaatcccagcactttgggaggccaaggcgggcagatcacctgaggtcaggagtttgacaccagcccgggcaacatggtgaaacctcgtctctactacaaatacaaaatttagccaggcgtggtggtgtgcacctgtagtcccagttattcgggaggctgagg

SEQ ID NO: 148490 - DNA, 463 bp, Homo sapiens
aagcagctgccagaacagaacagtgaactcaaatcccttggagccatggccttggagcagcacgaacgctggtggctctgtccagaacatgcgaccctctgtaaccaaagccagcaggttcagcagaatctctgtcttcacccaaggtgactgcattggcagcagtaaatgtgccaatgcaggaaggatctccaggccaggtatggcactatatgccccagaaatgtgcaaccaggtcacctcatcccagtctatcccgaaccttctcccttgttcagcacagcagcagcaggagcagcagcagcagcaactttgtgctctcccacccacgcctcagcaacagccacccttgaataatcacatgatctcacagacagatgacctcagcaagtcctttagacaaatgagccctagctgccaaggttctactaaagcaactgactgatcggcagctctgttccag

SEQ ID NO: 148491 - DNA, 332 bp, Homo sapiens
tatcagcttcttattgggtaaatatgtgtgtatgttgtaagatttttctgaggctaccaggtaagtcatgtaaaggatttaaaacagattctcagtatatggtagctgccacagatgggattctagtctgaatcaaacacaatttgatataatgttttgtcttccttacaagaggtaaactcaagacaatcatcatggaataaagccattttccctttttcatgcttctccacagtgcatgttatctctcttttggcaaagaaaattccaagggtgagataatcatttatacggccattcagtgttttttgcagtgctcccaaattcgggtg

SEQ ID NO: 148492 - DNA, 724 bp, Homo sapiens
tatatggtcactcagcttgcaaggggagaagcctggatatgaactgctcttgtctaaaaaatacccacctctgaggctgggcgcagtggctcacacctgtaatcccagcgctttgggaggtcaaggtgggaggatcgcttgagctcaggagttcaagactagcgtgggcaacgtatcaagaccctgtctctccaaaaaaatacaaaagttagcctggtgtggtggggcatgcctatagtcctagctacttgagaagttgaggtgggaggatcgtttgagcccaggagattgaggctgtagagagctatgattgcatcactacattccagcaagggcaacagagcgaggccctgtctcgaaaacaaagaaaaaacccacttctgagcaggcagtggttgctcatggccatttgcacaggtggggacagctcttcactgtttgctaggctggttcccactaaatgctgctgctctggccagagggttagagatagaaaaaggggctgaagacctcctcctagccctcccagccccaccatgtcttcctactcccccaggcctcagtcacagcagacaataaggatgccctaaccccttatccctgtcctgaggctctcatgttcttgaagatctcctcctacctccccggcagcctcctctctacctcctttgcaggcccctctgaataacagtgccctggccaatgcattggggtgcccattgtc

SEQ ID NO: 148493 - DNA, 297 bp, Homo sapiens
attttaaagataatggctaaatgcatttactgcatgttttattgagctccagtgaaatcggtcacatcttgtagtttgtcctaattaatagccaccccagaatgtaatgtcttctgttaaaaaaagagaaaacctgttcagctggttcagctgtcttaacctaaccaaattcatattttaactttgagtatggtaatgactaccaaattacagatattttagatactattttcagcttctaaaaggtttgggcattgtttaaatactattgagtaatgaagtgggatgaggggaaca

SEQ ID NO: 148494 - DNA, 423 bp, Homo sapiens
  misc_feature (353)..(353): n is a, c, g, or t
  misc_feature (389)..(389): n is a, c, g, or t
  misc_feature (400)..(400): n is a, c, g, or t
  misc_feature (419)..(419): n is a, c, g, or t
attgggccatctttatttttcaaattataatcagtaaggtggtgttaaaaccacaaatcaaataggaatatgtctaccagttaccctggatcattgtcttattcccagcaatcttcagcatgtcccctgatgtaattaaacagtttgtggagtttccctgttcggaactgatattcaaagttcagttacacaaaagaaagaccaacccagattgctgtctcacattctccctggcacagaaaaacatgcaaggacagtgataaagagtaatagacttaaaggttattgtcttccgcctgtctgaatccagtgctttcctccgcatgttgttgtctttctaaagaagataatgncaacctccttcatttttttttaccttgctccactgncttgggtgttnctcttccttctttccaggnacag

SEQ ID NO: 148495 - DNA, 377 bp, Homo sapiens
tgaacgcctccagtagcacagaggtttctacggcaagaagttgccccttgccagcctgtcaggccctgtgcttgctacactgtctagcccccagctctggtgggtgtgaggggctggcaccaaatatgccggtggcagcggtgccaaagcctccctcagaccctgagggcatgggtctggcggcagtggcaggggagagatcaagctcgcagtcctgaggctggtgagtctgagcaaaatgatatatttaacatcaaatatactcaaggactattaggattaagtattcaagatgaaggggaaagtgaaaccctctgagctgcagatgaggcatctcattagaagcagcgcttttctgttttctcaaagcctgactt

SEQ ID NO: 148496 - DNA, 256 bp, Homo sapiens
ctcaacgctttatacttctgccattttaagttataacattaccacaccactgctctgtccctcaccagcaacagcccatggaatctgtccattgtctattctcttaggccaatatcatccttccaaactggtcagcctgcttcctgtgcattctctatcatgcaggcagagtgatctttctaaaacttaaagccaatcatttaattttcttgcttaaaacacttcagtggttaccactgaagtataaagcgttgaa

SEQ ID NO: 148497 - DNA, 890 bp, Homo sapiens
ctgttgcctaggctggagtgaaatggcatgataattggctcactacaacctccatctcctgggttcaagcgattcttgtgactcagcctcccaagtagctgggattgcagaagcctgctaccatgtccagctaattattgtaatttttgtggagatggtgttcacaatgtttcccaggctggtctcaaactccagacctcaggtgatctgctcacttcagttttccaaagtgccgggattacagtcatgagccactgtgcctggccataatcttaattttagaaactttatttttgaatgtatatattgaatgtgttttatgtataaaggataaaaaatagaataaatctttgtagctgatgagaatcatgctgtgattactttttatatatcataatatgaattatataatattatataatatgcattttaatacatcatcttgtgatgtgttttaattattaaagttgaatagccccactccaaatgatacatgtattggaacttcttttgcaacaatttccctatcttgtatttctgaaaatgtaatcaaatgatttagctaattcataactctttcaaagcacgttttaaaattaggaaatggtccgggcatggtggctcacacctgtaatcccagcactttgggaggccaaggtggttggatcacctgaaatcaggagttcgagaccaggctggtcaacatggcaaaaccccatctctactaaagagacaaaaattagtgaggcgtggtgcgcttgcctataatcccagctacttgggatgctgaggcaggagaatcacttgaacttgggaggcggaggttgcagtaagccgagattgcgccactgcactccagcctgggcgacagagtgacacttcatctcaaa

SEQ ID NO: 148498 - DNA, 111 bp, Homo sapiens
ctgagagcagggagagaaccaggtctccaattgatgtagctgtggggattaaaataaaatgaacagaatccaggtgatatggtttgaatctatgtccccacccaaatctca

SEQ ID NO: 148499 - DNA, 527 bp, Homo sapiens
cgccatggctgactcttgaggatacacttcctctcctcccacctcggcctcccaaagtgctgggattacaggcgtgagccatcacaccctgcccaactgttcctttcttaaggggcttcaaaggtggggagaaataaaaagtagcttttcttctgggaaatgttacatgaggactaattcagtaaaatataatgtccctgtatcattcaatcttacagagtatttgagcagtctttctagctcccagttttaaagagggttttgataaatttgagcacttgtctaagaaagacagtgctcaaaggatatgggaagaattgtgaaaatatctgcatctctttatttgaagaaaaattctattgacaagaggagttaagtttatttcatgtggcttcagaaggcagaagttggattactgggtggaggcagcaggaagtagatatctccttaaaataagaactttctaacatatgagagtggaattggacaccttgtgaagcagggaggaccctgtgcttggagtcttt

SEQ ID NO: 148500 - DNA, 270 bp, Homo sapiens
tgcccacgatgcctgggtaaaagagaccctaaatggtcccagttctgggctgtttagactcagatgctgatggtcttaaggacctgttcatctccagcccagtgcctccctgacaaaggcttggtctaggaagagctgaagggagaaaccaagagtcagtctttgggtgcaactaaacctgccccaagtcacttagattttgagaacctaaaggatgctcagaaataatctggcttacctacccacttagaaaaactgtggtgttttttg

SEQ ID NO: 148501 - DNA, 187 bp, Homo sapiens
tcagaaaaattgaagttaatcatcattaactgttgggggagtagctaccaaatttgataaaaactcaaaaattcgtaataattcagaaattgagaatagcggccgggcgtggtggctcacacctgtaattctagcactttgggaggctgaggcgggcagatcacgtgagctcagaagttcgagacca

SEQ ID NO: 148502 - DNA, 421 bp, Homo sapiens
gcaagccggtgcagcgagagcgggctggggagaggtaaggcatgcagcctggctgacccacatcgcggagtatcgagcacacaaagcaccctcctccacggatacagaggcagcaaagacagcagccacaagacagcccaagggaaatgtgcacctgggagcttcccataacttctcaggtaaagaagtgatgtcaggcaaggaaccacagcccagagcaagcaagctcatcccaacctcaaactgaaatatgtgacatcaactaatagctctacgagaatgatccaagcactactcttaaaggtttctgaactctctgcaacgatcaatgttttcgactccctaaagcacatcagcaatttaaataaactcagaacaatttaacatcttaaatccatcagcctcaaatgtgatcgcacaa

SEQ ID NO: 148503 - DNA, 105 bp, Homo sapiens
aacttattctctgattgtttggctggctggtttgtagaatcacttgagaccccgataagaaaagaagatgaaccatgaactgcttttatttacatgtcagctgcg

SEQ ID NO: 148504 - DNA, 379 bp, Homo sapiens
gggaaacatgaatcagctgctgcattccgttcactcattcactcattcgctcgttcatttaacaaatgtttactgagcacctgctaggtgttggctgccgttctaagtacaggggacccagcagtggacagaatgggcaaaaatgccaaagctctctatactccttcattctgtgagcactgactgagcacctcctgtgtgctgggggcgcaggcagaccaaggccctgcctcaccaagctgatgttctgatggggagagagtaaagaagtggacaaataaggggaaatcaggcagccatcagtattgtgcagacaaaacagtgtgaagccggagtgcaggagggagggtggccttggggctcggtctgactggagggt

SEQ ID NO: 148505 - DNA, 365 bp, Homo sapiens
acctctcaagtagccggaattacaggcacctgccaccacacctggttaatttttgtattttttgatagagacaggctttccctgtgttggccaggctggtgcctctttttaacatggatttttaaaagccacgtgtatggagactattccttgttgtatgttttgcaaacattcttcagtttctctccagtctcgatactgtgtttttgtatggaagctgcaaattcttaccaagtccatcctgtccctatttatattttatgttttccattttaatctggtaagacgggcttcccccctaatatttttacctgcttttcccttttgtgtgggcagagaggagcccaagggggtggggagagggc

SEQ ID NO: 148506 - DNA, 191 bp, Homo sapiens
acgaatcgcttgaaccgggggggagatagcagtgagccgagatggcgtcactgaactccagcctcggcaacaagagtaaaactccgtctcagagctggcgggggtaacctcccaaaaggatttttatttgtaaatcatactgagatttctgtttctcgtttctaattcattaccttttcttttaatttcct

SEQ ID NO: 148507 - DNA, 417 bp, Homo sapiens
gtgaatcagaggtggcagagatgtgtatagacctctgcctgagcatggtctatggttaaccacgtcagatccatggacttctagctcctccctaacgttctccaaggagaaacccttgaagcaacatcctgtgtagtctgttgttctattattgaacaattcattctgttaaaaagttctttgtgaaatcggtggccccttatatactgaggggggtcccagaggttccacctgccttagaatatctcattgtcacatgcttcccttgtttcttctcccctgcttgacatggtcctaatgttcacacctcctacctgacaagtcctccatgagcaccttgggtctctctgctcacctccagacctctgcactgtacagcacaggatggttgtgaggacctgcaatcccacagtttct

SEQ ID NO: 148508 - DNA, 369 bp, Homo sapiens
aagctaggagtgactccttgccaacagcaagccaaaaaacagggatctcagtcctaccactgcaagaaactgaatcctgctgacaacctgaacaagtttgaaagaggactctgagctccagatacgagtgtggtctggctgatatgtttgttttggccctgagcagagaaccagctgcactctccctagacttctgatgtatagaaattgaaataggctgggagtggtggctcacacctgtaatcctgtaaaggctactcaggagagtcacctgaacctgggaggtggaggttgcagtgacccgagatcgtgccattgcattccagcctgtgcaataagagcaaaactccatctcaatttacaaaacaa

SEQ ID NO: 148509 - DNA, 352 bp, Homo sapiens
gggacaatgaggaaggcatttggctggaggaacagcgggagcaaaggcagagaggcgtgaaattgcgtggagagagccctagatctcagcaataaagctgcggcccaggcagggcagggaggggagtcctgatccataaaaagctgtggccatgggtgagcagaagaaaggcaggaaagggctctgcgacgccacactcagtctgggtggctctccccagccttcgcccaggctggtactggaattgacagttacgggatcctcagcccagccctcagccataccacggccagagaatcgggcagggcctccgaagccaaactcatttctgtgtctctcagccccttctgtt

SEQ ID NO: 148510 - DNA, 231 bp, Homo sapiens
cttctgagaaggtgacacttaacagtggagtgccccaaggctcagttccttagacctcttttctatctatatcccttacttagtgttctcttccagtctcatgattctatgctggtgactctttgtatctcaacctggacctctgccccgaattccaaactcatgtatccatttgcctacttggcatcaaattttcatgtttcaaccctaatgctgcccaaactgaattct

SEQ ID NO: 148511 - DNA, 672 bp, Homo sapiens
tgggacggagctcgctctgttgcccaggctcaatgttacagtgaataagagggacaatgagttagaaaaccaaagagttagaagcaactctgaagctagaacacaatctagagctctttccaaggcattaagctgccttgcaagggaatctggaaacaatgaaatacaactactatttataaatgtgaacacaatggggacagacacagaaatgttttagggcagtttagaaaagttagcattacgttttacaacggaatttgtgaatctcattatttaagtagggaaactgaggcctagaaactcacaaggccacagttatcaagtggcaacactgatcaggaagtgaatccatgtctgtctgtacttgttctcctaaccacatatactgtctggaaacatactcagctagagggaatatagctgtgttttacaaagtatgaaaaaataacactgattttgtcaatttgactatgggctaatgaatcttaaagaggaagtacacgttactgagaaaaaatacatagcttgaccagcctctttaaagctgaaatttctgtatctgctggaatattctataatttgaacgtactaacgaatagattaagagaagaaaactggtttcttgtcccaggttcaccattaaccatttgtaccattttgagaatgtca

SEQ ID NO: 148512 - DNA, 510 bp, Homo sapiens
tcgagctcggtccaatcatccagtgtatcatcttattaaaaagtacaaagtttcatgaactttcaacaagactgcaaaataaatatgccaggtaggttgagcctatccaagtgaaaacaaggttatttgacatttagtgagagtcaatgaaaatatgaattatttcaaaggaattcatgatccaggtaggaggatttagatcctacggtatgttagaataaagctagtttctagcagattctgttaacagctccagactagaggggacggagtgtgctgctttccattctcttctctacttctgtcactggggagaagatacacggatcacagctctgagaagtgtgcattaaagcacatttgctaggctgagcactggaatggtgtgggctggtgtgaaaatgaagcctacgtcttcttggaccctcccagagcccttcacctcaagggttagacatctctccttctctaaactaacagcagcactcaatccctggtgtgtccgaagtg

SEQ ID NO: 148513 - DNA, 319 bp, Homo sapiens
gtatgccactaagtcatcttaactgaatggtttgaaagtaagaggtgagaaataccaagtagccttttctttctctctctttctttttgtaccaattaaattgatttggaaaaggagaagcccacattaagaaaatcatttatgcctgggtgcagtggctcatgcctgtaatcccaacactttgggaggccgaggcaggaggatcacttgataccaggattttgagcctgggcaacatagtgtgaccctgtctctacaaaaaataaaatcagctgtgcacacacctgtagtcctagttactcaggaggctgaagcacag

SEQ ID NO: 148514 - DNA, 337 bp, Homo sapiens
agttcgacggagactctccccgagaagccggcgggagccccggggagagtctcttttctctgtgagtgtcttagggaagagcattgagggtaaagagaacggcgaatgtaaaggccttgaagggtatgtttgaggaacagcaaatagaccccggagtgcagaggaaacgagaaaggtagaccttagtgatctgcataggtcattgtatggatttgggctatttactgtcagtgaaatggagagtactgcagggttctaagcagaagagtggtgatcatcaaatacttaggatgctcacagggctcgggtactgagggtgtacaggtgaattcttcca

SEQ ID NO: 148515 - DNA, 138 bp, Homo sapiens
caaatcatgaaaatgccagggttcacgccaagaagcaagaatgaaattaataacgaagcacatcttcagagaggtttatcactactccagcatgacccagccagtgagtagtgcaagggaatacaaatccccttggac

SEQ ID NO: 148516 - DNA, 436 bp, Homo sapiens
tttttttctgcggttggattattcatatatccacccacgaaaaaaggccttaggcattcctgtaaacttatatttcatgaagaaagtcagagtacttgttgcagatgcaatgctaggtcttcagccatgtgctatagaaacagaaggtgacaaatataaccaaggattgggaggagaaaaagaagaaagccaatttgggaaatgagactgtaaagtttataatgctactgattttcaaacattttcagaagcaatggaaagaagaatgcgaagaaaatgagtttattttccaaaatgctttttttgttattgttttgcaatttccctttgttaacatcatataggttatgggggtttctgttttgaaaaaaataaatactgcaccgtgtgtggattgctactcagcactcagcaataaacaagtcaatgaatgctc

SEQ ID NO: 148517 - DNA, 367 bp, Homo sapiens
ccttatctgcctaaagcaaataccacttaagctctaggaactttcctgcaccctccttccctgcccatgtagatgtatgtgtgagattttttggcaagtttctctaatctggaccgggaggatggaagagcaaggaccccatttcagtagtgctcggaaaaaggatgcgttgaatttctcagcccttctccacctcacataaacacccgcccaccctgcacccggatcctgggtcataattttaataaatgcagaaagagaaagtggttggaggatggagcacatggaattcaggagaaaacccacaaagacccctgcatgtcagacacaccctgtcccggagcgtggtgtccccttgagctttaat

SEQ ID NO: 148518 - DNA, 513 bp, Homo sapiens
tggggtgggcatgtgtgagtgggcacgcatgcacatgtgtgtatgcttggtttcaatgatgacacttaagatggacttagttcttaagccactgtgtaaacttgttcagactctctacaaataaaaccactataacttttttttgacagatggaaaccaaacatcttaattttgcagattcgtatgcactgataactgtgagaaaaccattcccaaagccctatagaaataaatcattttgcccatctaaacatacctgagggatgggacacattactgtcagaatcagtggaatgatacccagacagctttgagccaaatatagggatcccaaataaaaatcaaggctcaactttttgtttgtttttaccatatcatgttgtgaatgagttcttccataaattttaatgagatgaaatttttggtgccatcaagggcccccaaacacctaattcaattcaactaataaaatgattagaagagagaaacaatactaaaagtatagattgacta

SEQ ID NO: 148519 - DNA, 268 bp, Homo sapiens
tgcaaacacctcatcttccgttagatcagccagcttacctggagcctgcaaaacctgaacttggggctcctggcctctattccattttttccatttctgtgagggttaagaggttctctgaaaaagcctgggaaattttatagtacaactgaaagggtgtgcactactttgtggaggctaaaagcttaacttgaaatgcatttttttttttttttttaagggctggtttggatttccaatgggctggatctaacgaaaatcctggggt

SEQ ID NO: 148520 - DNA, 234 bp, Homo sapiens
tgtggtgctggtggtagcagccagaaaatatagaagataaaagcattaattacatgaaatagtatattctgtattgcacaggagtatttttggttttgaatgaaagctgtgccctggaaaggatagcattcattttttaaggttttgagaaacactggatgactagtttggatatacattttggcacattctgtttgaccatccagctggagaataatatactaagcttaagca

SEQ ID NO: 148521 - DNA, 358 bp, Homo sapiens
aaaaaagaagtttttttatatcccctaaataaaaagaagaggtttgtagaatattcggctatagtaaatacacactgaattgagggaggaaaggagactaaggaaaccacaatcaagacaaatccaagggtcctgagaggaagggttaagtaggtcagacacaggtaacagaattccattcaaaacacaaacttctccaactgtttacatttcctcctattttcattccaaacctgctctatgcactgaccttctcacccattctcccagaaccattttacaaagacctctagtactcctgtaatcttaaactatggtcaaattcttgagccaggcactgtgctaaacattcataagc

SEQ ID NO: 148522 - DNA, 301 bp, Homo sapiens
aatttgtgatgcatcatattatgaggtttcatgatatttgtcaggataaggtcaaatgtgcaatccacactgtaaaaagcatagcttacttctatttatgtaattaattggagtctttaacagaggaaaatctttaagtgtttttgttgccttaaaaaatagctcacatgccctatttacaaaaagtaattgggttatctgagaacttacaacacttgagtatcattatatgaaggaagaaagtgatcctgaagaagctatatttattttctttattataaaacttgaactattttaaaat

SEQ ID NO: 148523 - DNA, 257 bp, Homo sapiens
ccgcgcccagccaataaaatttactaaaaaagcaaaactcttaatagctccagctacacactattcaagcaatctactctatcattacatgctaggcatttttcaaaatgccttttgattgatttttggaattctctaaaagcactgaactcttagaaaagtatcaaaatgataaccatctgaagactaagaaaatagagtccttaaagtcaagctgagtctgctgttagcctcctaaatgaaaggatagacagaac

SEQ ID NO: 148524 - DNA, 584 bp, Homo sapiens
ttcctctccttttacctcctgtcaatctagattaacagcgcagatccaggctaaattttgctactatcagtagtgattagtgtgagttgatgaaatcggattatacaggcggacctctgccttccccctcagcaagcaacaccgtgtgattagaaagcctgttgtccttctcttcaccggagtgaagcattctggaaggttctgctggagggaatatgctaccaagaaaacatttggccaccagaagctgctcagaaacaaatagaggtggaaggaaccatctatttcactttttactttttcttccaaattctgatgttcttttagattgaaaggtcagttacaacagaagaaatgcatgttattattttatttcattgagtttttttcttcctgggagaatggtcactttgaccaagagattgaggtgatgggaggtgacagagggagccagaaactggatgtcacttttcttgagcttctattatatgcacaaagacatttatatatactcagcctcaagcaatctgggaaataggtattaacataaacactttaaagaaaaggaggccaggctcagtggc

SEQ ID NO: 148525 - DNA, 752 bp, Homo sapiens
atagcggaacacgggacgttgcaggacattgattgcaaggactctggattttgctccacatgagctgagaaaatcttcagaggtttttgagtagagggaacgatatggtctaactgagatggtaataggatccaatggctgctgtcttgagaaaaacctaagtgtcaagggagatgtatatggaggccatcctaaaggtccaggtgacagatgacagtggtttacaccagggtggtgggtggtagcagtcgaggtggtaaggaacggctggactctagctggaatttgaaggtagagccaacaggatatgctgaaggattgtaaatagggtgtgaaaagaaaagaaaaaagtgagtcccaagttttggatttataaacttggaggctgaatctccactggctgagatagaggagtgtgggaggagccggtttggagggtgaggaggaggagcaagagcttatgaaagtgtcaatcctcatgggcggtgtattatttttaaaagtgtcttactacacataggtttgtcctgttccagctacagtgtgaggctgaagggacttatcaagtacataattcattgaaaggctacgaagggataaagaaaaataacagaaggtccctgcagcctctggcttagctggggagacaggatatggacccatcatgaaacattaacaggatgtgacagagaaccagctgtcaccagacagcacaggactgtgttgtcatgcccacaccatgtcgcttacca

SEQ ID NO: 148526 - DNA, 409 bp, Homo sapiens
tacttagcaaaatgtgttcagaatgagcctctgtggagagtcaggcgagtcatgtcccatggtagtttagcccattttaatggactaaatccaggtcactggtctgtcaagattatgtaactaatggcatatccaagactaagcacctgtctctgcacttctgctcctacttttgcccactccaactcacaattctttgcctagtggtacttcatgaatactgtagactatggaacactcctggtttttttttttgagacagagtctcactctctcgcccaggctggagtgcaatggcacgatctaggctcactgtaacctctgcctcccaggttcaagtgattcttctgcctcagcctcctgagtagctgggattacaggtacccactatcatgcccggctaattctt

SEQ ID NO: 148527 - DNA, 240 bp, Homo sapiens
cagtttttaattcacttagggtccaagccttcatatgaacttaatttggcttattacttcctcaaacatacttttgactagcgtatgaaaaattttcccaaaaactgatttccaaaagggtacaaattttggagactaatttttaatcagctaaccttcccccaaagagaataacaacagaaattttattgagcaccccattttatgccacagattataccaggcacattatatataatt

SEQ ID NO: 148528 - DNA, 229 bp, Homo sapiens
cccaccttagttttgtttttctctctcctttctagtttatggtagtaattaatggtagatgttgtgggttctccaggaaggtattgttaagataacagtttctgaagactgataagtctgacatgacagatgactacttgcagtcacattttaaacatactttgaactgatgaaaatcatttcaaaaaagagaggccgggtgcggtggctcacatctgtaatcccagca

SEQ ID NO: 148529 - DNA, 393 bp, Homo sapiens
caggtagatgctggctgggtacagaccaggggcctgttctgtcatctttgatgggacctggcccccaagtaagtcatctgtttgggtgtgccctacaacacaccaataacttttggggcctcagagaggctgtttttcaacaggacaagcaggctgcggcaggatgtgggtcagggctctggggacctaattcctttcctctcagtggtgcagtggctgtaccagggaggtgcagatgtgtttcctgttgcttttgcagcaggtgaaatggtaggccccagctggccttctcctctcccctatatttcctaccattgaaggggctatacctgcccccagcccctccgggggctccccacatagtccctgagattcccaggaaaaactcgccta

SEQ ID NO: 148530 - DNA, 377 bp, Homo sapiens
cttaacatctgtttctgtaacaacagcattaattgtgtactcacttttatcaacttaaacatcatccattccataaattttcatcaaaataccggttgaaatagcctacttatctaccatacagtttgacaggatttgatttgaatatttttgtcccttccaaaattcattttgagactggaaactcagtatgacaatattaaatggtagatgaccaggttatcaaggtggagccttcataaaaggcttgtataagcacccttatacaaggggtgaaggaacaacctagctagtcctcttgtatgtcctcttgtgaaggggtgggttgcccctccacacctgtgggtgtttctcgttaggtggaacgagagacttgg

SEQ ID NO: 148531 - DNA, 273 bp, Homo sapiens
ctaacgtttctagtaaaaactttaatgacaaagaataatactttacattttattgtactgttgggatagctatcacataaccattctctttatcaagccggtatttgcctatccataatttccactcaagtctttttttttttattgagacgaagtttcactcttgttgcccaggctggagtgcaatggcatgacctcagctcacggcaatctgcgcctcccaggttcaagtgattctcctgcctcagcctttcgagtagctgggattacagg

SEQ ID NO: 148532 - DNA, 543 bp, Homo sapiens
acaacccctgtgccaggttaagggatttatcattttgtcacctgataaatgattcttggatatctgcttgacaccagcacaattataagcagatacgacgatggaaaacacttcctgagcccttctgtttctgctgcgtgaagaagacactaatcatggtcacatataaggggccgtgatgtgacggtgtgaaatgctgtgggactctgcaggtgcagtcgcttgagcgagtcttaaagaacgagaagtgcttcgccacgtgtgtgggggattatgggtattccgggcagagagaggggaggtgcaaaacaagagccacaggacggacccaggaaccctcagaggactgcagattctccacttgagcgaaagcacagggagctcatatgatgaaggtcagtggggaccagatgacaaatgccccgcattcttcctgcagcaagagggaaatgagtgaaggacctgctctgaaaggaccaccgtaggagaactgggagaggtgaccttaaccctgaagctattctcagtcttgaaggaaccaag

SEQ ID NO: 148533 - DNA, 391 bp, Homo sapiens
caatcaccccagaaagctccctcgtgttatccctttgtcattccattcctctcctacccctaattcctaacagatcacgaatcattgatctgttgtctatcactatggttttgtctttcagaaaatttaatataaatggaatcatgtagtatgtaaccttttgagactggcttcctttcactcagtgatatggtttggctgtgtccctacccaaatctcaccttgaattgtagtaatccccacatgccaagggcagggccaggtggagataattgaatcatggaggtggattcccccatactgttctcatggtagtgaataagtctcatgagatctgatggtttgataagtggtgttcccctgcacaagttctcttgccagcaactgtgct

SEQ ID NO: 148534 - DNA, 221 bp, Homo sapiens
cctggttgacttacactctttggagtgctgactagtatagactctcccaatgctgccttttggatgaatcctgtgatgccacattttccagccttaggacaaatgataacctaccctgtagtctgtccatgctctggagaccctgctggtcttacaagatgaactggacaactgctttcactgataggcctgaaggaaaagggttggaactgtcaaggttc

SEQ ID NO: 148535 - DNA, 429 bp, Homo sapiens
acataaataaataaacaaacaaataaataaagttggcagagtatatagtctgaaggggtttgaggaaaggggattcaggtgactgagaagttccgatgggagaagtaggatccaatagagagaacagagaggcctcacagtgggaagaaaagactgccagcccaggagtcagggagtgaatccccattcagaatgaagagccacaaggaagaccttccaacccaggaagtattatacctttcaaaagaaggctgggaccttaaaaatcaaaatctgtccttaccagctaaaataaaagtttttctacagtcatggctcaggagtttgactcaccagtagatccccaatcagccagtcagaagacaaaggctgcaaagttgcacattgagagtcctgggtcagaggcctgtggcaccacaaccattaaag

SEQ ID NO: 148536 - DNA, 465 bp, Homo sapiens
tgtttcaggaaccgcaggcctaggcaggagcacattcaaagtaaacagagtgattctcctttctagaaagaaatgctaattccctccaatccagtaagtctacgggtaaggcaaaggtcgaacagcaactttttaaaagaagcaaagcctgctgtctcctttggaacacagaaaactgttccagcagctgggggaaaagtcccgacgctgggcacagggctagagacgccctgctacaaaacgcttatgcatgaagagctaatccttgtgccaagtagacacggaggctggctgagtgaagatgggctggagaattaactctgcatcacacattgaacaggtggaactggccaggactcccagctctccaacggtgagacggacacccaggtggacaaggtggcggcctctccacatgcatatgccgagccccctgtcccatcccaatgtaacgactgatggttg

SEQ ID NO: 148537 - DNA, 156 bp, Homo sapiens
ttacccaaagaagctggagttaagattcatttgttcattcaacagttggtcagtgtgttcctgctttgtgccatataccaagctggcatatggtaatatagtcatgagtatgatattggcctttctacaaggaattcagtggggaacacaaacatt

SEQ ID NO: 148538 - DNA, 409 bp, Homo sapiens
gagacgattagctctgggaacggctcgttctggcaggacaggctgagttcagaagcagcctcctgcaggaacatttgaccaatggctcggcaaagacctaacctgcacgtttccctgtgctgcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaaggtagccaagggagggtgaaggagagtattccagaagagacaacagcttaggcaggcaggacctcgccatggaggaaggtgctttctgatcactgcgggacacctgtgtgatagctc

SEQ ID NO: 148539 - DNA, 514 bp, Homo sapiens
atttacttgtttgcttatgctgcctcccattctgatttttatttttgtaatatgtagaataataacatgctttcaaaagtcaaaattatacaaaaggcatacattgcttttgtatcccttccatgccatttttcttcagttttcttaggtaaccaacttaaatgttttctgtcttatccttcccatttcttttttttgatggtatctgtatgttttatttatttatttatacaaaagatagcgtactatatatactcttgcactttgctttttttcctacttaactgatatctcctggaaataatgccctatcatgccaaagagatctttcccattcatttattttaattgtagtaaaatttacagaatataaaatacaacttttttttcttttaaagactgaatttggctcttgtctctcaggctgcagtgagccgagatcgcaccattgcattccagcctgggaaacagagtaagattgtgtctcaagacaaaaaacaaaagacaaaagaaa

SEQ ID NO: 148540 - DNA, 561 bp, Homo sapiens
gattatagggagatttctctgatgtcaatgctaaggcagccagaattctggagctatgaaaaatagtaatggtattttttttctttaaagtggaacatgagcctattaatatgcccagtagcatttgattggggtcctgaaataaaggagcccttctagggatagacttcacatattgaagtactctgtccccaaatttaattatcttagggcataactacaatatatgatagaatgtacccttttatccacagcctccagcaatttgctgagatggaaaggtggcctattattgaatatatctccagaaaaaaagagatttcataaatttaatcaatagtacattccagtagcttacaactctcagaagcatcacggtctcccttgggcactacctataatcctctggtcataatttaaaccaatttcttttcattctatcctctagttgccatctgcctcccatatttctctcatccttcagctttatcttctactttattttgtcccttcaacctttccttaacagattctgcttcctaattcttgaatcattttcac

SEQ ID NO: 148541 - DNA, 309 bp, Homo sapiens
cagggccaaactatcacaaatcctatgcaaaaccttgagcacagctaactggccttctgtttagtctacatttctctatccagtcatctgagaacatgtaaagcttcattacattcttcatcaaaagttagacatactctgtcaaagtcattcattttcatgatatgcctatcagtctagaaaactcatttttaaaaaagggggaaagaaaaagacacaataggttgttgcacctgataataggtgggacacacaatgggcttctctaacccattaagtttgaaagttaattcctatctttgcttagaa

SEQ ID NO: 148542 - DNA, 424 bp, Homo sapiens
ggtgtgtgcccaagagaacttgaacaggtgttcaaacaaaacatgtacatgtgaggcaggaggatcgcatgagccccagaggtcgaggctgcagtgagctgtaatcgtgccacttcactccagcccgggagacagagcaagaccctatcttaaaaaaaaacccacatggacatgaacgtccatagcagcactactcacagccaccagaaggtggaaacagcctacatggccatcagctgacaaatggataagcaaaacgtggtccgtccgcaagatggaatactactcagccataaaaacaaacaaacgcctggcacagtagctcttgcctgtaatcttagcactttgggaggctgaggtaggaggattgcttgagcctaggaattcaagatcagcctgggcaacatagtgagaccctgtctca

SEQ ID NO: 148543 - DNA, 428 bp, Homo sapiens
tctaccaccgtcttcccttcttttaatgagcatgttgtcctttcagatacataaatacaactccagaccattttctatttgcctaatgatggattcacctcttacttttatcaactaaagtgaaaaaaaaaaaaaccaaacctataccatctttcctaaacaaagatgtttctcttgactcatctcaaaagtctagtttttctaggattggattggtaccaccgagtcagtcacattcatacagctctccttgaaatcagttccatcactttgagtcagtcaatacttgagtagtaatgtctgtgaaacagacttcttcccttcacaaaactttagctgagaaccaagtggcatcagttctcatctaatcagctagaagttaaatagccactgattaagtttcatgggcttaaaataatttgtaagaa

SEQ ID NO: 148544 - DNA, 557 bp, Homo sapiens
caattaatctcagctgagatttataacctttccaaacagcaagatgcaagacagaaaaatgctgctccaaaagttgctgaacttcttgcctatctagaatgaatgtatcaaatatatgcaggctagcactggccctgggagagaaactgaaataaaagagactccgaagtgatcaagcaaatgatatactgctgctttataaaaacattcttcagtttcatgtgtgttccgtctctacatcattaactgatgctcaaaagctataccttctcccagcactttgggaaatcgaggcaggcagatcacctgaggtaaggaattcaagaccagcctggccaacatggtgaaactccatctctactaaagatacaaaaattagccaggcgtggtggcacgcacctgtagccccagctactcagaaggctgaggcaggagaatcacttgaacccaggagcaggagttccagcctcaccaacacggcaaacctgtctctactaaaaatacacaaattagccaggcatggtggcgcatgcctgtaatcccagctactcgggagg

SEQ ID NO: 148545 - DNA, 299 bp, Homo sapiens
cagtgttggaattacaggcgtgagccactgtgcctagctgcattgcagtattagaacaatactgttcttttaggatggattcaatgacctctaccaagcagacaatgaagaaacagaggtgtatatttcatgttatttaaaaatctacttaggtcgggtgcggtggctcatgcctgtaatcccagcactttgggaggccgaggcgggcggatcacaaggtcaggagatcaagaccatcctggctaacacggtgaaaccccgtctctactaaaaatacccaaaaaaaaaaaaaaaaaaaa

SEQ ID NO: 148546 - DNA, 399 bp, Homo sapiens
tggaaaaatcaaaggaaggtcttgttaagatcaaagagtaagtctagaagcagaaatgagtgagagaaatggaaagttgaagaggataggatactagaatttaagtttctggaggtggagtaatttgaggcaatcaatgagatccaagattcatccaagaatgggggtgactaaagttacatggaggtcatagggttgacaaggtcaaggagctgttggatgggttatgtacatggacattgtggtcactcatggtgattgtgggacccgaggtggatcggggccagtacgatggtagtaggtcaaggaagagggctgtggtttaatgcggcagcctgaaattcaacagaagaaaagtttttacttgagggcatagaagcaagggtctgtagaaggcat

SEQ ID NO: 148547 - DNA, 203 bp, Homo sapiens
cgatgagtagaaacgcaccaggttcttgaaataggacgctggacaggaaataatttctgttgccccacttttaaggaaaaattctacaaacaaatagagctctttatcaacagttcagaagtaaaggaaggcattttaaaagggtcaatcagatgtagactttcaatcgtgtttgtgccaaggacagagcctcaagcgtggct

SEQ ID NO: 148548 - DNA, 614 bp, Homo sapiens
accacactcagctcgagttttatagttttagctcctgtatttaggtctttgctccattttgagttaatttttgtgtatagtgtgaagtagcatatagatatccagttgtcctagcatcattatttgatttgtatgtggatatccagttgttccaacacatttattgaaagattgcctcttgcctaatgaatatttttggcagttttatcaaaaattagttgacaatataaatgtaagagtttatttctgggctcttaattctattctgttgatctatatgtctttctttatgccagtaccacactgccttgatggctgtagctttgtaacatgttttgaaattgggaagtgtcagtcctccacctttgttctttttcaagattgtatcagttattttgggtcccttgcctcccttccccttccccttccccttccctttcgacagagtctagctttgttgcccaggctggagtgtgcagtggcgcgatctcggctcactgcaacctctgcctcctgggttcaagccattcttctgcctcagccctgagtagctgaggaccatcgttgcaacgatggtcctcagcttctacctagaagctgatggaaaccgattt

SEQ ID NO: 148549 - DNA, 126 bp, Homo sapiens
attaagagtaagaacaaaatgctgggaggtaatagactatagtgactttggagcgtggacttggaatcaggaattctgctctaccactcctgagttatgcaacattgcacaagttatttcacttcc

SEQ ID NO: 148550 - DNA, 797 bp, Homo sapiens
gaaggagggaaaattccttggcaggctatgtagccctgctttagggctttgctttctggatccaccgcttttcttctgcattttattgtgcatactaaaaaggtgtgagtaggtcaccaaggcacctagtctcttgatgactgatcagctgcccccaaagcatttacattagtggccttatattctatgacaggaaggagttgccgtaagtcagcatttctcaaccccttcaaaagtttgaaattctatttccaaaaaaaatcatttttctctctgctactctatgcctgaaatacaacttttgaatattgtcgtgtgtttgctgtttggttttactacttaagtcttattattactactcctgattattatttaaaataatggttcctctcttcaggtaagtaaggaaacatcaaacctgggtgttacacaagctttacccacagggacactgttgactgggagaagggaaaagcatgtgtgactgcggtgtttattggaggggtttcctgataatattgatttcctaaaaagggggcatcccatcttgtgctggggaaattggaagcctggcaccacaatcccatggggattgaaacggctatccataaatctgcacagtgtgcctgattttgtccccattgagcaactgtaataagaattctatagacactgcaggagctgaatcaagactactgagcaaaagaaggctattgtcagtgctgtgtatgcattaaacacagtagattgccgggtgtgcatcctggaattgtacaatttctcaataaactaagtcc

SEQ ID NO: 148551 - DNA, 153 bp, Homo sapiens
ctgcctttgatgaaggagttaagaaggcccaaagtgactcatgtcacttcctttctgtggcctgcaactccaaaaggagaagaggagaggacgagggagggtgggaaggccattgctcctggttccggggtgcctctccccttgcctgctcag

SEQ ID NO: 148552 - DNA, 416 bp, Homo sapiens
aataatttttgatttatcatatctgaagaaagaaatgataatacatgatattaagtcattcaaaccatatgaagtttaggtaggagaaaaatgtattcttagtgggaacacaaagtcttgactccataaatagcaattccttttctctgagatctggtttatactttcattttttaaaagtcatccccccacagataagtctaaagcctgaaaagctaactttaatattgtaagttcagaggctgactcttggaggtattaaattaaaacttgccaatgcccttgttcagagctcttcacataggatgatattctgcacacacacgtgctccagttatttttgcttcaacatgcgagtagcattttgatagaagtgtatgtccagcaaagaattgctgctaactgattcaaaccag

SEQ ID NO: 148553 - DNA, 358 bp, Homo sapiens
acaacaagagaaagaatttatgagagaattggtcagggaaggaataggattgctcagcaaaggtcagaaaataggagacaacatatttttgaaaaatcaaaagcaaataaagatcacttcaccagactagcttagcaagcagaggacagtgcgattcaagtgctgtggattgtgtgcatcaagccagtcagcgtggagcagcccaggaaagattcatcacagtcatgcatttggaaagtcctgtggggggtgttacagagtgaggtgcttggtattagaactaaatgcctcatctatcataagggactaaccagacaatatttaaaattaatgaaaagccctgcctggccaacattag

SEQ ID NO: 148554 - DNA, 762 bp, Homo sapiens
  misc_feature (139)..(139): n is a, c, g, or t
  misc_feature (151)..(151): n is a, c, g, or t
  misc_feature (166)..(166): n is a, c, g, or t
  misc_feature (263)..(263): n is a, c, g, or t
ggatcactgccatagccagacactgaactaactgatgagaagtgggtgtgtcatagctgtccggtgtcttggggtgcaggaaaattaggtcaagaatcattgcgttagaggtagatgctagagtaagaaagaggatctntgcagcttcagncaaagcacctgtccngcagagcacgtttcccatctgttttttatttgaggtgggatctctgcagcttcaggcaaagcacctgtcctgcagagcacgtttcccatctgttttntatttgaggtgggttcccactctgtcacctaggttggaatgcagtggtgtgatctcggctcgcttgagcctgggaggtggaagttgcagtcagctgagatcgtgccactgcactgcagcttgggtgacagaatgagatcctgccttaaaaaaaaaaaaaaaagatgccaaattgcttatcatcccagtttatttttgtacagctatacagtttcgtagtagaaggcaatacgcaaaaattctgattgtggtcatactgtcctgggtgtgcagatgactacctattttctgtaattgtcaagaattaccattagaatcaggaaatattttgcaataactaaaacatttaaaaagtaaacaaaactgtacaaccacattataactaaacgagatgagtgattctcaaagcaggataaacccctctgcccagccaatgtggattcccacagggcttttccccaactccaggagaggccctcgaccctggtgaggatcactgc

SEQ ID NO: 148555 - DNA, 343 bp, Homo sapiens
acactccaatatgcgggatctctgggagggttgaaatgtctgcctagggcttcatagagggctgcatgctgaagagtgtgttgaagctggggttttgaagttcaagtaggagtgtaccaggtagacaagagtaggaagaacagtccgggcaaagaaggcctggtaaggcagataataagcaggtttaagatattttagcacctctctaaaaaactgaggccaaaagccaggcacggtggctcacgcctgtaatcccagcactacgggagtctgaggcaggaggaacacctgaggtcagcggtttgagaccagcctggccaacatggtgaaaccccatctctac

SEQ ID NO: 148556 - DNA, 448 bp, Homo sapiens
aacatggcaaaaccccatctctaaaaatgcaaaaattagctgggcatggtggcgggcgcctgtagtcccagctacttggaaggctgaggcaggagaattgcttcaacccaggaggcagaggctgcagtgagctgagattatgccactgtactccagcctgggagacaaagcaagattccctctcaaaaaaaaaaaaagaaagaaagaaagaaaagaaacagcgctagcaaacaaaacaaagtccctgtccttaaggaacttgaattctggctgtgaggttgacagtaggaggcagataatacatcaataaacatatgtcatgtcgggattaacactatgaagaaaaatgaagcaggataaggggtgagagtgatggggtactgtcctatctagaatgacatggaagtcccctctaaggaggggatcttgagcagtggcctgaaggaaa

SEQ ID NO: 148557 - DNA, 481 bp, Homo sapiens
  misc_feature (1)..(1): n is a, c, g, or t
nccagccggtacccagttacaacagctctagattttttggaagcaaattccagaaccacagagttgactggtcgatatgtctcttgagtttgttttaatctataggcttctcttcctcacctcatttaggtgaggaagcaggatttgggttttgtatgttcctctgttgccttttcctggaatttggtagttctgtctagagccatgctgtgcagtgtggaagccactggccacatgtggcaatttacatttaagctaattaaaatgaaaaattcagcttagctgtcacatttcaagtgattaatagccacaaatggctaatgactaccaattggattgtgcagataagaaaatttgtattgtcacagaaaattcccttggacagtactaacctagaggcttgatccaatttggtctttccaaggagctctggttccttttagtaggaaatggtgttagagacacaattcgaggtgctggg

SEQ ID NO: 148558 - DNA, 475 bp, Homo sapiens
cctttagtagaagccatcccagtaactgccgcctgccacactgcggcccttcccaccttctcaaccctctagttttcctttggtttccatgcctcgacactggcaattctcaccttttgacataccaaagtttaaaatgttaggtggaattaaaattaaccatcatccacctcctaaaagctttccccctaaacttcttttccttttttagacagggtctcactctgtcaaccaggctggagtacaatggtgccatcatagctcaatgcagcctcaacctcctgggcaacatggcgaaatcccatctttacaaaagataaaaaattagcttgatgccatggcaggtgccccatggtcccagctactcaggaggctgaagtgggatgatctcttgagttcgggaggttgaggctgcagtgagccatgatcatgccactgcactccagcctaggagacagaatgagatcttgtctca

SEQ ID NO: 148559 - DNA, 646 bp, Homo sapiens
ctcagaggatcccctcacgcttatacttccctactttgaaaaaaagatttgtatcaacactacaattttccatcattaagactaataacacagagcctagtatacatcaaggggaataaaaagaaaaatctcacattcaagtggcggctgggtgctgacctttgttccctttttttgtgtacgacttaactctttacaaaaaagagccacacgccacaccaacatgcaggtgaactccagctagtactagcaaagcatagcattcagttggaaaatttgataaatctccatgcaggataatgcatttcattacatattcactacattaattctagctacattaaaaaaaaaagaagaagaagaagaagagtagaattgaaagtgacattggattttagctatctggatacaaaggtcagttttcacagagtatgaatttgcatgtacaagcttttttgaaaaccagatcagtcagtcccaacaactgcacttaaaaaaactatgtggaaaataacagacaatgaactttttacttgtaccctaatacatttcattatttagatggtttatgtctgccgctagaaaggaaactggccccgattctaacaaatatttgttctgatgtgttaaagcagtgtttctggac

SEQ ID NO: 148560 - DNA, 396 bp, Homo sapiens
tgtgggaccaagacctctcactgcagagttcagagttatgaagaggtgcaaagtaccatatgggtcattaaaagtgatggcacggaggggaggcacctcttcttctactctctttgcatctacccctaggaataaatgggttccaagacccatttattcttcatattggggcacatgctatataaggataattgatccagtacatactctgtatcttggagtatggcatcctatccttgtagaatttgcctatgagctggtgttcagctgtaccttcagcaggttgttccaatgttctatcaagctgacaaattccaagtggtgaaaaaagtgatattattagtggatcctgtggatatgggtccactcctgcgcttggttttccataaaataggt

SEQ ID NO: 148561 - DNA, 333 bp, Homo sapiens
gtagctgggattacgggtgtgcaccaccacacccagctaatttttatattttgtagacagggtttcaccatgatggccaggcttgtctcgaactcctggcctcaagtgatccacatgcctcagcctcccaacgtgctaggattacaggcatgagctgccacacccagcatattcatacttttgttgttgaacttatgaaatcaatgtaaccccaaaaactgaaaagaaagagcttgtccttttcctccactgagtccacacagcctttcatttgtaaatgctcttgtttcacccccaattctgcatgtgctacatgggtatcagtggtgcatc

SEQ ID NO: 148562 - DNA, 592 bp, Homo sapiens
gaacctgtggtcccagctactcaggaggcttaggtgggaggactgcttaagcctagaggtagaggctgcagtgagccatgattataccactgcactccagcctgggcaacataagacccctgtctctgaaagaaaaaagttttcagagacttaataaaagcaagatgctaaaaacaaacaaaaaaaaatcaccttgccaaattagatataagggaacaataaaaaacaaaagtgggggtacctttaaaaatccagaaggattccaattcagatagctaagcaactattccacttaaagggacagaccatgaaaattatgtataattaactaaggatgtggtttatactaggatcatgaggaaagttaagttaatggacccgatatacgcaaggaaaagccctgacctttcatcaaaaagttggcaaataagctgggtgcggtggctcaagcctgtaatcccaacactttgggagaggccaagcgggcggatcatttgagctcaggagtttgagaccagactgagcaacacagtgaaaccccatctctaccaaaaatacaaaaaattagctgggcatggtggtgtgcacctgt

SEQ ID NO: 148563 - DNA, 409 bp, Homo sapiens
  misc_feature (208)..(209): n is a, c, g, or t
  misc_feature (211)..(211): n is a, c, g, or t
  misc_feature (216)..(216): n is a, c, g, or t
  misc_feature (224)..(224): n is a, c, g, or t
  misc_feature (234)..(234): n is a, c, g, or t
  misc_feature (241)..(241): n is a, c, g, or t
  misc_feature (243)..(243): n is a, c, g, or t
  misc_feature (249)..(249): n is a, c, g, or t
ccgacggggtggaaagtaagacagtaaaggggtctttccataagggagttgagacccagatgacccatctctccaggttttttgaccctggttggtataatgggtgttgattcctgaaagggtcaagagcaggcagtaccttttgtccaaactcctgaatggcttgtattttttttttttttttttttttttttatttttttaatttnntngggtntcctgtanagagggggtntggccangnggccgnggcgggtcttgaatacctgggctcaggtgatccttcctcctgggccccccaaagggccgggattccgggtgtgacccaccttgttgggcacgcaaatttttaatctcaactattgtgggagagagggggccccccaatgttggcccagtgtgggtgtcaa

SEQ ID NO: 148564 - DNA, 545 bp, Homo sapiens
ctgatgcatagcatttgtaaaatcccactaaaacaagcaccatgaaggtgttctactatggaagcagaggaagtttctttcgtgaaccttgattctgctctctgggagaaatcccttgtccttttataatcatggcattttaatctgcttgtgggagtttctttgttgattgtttgtttcttctccattgcctcatgtgaggtgttttagaatatgccttccttgaaggcagcttaagcttcctagctctcctcctgatagtggaatatgggggccctaagttgtttaactctcaaatggtcaaaggcatttatttattgttgattgatggactagttgattcattgtttaggcttatgatttctttggcaatccaatttccccagatgcttggtaggcaactcatctttttccttacggttgcctctttatgacaatagctatacatcattcctagaataattttttaactttatgtataccttggctttctggtccactaacctttctctttaaacctaatggaactaccctgagtctatctg

SEQ ID NO: 148565 - DNA, 272 bp, Homo sapiens
ttaaaaattcatctgttttgcttcaccctgcattcctaagacttgagaatgaaatagctcttcagtcaaggatataactagtgagaaaaggggaagactaggggagagaaaaagacattgtacatattctttaagccctagattacacggtatatttatagaagcaagtaagttggaatgtgctctcctaaacaaaacttgcgctattaagaacaccgtgaaaagtcattctcacataaatatcaaaatttcttttttttttttcctttttt

SEQ ID NO: 148566 - DNA, 830 bp, Homo sapiens
  misc_feature (40)..(40): n is a, c, g, or t
  misc_feature (68)..(69): n is a, c, g, or t
  misc_feature (83)..(83): n is a, c, g, or t
tctcttaatttccaccgctacacagacagggtctctgtcnccccagctggtggagtgcagtggcgcanncatgtaaactcaancacctgggctcaagagatcctcttgcctcagcctcccaggtagccaggactacagagtctttctgtcactcagcctggagtgcaatggcatgatctccgctccctgcaacctccgtctcctggattcaagtgattctccagccttagcctgctgagtagctggggctatagatgaagaaatggaggatgaaagaggtcacgcgccttgcccaagattacacaactactaaagggaagctgaagaggatgctacaggggaagaatactaggagctacctaaaagctacaaggatgacagctctgatgaatccagtgttataaaggatgagtacaagagagacagagacgagtgttgtcatgggattggttacagttgctttcctgaatacttcctccattattctggtaacaacaccctgattttcctctggaaaaccacccccacccccgaccccagctccagaggaaggagacatgaataaacctggtggggccgctatccttcagggggggtgacgccagaacctagctaactgactcgcgatccacagcgaccccgtttaggtagctgtatgatgcaactcgaaggggagaaccggggttcagaagataagggggagacgccgtgtcgggtcggcgagacgtaacgcgtacgcaatccactgggggacacagtggagactacctacccggagggagatggtagaatgctacacgtcacatgaggccgcgtaattgcgacgtgcg

SEQ ID NO: 148567 - DNA, 419 bp, Homo sapiens
ccttgggtgaggctctgggacatgctggcttcaggtaccagcacagctactggggtccaaaatgccaagtgtgctcttggggtccccagttccaggacttgacccttggatggcatttctggacctgccctgggccagtgggaagtccactgctctgaagggtgagtcccagaccaggtggcattcactacaagctgacttaagagcctttgggccttaagggaacatcagggctagtctggcagtactcctcatggtctggggtagtggtgattacagggtgaggctcctctgcctttggaaaggggagagaaaactgggaaggactgtattttgtgttttgagtgtcagctcagcagcaataccaggttgatgtctaagacttttgactctagttcctgacccccagatggcacctc

SEQ ID NO: 148568 - DNA, 408 bp, Homo sapiens
agccagagtgctgcccctcctcgccgatgctggggactctcctaaagcaggaaaactcactcctaatatggttgctttagttcaccgagatgctgtttccagctgtagcctggaaccaagggacttggatcctgactgacttttctgcctcaaactctaggaccatgaacaaaccagacaattaatatgaaatttcagcagcttaaggcacttgctagggtttttacagctgcttggtgatcctgatcctgataagctcagcacatcttggcctcagtgtgtttgtccaaagccgtcaaagctgggtatcccgtaagttggaagtggtgcacatactacaaattcagatccatcggcagtgttcgcccttcacagtcatctatgcccaaaactcaaacaatgaaaaac

SEQ ID NO: 148569 - DNA, 142 bp, Homo sapiens
ttcaacaactcctgggaaattaaatattaaaagaaaaaaaaaagcagtgtgttttgtaggacacatcactaaaaacaggtaactaagatttccctgcacagaggagttccaagactttaaactgtgtccaacatttcacagg

SEQ ID NO: 148570 - DNA, 428 bp, Homo sapiens
acaacagctaaatttgttctgctttcatccacatttacactttccttacaagtatgtgtaccactttattttcttagtagaccaggaagatagagttctaggaggcattacttctggcccaaatgagatcatatcaaaatcaagaaaatcaggaagaggggtgtgtgtgtgtgagagagagagagagagagaggaagagagagagagattccttaagtgtgcaaattttgagtccagttttacacatagaagggtgagatacaaacaaacattgcatgccagtggggattaaaactgtagagcttttggaaattggctcctccctgtgtttgccaaaaccagtctggtgctttgtgtcacacttccctgccatatgcaggcaggctggctcttttcctagggaaactgtttattttaaaacccacccg

SEQ ID NO: 148571 - DNA, 319 bp, Homo sapiens
ggaaatgactctgtccacagaagagcttattgtactgcacctcgtcaggctgcagacttgaagtcattgctgtgctgccatgggcatctctttccacttgtagctatatttagagcatgaaaatgctgaacatttccttcctgtttctttagaagacagagcggggagggatttcttgtattcaacacaaatccctcggataaccatatgaaaagataatgggaataataatttttcgttctttgtttaaaaaaatattaacgctgaagcttggactagaatagtctctattttttttttctgcttcatttttctatgt

SEQ ID NO: 148572 - DNA, 345 bp, Homo sapiens
tgtaagggcttccatgaggagcaaatgtgtggggccacagagctgccaggtcaggcctggcctgcagaggggcctggtgagggcgaccgacgtgcctggggacaggtaccccagcctataggaggccacacaattcaagttagaacgccttgccccaaattctggaactctttctgttggtgttggaggagaacacaccctccctctccaaggagctgggcctgttgcatcctggcagggctgacgtggcacctgctgccccgtgccctgggaagctgaaccagccggacgcagctcccggacgcagcagaaacggaataaccactcggcccaccggaagctgtg

SEQ ID NO: 148573 - DNA, 250 bp, Homo sapiens
ggcatgagccaccatgcccagccctctcccagattttttaatgtagtttttgaattgtttgaaaataaattgcagacctttagccctgaatatttcagtgtgtatttcctgaaaacaaggacatcctctttcattcccacaatataatcaaaatcaacaccttttaaaaactttgccatttgttctaataatgttctttgtggaaaaaatgggggtaaattttttttatttctggtcaagatccaatcca

SEQ ID NO: 148574 - DNA, 547 bp, Homo sapiens
ttgctgtgtggcgttgggcttgtcattcgcccttgctcaggctttgtttccttagctgtaaaggagatggtgatggtggccttgtgacctgatgccatgccctacacatgctggatcctcagcaaatgccagcctctctcctgtccctcaccgggtcctcctatcactgccccagggctggataagcctttgctgtgtgtggggggagggcactggcctgggagttcctggatgtgtagcagcatccctgatacacctgactgatgccagcgccaccctcttctagtcacagatgtctccaggcattgccacgtggcccctggggtgtaaaattgccccgggttgagaaccactgcacggtgagaaaagatgtggaaggacaggaaactggcagttactgggatccccgtcttggccttggacggagccagactggggttctgcagatttttctgggaagagctgaacagtaaatatgttcagcagcacaggtcacaatgatacctgctgaagcgactcaactgggctgttgcgtagaagcagccct

SEQ ID NO: 148575 - DNA, 320 bp, Homo sapiens
ttccttagatgctcagctatctgctggcagattggctgactggttagttgtttgaatggttgattgattgaatagttgcttaattggatggatgagtgggtagttggttaacaggtggatgggtagttgactggctgggtgaatgattggatgggtggatgggtgaataggtggatgggggaatgaatggttggctgatggttgggtaagtaggcagtagggatgttggtttggtcactaactggttaatgtcttccctactcactgcacaatctctccttccggggtccttgggacccaaccaactcccttgaccctga

SEQ ID NO: 148576 - DNA, 355 bp, Homo sapiens
caaagagttcttttttcagctccacagctggaccgtcttaataatatgacagcacagatgaagagttttaaaccttttgttggcttttctttcgtatctttttggcaagggcacatgaaaattaagtactgataatatcacaatgaaagcagctgtgtcattcagaccagtgaccattttaggtttgatgaacttttcattaccatcatccagggtctaaattctccattgtaaggtaaggattctccagggtggtggtgaggtgggttgagattgcatttgtatcatttgtgtttttatgaactctgaagatccatgtcgggtgaaggaaaggatgggaggagaaaaggaaata

SEQ ID NO: 148577 - DNA, 315 bp, Homo sapiens
tgggcccagtgacccaagccatgtgtctgtcattggtggaaaaacagcccctaggtcagcttctatggggcatggggtcctgctggcctggacttttactgtgggctggtgatggttgtgggtctgggggcagcttcctgatctcagaggacatagagaggtgatttcatttttactgcaatcatgaatgggctagttggtgaccactccctattttctcgccatcccagtcccctgagagcttggttattggttgtctgtcagctgccctgaagttctgccatcctcccataacgttggaccaaccctttcccc

SEQ ID NO: 148578 - DNA, 281 bp, Homo sapiens
agcagtcttcagaccagagtcagtaacccttagtcttatgtggaaatgagccaaatattatgtttgagcttccttccagctgaagtcaaaaagcagccaatagccaaataagttttctattaaacaccagtctgcaactaatagactaaaaaaaaaagcttcctgattaatatgttattcctgaaactgctacacatatacagcctatagaggtaggaaagcctgtttaggccatgctattatttgataacaatataaagctaattctggaaggatacaaa

SEQ ID NO: 148579 - DNA, 405 bp, Homo sapiens
ctgttcatttccccctacaatgtgcccttccctctccacctcctttgctacttccctacctctgcttgttctctctcacctagaccacttgacgggctcctaggtggttcctctgactcccacatatccatccccaatgctgtgctcggggtgctccaagtcataattcctattatttcactcccgggattaaaacctttcaacaccttctcccaaattacagaataaaaggtcggcttctctctctgctgcacaagcaagacttcatgataggctcacaaccatacctccagctactatctctaccaacctctttatacatctcaagctctggtgaaaccaaatggcctgcagctctctctccctccttcccccggcctttgcgtgtgctgttacctctacctg

SEQ ID NO: 148580 - DNA, 426 bp, Homo sapiens
ttgccaaggaggggtgagttatagtatgtaattataacatacagaagttttttgtatgctggtaactaattttaatttcctacatttttatgtagatttctgctattcttgtcctattttcctaatcatctttctatatgaatgactacataattctgagaataccaaaagagacagacacagaaccaatcggattcctttcttcttgaagcttctgcacagcaaaagaaactatcaacagagtgaacagacaacctacagaatgggagaaaatttttgcaacaatgcatgtgacaaagatctaatgtccaacactgataaggaacttaaacaaatttacaagaaaaaaaaaaatctcattagaaagtgggcacaggacataaacagacacttcaaaagaagacacacatgcggccaacaagcata

SEQ ID NO: 148581 - DNA, 410 bp, Homo sapiens
agctcgaattccgaattccgggcatgggatccaactgagtcactcattatggcagggaggggaaaagtcaaaggggaacatctggagctcaggcaaagcaatttgatcccactgcaacagagggcctggagggaggctttcagatggggtgcaagaacagcacatctgggaaaggggtccagcttgggcaaggggacccgcttcctcctcctcccatcccagggctgtaggtgaccttgcctgcatccctgcccctccctgggcctcagttttccaccagtacaatgaaggggaggagaatgttcctatcagttcaaacattgtgtgatttctttggtgagctgggtggggctgcgaggtctagaggttaagaagacaactggagtcacattgttccctggagatccttt

SEQ ID NO: 148582 - DNA, 858 bp, Homo sapiens
gttgctccccgtgttcaggtggagtggttaggggtaggagcagtgcacagagggcagagccagcctgggagggagttgctccccgtgttcaggtggagtggttaggggtaggatgagaggtaccatggccagcgccccaggaggaatgggctttagcttcaggccttacctgcagcccagcgcagcagggagcctcaaggaacatctagccactcctcttccaaccccggcagctcctcacagtgacacgcgatgttttcaaaagtccatctttccacaggatgtttacagcacccagcgggtaggcagtgctatttattaaccctgttgtactgatgaacaaaccagccggctcagggcagggggtgagcttgatcaagatcacagacaggaagtgacagcggggtctcagcccaggccatgcctgacacccacactcttctctggtgggggcgcttccacctttgtccctggaagcccagcctgacagcttctgcagtgcctctggcagccgcccacaaacccagccaggcaaaatcccagggtgccagacaccaggagaaatttccaggggaatttggccatttggctgtctcttcacttccctgaaaagccaaacagagaatggatttcttatcacactgtagcaaggcaatcaactggaaaagagacaggaggagaagtgtgaggaccaacagtcacagggacccaggaatcgtgttagccacaagtgatcttccagtatccctgtaaagagagctacaggcccattttacagaggaggagaccgaggttcagagagggtaagaagtgaattagccgggcgcagtggctcacacctgtaatcccagcactttg

SEQ ID NO: 148583 - DNA, 507 bp, Homo sapiens
atgccactgcactccagcctgggcaacagtctgagactctatctcaaaaaacaaaataaaataaaataaataaagtgatttgctttcatgctattgtgttgtttgagtcccttatctatttggatattaaccccagaacagatatatggcttgcaaatattttctcccattccatagcttatctcttcactgattgctgcttttgatatgcacaagctttatagtttggtattatctcatttgtctattttagcttttgttgcctatacttaaggggtcatagccaagaaaatcttcgcccagaccaatgtcatggagcttcccccacctatgttttcttctagtagttgtacaggtcttacatttaaggtcttacatttaagtctttaatccgttgtgagttgatttttgtatatagtgtgagatgagggtatacttttattattctgcaggtagatatccatccagttttcccagcaccattcattgtaaagactatctttttcc

SEQ ID NO: 148584 - DNA, 708 bp, Homo sapiens
gctcagcccgggtttccgccctcagtggccacttgctcctgtgaaagcctggggaccagcgagccagaccccttgttgctcggcatttctacgtctccttggtgagatggaaagctctaaccccctgcacaccgagccacgtggtgaccttgtgccagctcatccttgtcagcttctccctcctctggggaggagcaaggaaggggagctgagttacttgtagactcgctgagggtctgaaattcttgaagtgggtgagatgatgtttggaagtggactgctttcccttttgtgtagtttgctctttgtctctgcctaatgtctgtagccagcacaagctggttctcatggagataagcattcaggcctgtgactaacaaaaggggctgatgtgaaagagaacccaggatctcgaaatgcttctgtcatcaaaaatgattgccttgtgtttcatttaaggcaagcgtgtttaattctgtgtctctgcaaactgactcaaagttatattaattaattaaattaattaattaaaatacctggttaagtagcagcacccaaattcttaaaatttccatacaatggattttggaaattttaaaaatgaaaatatgttatttgtgatatgtaaaggattgattggtgtaattttgaaatgaatgaatacatatttttaaattcctcagtttaatttctggtatgagaaacatc

SEQ ID NO: 148585 - DNA, 338 bp, Homo sapiens
tcaagctcctcctcctggttccgctagaggcccaacacttccctcaaataaactcttctgcccagctcctgtccagctcacggcagccactgtcggcatgaaaattcctcaattcaagctctctaggcccaccttctgcctcccactggcctggacacgcccagctccaacctgacaatggtctctacaggcccagctcctgcctcccagccttctctccaggccctgaactttctcaagtcgacctcaccaggcccagctcatgcttctttgcagcctctccaggcccaactcctgcatcttggtggcccctccaggcccagcctgtgcctcccgtc

SEQ ID NO: 148586 - DNA, 499 bp, Homo sapiens
tcaagctcctcctcctggttccgctagaggcccaacacttccctcaaataaactcttctgcccagctcctgtccagctcacggcagccactgtcggcatgaaaattcctcaattcaagctctctaggcccaccttctgcctcccactggcctggacacgcccagctccaacctgacaatggtctctacaggcccagctcatcgggctctgagggacctctccaggccaagctcttacctcacggaggcttctccaggtcgtttctccctgtcttcaggcagtggtgacaggtcagctcctcctccacagtggcctcgtttgggcaggtcctgcctcttgcagcctctcaaagcccagctcctgcctctgagtggcttctgcgcacccaaatgtcctccagtcagcctgtcctggctgagctcctgcgtcctggctgagctcctgcctcctgtcggcctctataaacccagcctctgctgtatggtggcttcttcaggcc

SEQ ID NO: 148587 - DNA, 373 bp, Homo sapiens
gatcactggccttcagacatgctcagcctattggcccagtgtcaactggtttgttcttgggcagtattaacatccacagattgttgtccaacctcaggtgccaacctcaagagaaacggtcagcctaaatatgatttttttttcagacggagtttcacttttgttgcccaggctgtgcacggtggctcatgcctgtaatcccagcactttgggagatcgaggtgggcagatcacctgaggtcaggagttcaagaccagcctgaccaacatggtgaagccccatctctactaaaaattacaaaaattagctgggcatggtggtgggtggctgtaatcccagctactcaggagctgaggaccatcgttggggtac

SEQ ID NO: 148588 - DNA, 407 bp, Homo sapiens
ccactttggtatcttcctagaataatggtcagtgcctagcatttaaatagctgagccaagagcatgtgaaccttacctctgtcagcagtgtctttatcttccttttgaccgaagcatggtgaaaactaagccccatgcatgtcacagcaaacatcatttctctgagattgtcttgatttttaggctttagtgtaagggatttaaccttgctacttcttctgccatgctacgtagttgaattgctcactagatggagcccttttattaggaagctctaaaaagtcagcctgttaagtaaaaactcaggtaatcataatcaaagaggtaatccccgtagagctttaagaaaacaagctatggatgaagtaaatcagaaagctatcatataataaaaatacactcagatg

SEQ ID NO: 148589 - DNA, 399 bp, Homo sapiens
agtgctgaaagagtgagccaggacagcctttcgacattgaacaaggcaattcccaatctcttgagccctggctgtgttcactgaatggatctagtctctgaaaattcaccgacatttttggcttggcgctgtggctcatgcctgtaatcccagcactttgggaggttgagacgggaagattacgaggtcaagagatcaagactatcctgggcaacatgatgaaatgctgtctctactaaaaacacaaaaaattagctgggtgtggtggtgcgagcctgtagtcccagctactcaggaggctgaagcaggagaattgcttgaacccaggaggcggcggttgcagtgagccaaggtggcgccaccgctctccagcctggcaacagaacgtgactccgtctc

SEQ ID NO: 148590 - DNA, 217 bp, Homo sapiens
agtcagctgctccgggacagtaggtggaaagtcagaattcactaagatggggacttttccaggcaaacagagcagaagggtcatttagcacagtgtctggtacaggggaaatgcccaaaacacacagcttgttactatctagcgccagcctccccttcccttctcccttccaactgcgcatgggactctccctctctgactgtgcagcatgtagagc

SEQ ID NO: 148591 - DNA, 481 bp, Homo sapiens
tcttgctatgacattttccccatccccttcttgataagctataacatctgaggtttacagtgggatggaggcagagacagtgtggtttagactgcagaggaaagagcatgggttttcaagaaatacagatctagctttcagttctgattctatcactaactttgtggtcttgagtgagccccacatacttcctgaatcttctttttccaaatatgtgaaataggggcaataatatacgcaaagaagtttagtttggagaattaggtgacgtgatatattcaaaggggctagcactgtgcctggcacataccagaaatggaataagcactagccccttacctttcctgaaatcagaggcacacatgtgggctttggacattatctagtttattagaccagcagtgctagccagactagaccctagaaatttgaagccccaaatacaactgagggggcagagagaaaatagcattatctgacc

SEQ ID NO: 148592 - DNA, 2834 bp, Homo sapiens
ggaaagcatcagagctggaaagactggcactctggcctggactagcagcctctcccagcacagtccacagcaagccagtctcagatgtggctcgaccggcctggcttgggccaaaagcctggcatgaatgtgagatgttagagctgctgcccccatttgttggcctgtgtgcctccctggcaggccactccagtgcttggcaggcttacctgtcactgtcatccacagtgctgggtcctgcacctgggccagggcctgagccactcagcctcctccagaagctgatcctgtggcgcgttctgcgacctgagtgcctggcaggtgccctggcagacttcaccactagcctcctgggtcggcccctggatgaaaacacgtatgctcccaccatgccctttaaacatagtcaggctactcagcccatgctgatcttgttgccaccgcctggccacccctcagccactctgcatcctctgactgtcatccagaaactggctgccaagtatcagcaggggcagaagcaactgcaggtgatagccctgggctctgaagcctgggacccagtctcagttgtggtcagcactctatcccaggctatgtatgaggggcactggctggtgctggacaactgtcatctgatgccccattggccgaaagagctgctacagctcttgctggaactgttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctggtgagacccttcctctcccccttggagtcatcagcccccaggagagcctggaagagggtgggggtgggatacaattcacagctttggttttggcggtggtggaaactgaaggtactggaactgagagactctaacctcatcttcagcttcagttttctacgggggtcctctgggggacactgaggacagggaggccctgattagcctcacacaagcctgcctgagccccagtagtgggagctgggtccagccacacacacctcagtctttgctggccacgctcatgcccctcccaggtaagcctcactcaggtatctgttttggggtagggaatagtgcaatgcaatgccaccccccacagaaatgtggacagcagtctcaataaaggtatatgagggggtaatattcatactgttatgggggtgatggcagtaaaggctcagaggaaggcctactctctcgagtctagggtggggagagtccatcttgtccctcacccctcacctctatccccaagagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccaaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatgaaaaaaaa

SEQ ID NO: 148593 - DNA, 552 bp, Homo sapiens
gagagttacttgcgctatgcgcccgatcctagttacgagtgaagagaaaggttacattttaagagagagggtaaggatgggtaggaggtaacccccacttcccacctgccacctcccagcttcctagccttgcctgaccagcttctgacgcccccaggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatgaaaaaaaa

SEQ ID NO: 148594 - DNA, 1511 bp, Homo sapiens
ggaaagcatcagagctggaaagactggcactctggcctggactagcagcctctcccagcacagtccacagcaagccagtctcagatgtggctcgaccggcctggcttgggccaaaagcctggcatgaatgtgagatgttagagctgctgcccccatttgttggcctgtgtgcctccctggcaggccactccagtgcttggcaggcttacctgtcactgtcatccacagtgctgggtcctgcacctgggccagggcctgagccactcagcctcctccagaagctgatcctgtggcgcgttctgcgacctgagtgcctggcaggtgccctggcagacttcaccactagcctcctgggtcggcccctggatgaaaacacgtatgctcccaccatgccctttaaacatagtcaggctactcagcccatgctgatcttgttgccaccgcctggccacccctcagccactctgcatcctctgactgtcatccagaaactggctgccaagtatcagcaggggcagaagcaactgcaggtgatagccctgggctctgaagcctgggacccagtctcagttgtggtcagcactctatcccaggctatgtatgaggggcactggctggtgctggacaactgtcatctgatgccccattggccgaaagagctgctacagctcttgctggaactgttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatgaaaaaaaa

SEQ ID NO: 148595 - DNA, 708 bp, Homo sapiens
gcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtatcttcgcgccgcccctcgttcgcggttccagtcccctcgaagtctctaattacacctcgcagttaccccttcttggtgatcttgcccccggtaaccctgctagcttctccgatctcgcttcaccacgacctcctacccgctaacccccacttcccacctgccacctcccagcttcctagccttgcctgaccagcttctgacgcccccaggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaac

SEQ ID NO: 148596 - DNA, 2467 bp, Homo sapiens
ggaaagcatcagagctggaaagactggcactctggcctggactagcagcctctcccagcacagtccacagcaagccagtctcagatgtggctcgaccggcctggcttgggccaaaagcctggcatgaatgtgagatgttagagctgctgcccccatttgttggcctgtgtgcctccctggcaggccactccagtgcttggcaggcttacctgtcactgtcatccacagtgctgggtcctgcacctgggccagggcctgagccactcagcctcctccagaagctgatcctgtggcgcgttctgcgacctgagtgcctggcaggtgccctggcagacttcaccactagcctcctgggtcggcccctggatgaaaacacgtatgctcccaccatgccctttaaacatagtcaggctactcagcccatgctgatcttgttgccaccgcctggccacccctcagccactctgcatcctctgactgtcatccagaaactggctgccaagtatcagcaggggcagaagcaactgcaggtgatagccctgggctctgaagcctgggacccagtctcagttgtggtcagcactctatcccaggctatgtatgaggggcactggctggtgctggacaactgtcatctgatgccccattggccgaaagagctgctacagctcttgctggaactgttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctgcttcagttttctacgggggtcctctgggggacactgaggacagggaggccctgattagcctcacacaagcctgcctgagccccagtagtgggagctgggtccagccacacacacctcagtctttgctggccacgctcatgcccctcccagagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccaaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatgaaaaaaaa

SEQ ID NO: 148597 - DNA, 125 bp, Homo sapiens
gtttaaattggtgatactggcaccagaaatgctagggtaggacaagaaatatcgcatatttttaaaccaaccaaacaagcagcaataaaggaatactgcatttttatcaagaaactctctgctgt

SEQ ID NO: 148598 - DNA, 460 bp, Homo sapiens
  misc_feature (136)..(136): n is a, c, g, or t
  misc_feature (178)..(178): n is a, c, g, or t
  misc_feature (185)..(185): n is a, c, g, or t
  misc_feature (244)..(244): n is a, c, g, or t
  misc_feature (253)..(253): n is a, c, g, or t
  misc_feature (338)..(338): n is a, c, g, or t
  misc_feature (358)..(358): n is a, c, g, or t
  misc_feature (453)..(453): n is a, c, g, or t
gagagaacatgtggcattttttctataaggaggatgtccacagaagtcttcactgagtgagttaaactggaacgagaattacaacagtcatcatctaaagaaagcaagagaatattctttcagatactgtgtactnatgaaactgctgactcagctggtctgaaggaccccactggcnctggctngtctgaaggaccctgctgatcacaacttgcctgaaggaccctactgacatcagctgttntccaaaggncgccacaagaaactgactcaccaaaaaatgcatcctgatgatttcatcccccttaacccgaccaatcaacaaccccaaatctacncagcccctttccctccatgnttcctacaaaactccagcccagaactcctcagggagatggatttgaaggtctcctcccttctacttgcttgatgccctattattattaaactctntgctaca

SEQ ID NO: 148599 - DNA, 201 bp, Homo sapiens
ttaaagcataggaatacagaagataatttttttagattttggaggtcacatttttagaacttggctatgaattggacaagggacacatcaaaaataatgaagtttctagtctgggtgacttgaaggtgagtagtatcaagtgtgggttaaagaagttagtaagtgggctgggcgcaatggctcacacctgtaatcccagca

SEQ ID NO: 148600 - DNA, 374 bp, Homo sapiens
cattctccacggagggaccagactgaatgacagcctccatgaggaagataggacacatgcttgtgatttgtaaaactctaagtagcctagagtggctgcaacgtcacggcactgtgggaaggagggggaaaggcattagacagtggacagctaggctgaaaaatgaggtaggaagccaagcatggagggcaatgatgtcagactataaaatgtcctttactggacacgtttgggcaaaagacctagtacaggtgaaatgtctatatctaaatgattttaagatgatgcctcttatatgtttaatattatattaagagtatcacctgtaatcccagcactttgggaggccaaggcaggcggatcacgaggtcagg

SEQ ID NO: 148601 - DNA, 782 bp, Homo sapiens
agacaagcatagtagatgaagattaactttttcctggaaagagtgcatgaagaaaaagtgtaagactatgcacttacaaaagaaccctcacttggaagagaaggagagaaaatggagacatagaacgtccattgcatctaaaaatgccacaaactttccaaaatcttttttgttccaatttattaatgtcagtatttgacttgatcctatagcacataatcccattcagaaaggcaacattgttataaattttctgcctacgaaatatttcctggtactccacagctaatttacccctggaaggggcagattttaaaatgtgctaatgtaactacaacttcagggcagctctttggagacaagaatttatttgagtcataaatatatttttcttttgtgacttattttccaaaataataagaagaaatcatcattaggggtttctccgctcaccaactgctactaaaaaaattatagaaagacattctacgtaaatataggtcatgacttgaactagaatgcagaaatgaaaaatcatgtggactgatgacagaggattgacatctaagaaaaagagatattttggcagaaaagttgtattgtatttaattgtgccagaaatatttggaaacattgttcacagttttttgacttgcatatgttggcttggagaagtaaaacaaatcaaagattattaaatacataaaaatgcactgaggaaaccaacacttcattacaggttaaacatgtgtttttactcttatgccttggtttttgtgctc

SEQ ID NO: 148602 - DNA, 343 bp, Homo sapiens
ttgagtatgctccgtcatcccgcaacccccgtggtgacagggtgggagtcctgtaacctgtcacaccagcatgtgagggccacatgccccacgagggggtgatctaaggctgagtttgggcagagaggccaaaaaaaaggtgccaggcagctcacggacagaggtgctcgtgccacacagaattctcagttctgggaatttttgtcaccaaaattgctgaggactcgggcagctacgtcgtctgtaccaggggtgcgcctgccccaacagtgcctgctgggccccttaaatccgccagcctcctagctgagccatcagtggctccttggtggcctcgcaggtc

SEQ ID NO: 148603 - DNA, 176 bp, Homo sapiens
agtttacagcagttctgtattggcttttactgatgtgtctgaattgctccacttaacccagaatttcccatgattttactaagagccatgtatttcctgctcaaggtactagttttcctgtttacatttctctataatatggtgtacgctcataaccttggacacacactcttcct

SEQ ID NO: 148604 - DNA, 548 bp, Homo sapiens
tggctaatttttttgtatttttagtagagacggggtttcaccacgttagccaggatggtctcgatctcctgacctcatgatccgcccacctcggcctcccaaagcgctgggtgggattacaggcgtgagacactgcgcctggcaaatatagtccatttttatcaccagataaagtttctttgtgcccctttccagtccgctctgcacctccaggcacctactgttctgatttatttcaccatagattagttttttctatcctagaaattcgttaaatgaaataacacagtatataatcttttttgttgatatttgtcactcaatgtaaggtttctgaactttatctgtgttgttgcttgtattaatagttcattgtttatccattctcctactgatggacatttggattgtgtctagtttggggctattatgaataaagctgctacagatattactgtacaagtatttttgtagacatgtgttttcatttttcttgggtaaatacctaagagtaaaatgctacctcataaggtggatgtgtgttcgat

SEQ ID NO: 148605 - DNA, 477 bp, Homo sapiens
tggctaatttttttgtatttttagtagagacggggtttcaccacgttagccaggatggtctcgatctcctgacctcatgatccgcccacctcggcctcccaaagcgctgggtgggattacaggcgtgagacactgcgcctggcaaatatagtccatttttatcaccagataaagtttctttgtgcccctttccagtccgctctgcacctccaggcacctactgttctgatttatttcaccatagattagttttttctatcctagaaattcgttaaatgaaataacacagtatataatcttttttgttgatatttgtcactcaatgtaaggtttctgaactttatctgtgttgttgcttgtattaatagttcattgtttatccattctcctactgatggacatttggattggttccatgtctttgctattgtaaacagtgtggcaataaacatatgtgtgtgttcggttgagcggaga

SEQ ID NO: 148606 - DNA, 276 bp, Homo sapiens
ttgggaagccaaggcaggaggattgcttgagcccaggagtttgaggctgcaatgaactatgatcgtgccattgcactctagcctgggtaaaagagtaagaccatatcttgaaaaaaaaaaaaaagaaagaaagaaatgaaaaaaaaaaaaagacaatactattacatttcagtagcagtaataacagtccctactaaacagtaaatgctaaacaaatattaatttccgcattttacaggtaagagaattgaagtagggatggattaagtaactttt

SEQ ID NO: 148607 - DNA, 133 bp, Homo sapiens
agaagtcagggaggggaaatggacacaactacaaggaaagatgctgcaggaggagaagccagggaggggaaatggacacaactacaaggaaagatgctgcaggaggagaagtcagggaggggaaatggacaca

SEQ ID NO: 148608 - DNA, 555 bp, Homo sapiens
gcctagccagtaaagaaaaagcaaactgattaaagtaattaattaattgaaattatggaattctggaactttgaggacaccccagaaagcacaccctggctcattttacagatgaggaaattgaaattcaaaaacatgaaataactgagccaaaatgaggagtccaaggaccctgaaccttgcctaatcattcaattattgcataataactgtgacccaggcactatgctaggtgctggtgacacaaagctgaataacatatggttcattcttttatcagctcacagacacgtaagagaaagattacgatgggatgtgatcaattcaatgattgagacacacagatgacattcagtaagtgaagaaggaagtctatgtgaactcaggctgagatagtcaggaaagctacctaataataataatatgggaccaattgtgcttctctccaaaatcatgttatgaatgtctcatttagccatgcgaggcagaggattgaatttgtagagttcttaaattggacaagggtcagaatttcgtgaaagacttgttaaaaca

SEQ ID NO: 148609 - DNA, 388 bp, Homo sapiens
aggtcatctccacccaggcctgcctcgccgtggccatcagtggtagggtgaaggcagttctgggctaaggacaacataggctagggcaggcaatgactctggtctgatatgacacacctagaatggctacacagtcttcctcactccctctgtggagttgaatgagcatcagcagtagctgagagcctcataggcttctgagcctcctccaaaacacacacacgcatacatgcagcatgcatgcaggtgagcttacacacacacgtgccacacatgcagagaaacagatgcaaacctgggtatgtggacagctggagtcaaatgacccagctcccatcttgtaagacatgatgcactgtggccaagacgtagagagtcttactcctgt

SEQ ID NO: 148610 - DNA, 505 bp, Homo sapiens
gtacatccaatagataaaaaagccctggttccttgcctcaagagtagtgacctggatttacttttcagagcaagcaatagagggaggcgaggctaactgagagcatgtcctcacttgtctctccacactcctccttccctatcctgcttccctttcctccgacatggttttcctgcagtatatccgtttcctcaataaactgcatgtaccgaattcctgtctcaggatctgcttctagaaaacttgacctaaaaccaagataggaaatttagaaatctcttcattattatgtttctgtctaattaagaaattctggtttcttcccttgttacttcagatcagtgaaatacagagtagcaaaactaatgaagaagcatgagaaattaaaaaggacaattcattccttcctcccaaactcatatccagtgtggtctattcctagcatccaggatctcctggagcacctccagtttttattcttttaaagctcaggccaatccaaaga

SEQ ID NO: 148611 - DNA, 248 bp, Homo sapiens
ctgttctaatatatgctcttccttctgagaacccatttactgtcacagatccaactttcttccaaaggcaaatgactccaaacccatatctgtgttgtgatccactgttaaacttaatttccctccctgggctctgacatctacttagctataggatacaattactaggatgaccttttgatattggtaacttatacacaaaactgagttccgtttctcctcatcctcacaaataagcaaccattctc

SEQ ID NO: 148612 - DNA, 290 bp, Homo sapiens
ggcagaaagcgtggaagacttggaaagtcaacatgactatgctcggacttagcactttatgccaggagaaaatggcattatgactcacggaaaagggaccttcagatgggaagggtacagacaggctacccagcaacagccctgtgaaccccgttcctctgtgcccttcctgaggaacctaaaagcgaatgagcctcagacaactgaccagggaaagggatgggaggagggtgtgagcaggtcagtctcctgagcccgaacatgtctcagtcggccaagacctgcacctg

SEQ ID NO: 148613 - DNA, 293 bp, Homo sapiens
cagctgggtgtgtattggagctggcatgaaattaaatgaaagtgaggtcaggttttggaccaatcccattcgttaaaacctcagagccttttggattactagtcagtgatggagatgtgttataaagctgcctctattagcaaaggacatcagatcagccagtcactgcaaactgggaggcttatctttttttttttctttttctttttttcttctttctcaccgtggccattaagtgcacttgttccacaaggtgggccttaaggctggggcagctcttgattaggagactg

SEQ ID NO: 148614 - DNA, 699 bp, Homo sapiens
taacaaaatgaagtttctgcagtaagttatcaaagcgaagagaagccattgtgaagatcatggcattgtatttcaggtagtaggaagatcctggtaattgtatcagggacagtttttacttccccacacccccacctcctcagaatgggggaatgaaagcattgtccagtaattgcaaagtatctggtggttattcagatgataatggacatttttacaactggagtggaaaattatttatttctgaaggtcgaatataagtgaccactgtactccttgttgaagagagatcttgctttatttcttgaagttttctgggcagttgtagaaaatggaatgtaaaggagcaactagaaaatctttattttacaaagctgagatcttgaaagagaagtaattataagctttgagaatgctgtattagtaaagatacactgggaaaacctgtttgcttgataaaaattcccattctttattaaaacaaatgcatgcttatttgaacacagatctaccaattttatattacaatatctaattagtattcagtcttagctttttttgcctatgagacattttcctattaatcataatggtgcttctctaccatatagcactatagtaaagtaagtggattatttagaagaaatgcattcttaacattatctcctctacattttttgaaatctagggtactgatgt

SEQ ID NO: 148615 - DNA, 355 bp, Homo sapiens
agggacttacacaaaaacttggcagagttaatatatgcttataaaactactgataaaaagaatattgctgtgatgatactatacttcactatgaaaaaaacctcgtaatatttccaactgggcaatgtttcacaatgtaaaaacattcaagagtaatgaataaaataattagtaacaaatgcaaagagatgggtaaatattgaggcatacttttctggtagcattcttgacataaagattgagtaaagatgaccttttctcttcatcttctatgtctcagtacttgctaatagatcctcagtagctattcactcaagtgaataatagtaagctttgcaacttccttcacacaggc

SEQ ID NO: 148616 - DNA, 529 bp, Homo sapiens
ggacgagaaaccttaaaacctggcctctcccgattatttgtattggatgaaatggaccctggccctactccctgggaagagaggggctcttgggacatgacttacctctaggtcttaataattacagacttgcaaagagcttgacttactgacacactgtccgccggagactcctacagggcgggcacacatctacttactcccacagcggcgccgggcccgtattcatgggatgcagccgcgtcgtcacacccggatctgcggaggtgctgggagacagactgccaacacaggggcgggcatccctcctgtgcagctcctggctgccctgactgcagccccctcccatacaggaaaacccgctggcaggtgtggacgaaccttggatcttggcctcttctctaaaacaaacaggacagtgcagggggtgaagaagcaccactttcaggtcacatggcccatgggcaattccagggaattccagtttgtgaagagaaagaaggcaccaaccgactcatctccagctgag

SEQ ID NO: 148617 - DNA, 531 bp, Homo sapiens
cactagacctaagaaggagactactgggcattaaactgtgatgctgaactctgagccactcacaatagtagtaactggatggggcttcatgctgcctcacttagggaggaagtgttatgttctgcaagccagaggggaaaggaccggatcaagccaacacagttggaaaccctctgcagttaacattttcctgggaagacatacacggattgttaatacacaaacttcacagaatgcatgtaatcctcaacatgatggtttcaatgtttatatgaaaaaaatgtacattttgtctcaaaatttactcaacatttttaacaaagaaacatgtaggaaaagtttcatgttgaatttcaaataacactggaagaacgtcagaatcattactcattttggtaagtatgtcaaatctcaaaagagatatgtagtctccaaagcaatttctttcattctaaaccttggtccaccaaggttggccatcataggaagattaaagtttgcgagttcagggagctccacaggaacaccaac

SEQ ID NO: 148618 - DNA, 131 bp, Homo sapiens
ggacacaatagtggacatttatttattctgacttattttaacctaattagggagaaaataaataagagttcccttccaacctgtctagtcttttcctagaccgagacaaagataattctggagaaagcagg

SEQ ID NO: 148619 - DNA, 393 bp, Homo sapiens
taatatgaagtctaagtgtatccatccactagatgtcagcattaggcaagatggagtggaatggatgtagaataatagccagaagctcagtaagagatttagtctaacaagtaaactgacttgtataaaggcacgcattttatgatagagtcaggactagaaatcaagtctcccaatttttaatccattgttatatcacatttctttaagtcaagtgagttaactgcatgtaatttagtagctaaaattaaaatatatggatcttaacatttgctagggcttcatggggagattttagtactactatgttgatattaacactggcatccaggaatacctgaatcctgttgtactaatctctctgtctcttcctttacatttcacaaaagatgg

SEQ ID NO: 148620 - DNA, 391 bp, Homo sapiens
caattctaaccaaattgtataaaattgtccaagttagtatacacttatatcagcaataccgaaacttggccttattatctaaaaattaccaagtcagctttcctttgttaaattttctccacatatcaacttagtaaactcagctaacaagtgcacttatttttataattattatggagcttataatagacctaaacactcttggtgagttcagcaacagtaatttacaaaagattgctttcaatattgcagcaatggtccaatgaaaacagttcaaaagctctaaaaatttcaaaatgttagttcaaaaaaattactgggttattacatgacaaaattataaatatctgaagtagggataacaggttccatatggttacaaaagatttat

SEQ ID NO: 148621 - DNA, 812 bp, Homo sapiens
ttctacaggtgctcccggattttgctctccagcttccggttctccgcctccaggatcctcactctttccaggtaggaggccaggctgtcgctcaggctttgcatggtctccttttagttctggatgcctcccattcctgccagaccccggccatccctgccgccagacccccggaccccaagccacccaggaagctgttggagcggaacacggagatccgggaaccagagcccccggcgcttgcctagaagctggccgcgctggttagcggtcgggcgcggtagctgggcggctggacggagcccagggaccggtagttggtgcagaaggtggaggaatggtgaagctcatgctgtctggggaggacagcgagagcacaggactcagactttgccatctaaaatatattttcatagatcagggtgtaatagtgggggggtggaaagtagctcatgggccccaatttttctcatcattcataataggaatttagaaagtagtatctaagattgatggaatagcaagcaaagctttaagtatattatttagagctattaaaataatcaatagaagaaaacatgttttaatagaccatggaagattagatgggaagtttgtgagtaactcaaatcttaacttttaaagtgagaagctaatggatactatttaaagaccataaatcaataaattgatgtaaaagcctactatttacattatgttcataaccatcacataaactacaattagaaatgttggaaaatgattttacctgagagtgagataggtgggaatcagatagataagatggatga

SEQ ID NO: 148622 - DNA, 574 bp, Homo sapiens
ctcccaaagtcctgggattacaggtgtaagctactgctcctggcctgcgtttgtggttgcttttaaatagattttcatctaattgcaaagaatgagttgattaattcacctgaggattgttccacccctgacttgcacattggaattatccaggcaaatttttaagatactgaagatcctgattagtatggtatgcatactatggtggtgggcactgaaagtttttaaactccttaggtgattgtgataaatggactgcttcaacaaatgatgtcacttgggaatggatggacagagaggaaaagcttaaacagttataattctcagtagtaaaaaattttgccattatataccctctaaaaagtattattttgtttttgtttgtggttactgttttgtgtatactgtgtgtaccccctgtctaaagggtttataatgtaaaatgtataatgtaaaataaatcaacattttcaaatgttacatcttcaccctttattcagttaactgcacttttattccatctagactcaaaacttttagtacctatcatttcattccaaactgataattatat

SEQ ID NO: 148623 - DNA, 670 bp, Homo sapiens
ctttccagccacagagtattatgagtctgtgatttcttgagtcacaaagcaaggtcatttgatatatgtgagatgataataagctgtaatcggggaacattctccagtcgtaagcatgaaacctctgagttattcgggactactcctttttctctttcagcccacatttagcaccttgggcacgcctctctgattttcatttctgtgttcactccctgagcataggccttcctacctgtagcagggatgacgggcaaatcctccttcctcatctcccatcacaagagttcagaatttccctcgtcattccagcctacacaccaccacctgacttgtttctaaactcagaactgattttgtttcctctgcttctgtggtcctccattatttttcagtttggcttccaagtcctctatttgacacaaacatacccttctaattacatcttttattcttctccattcaaaccaatgttccagctgttttctggctatggcccatgctttctcctcttaatgtccttgctcatataattacttgacgacttccatctggatttcctgatcacccacctgtgaatctctgcttatcccacctgtttttcaagattaaaatcaaatgccctttcttccctgaagctttttaaattttctcaacagggcaggatctg

SEQ ID NO: 148624 - DNA, 561 bp, Homo sapiens
aaagacatgattttattttttattatggctgtgtcctattccacagtgtttatgtaccacattttctttatctaatccaccgttgatggacacttaggttaactcctgactttgctattgtaaataatgctgtcataaacgcatgtaaactcatacttctctaacttctgattttgtgctcttaaccacagtaaacaactcagttccttgtaacaggtcactactgagagatcaggaaaaaaacagctctccaagattgtcccaaggaccccctgcacctgcaagtatccaacaagtccatcagcccttggactactgttgcatgaatgagacagacatgagaagacttgagtctccatgtggtctttctcagtcaccttggggccccaccaagtgttggtgtttttaccatttgctccttgacagaaagaataggaagttcatgaaggttaatgtgtcataaggcatgagaacactggaaggttgaatgaatcacttgctttggaggcctttgaaaacaaaaacaaaatggcaacaattaaaaacaattactgggtacct

SEQ ID NO: 148625 - DNA, 401 bp, Homo sapiens
aacgcaaataagcaacaaaggacagagaaaaaagattggaaggaaaatggcaaaatctgaacaataattctctccagatggaaagattaagagtcatctttctacttctatttttctgtatctggtaatttctgcatagtggcgcaagtcctgatggttaaagggagaaaagcaaaaatgttaatgacactggagttgctggcagcggactacttggccggagactgtgctgtgtttgtttgtcccctccaagtcttatgctgaaatatgatccccagtgttgggaggtggggcctggtgggaagtgtttagatcatgggagtggatccctcaggcatagcttagtgccattcttgctggagtgagttggcactcttagctcccatgagaactccttgttg

SEQ ID NO: 148626 - DNA, 507 bp, Homo sapiens
ggaacacacagctacaagatctggactgactatattcccctgcttttctacacacagactctagcagagaagttaaacttcatgaggatagaacgttttaactcatgttttccaaccaccattcagaagagaggctggaacacaacgggcattcaacaaaaatttgctgaatgagtatgtatagacttttagcacaaaataagcaaaatgacgcaagggccaacacatttttgcctatgtagttttatactgtaaacaatgaacatatcacactcttcagagttgggctcattttctcatttgaaacagggcccatcactcaaactcacagattgagttttctttaatgattgtaaatactgttatttttattagaagagttgtaattcacatatggcagttgtggaagctgcttgatagaatgaacaagcgcaagcgcagtcagatagacctgttaactccatcctagacattttaagagtcatttctaatccttacgacttacaa

SEQ ID NO: 148627 - DNA, 518 bp, Homo sapiens
  misc_feature (478)..(478): n is a, c, g, or t
  misc_feature (511)..(511): n is a, c, g, or t
  misc_feature (518)..(518): n is a, c, g, or t
cagacaaacagactctttcaaagagtcagtgatggaaagtctcccaggtggagcccaccatgtggggcagaagcagatgctccaagaacctgctggtttggccatgtgactgggagtggagggaaagaagtgatgctgccagcttggctgtgcagatgggagttggcagttggattcagcctctgcccacctccaaggagttaggtgctttgaagaccgatgagttcacccttcagcaaatgaacaacagcgtttgtgagaagagcagaggggcccatggctcagttgtttccagaattgctttgtcacaggcccttgtgattattcagaaattaccaaatgttagcttcttgagctgaaatgttttatgcaaattaaaggtgggagatcaagatgcttttatctttctcctaccccccaccatttttcttctcctcaatgaatcccctctatcaccagcacaatcaaataaacactntggcctcgttggcctcagcggtggagctctgcngccggan

SEQ ID NO: 148628 - DNA, 387 bp, Homo sapiens
ccaaaattatcttttttatggggcacctcaccttactgctaaaacattacagtaactttaaggtataatttctaaaattcaatctctagaccatgacatttaaaatcaccaaatgctttcattttttagtagcaatcggcatttccattgcaattaatctttctcaccatcctatacctccacccatacccaaccatgttccctcttctacttttaaatttttgcttaatccatccacatttccccttgcagtattccttctgttttatctatcaataaaacttggaagatcactgattgatttaatattagttgcaaatggctttcaatgatttctatttataattactcccattacaataataacaattcagatcaaggggaaat

SEQ ID NO: 148629 - DNA, 583 bp, Homo sapiens
tacatgaattaaataaaatgatgtttgtgaaaatgttataaaaatgcccaaatcagaaattgtagttactgtataggttaatttcctatgaggttgttaaacattttcatttttttcttccaatttaaaactgtgcatattttaacagacaggttgagctacttggaaattcaaagtactttaaacatttatgtaatgtcacatacttagtgcaaaatgctctgtctgctttgcctcttttccagaatttagacaagtctagactacagaaacacctcaaatagttaatgcgtaattagaactttactttcactcatttttaatttttacatatctttaagtgaaagcatatacttgtgtttataaatgtatttgataattagcaactcaaacttttaaagcattgtgtttgccatcttatcaaactactatcaagtgcaaacatttttcccattgattacaaatcttacatgttagacctataggcatccttgactggcaattgattttgaacatatttggttaactgctgagtcaactttctgtttagatcttaggcaaatgtgttatagccatataccta

SEQ ID NO: 148630 - DNA, 522 bp, Homo sapiens
aacaggctgaacttacgtggatgccaggaggaatttttgttttccctgttctctatgagttgtaggcggactttcacaagaatggctaggaaatcagttgggcacagtggctcatgcctgtaatcctagcactttgggaggctgaagtgggcagatcgcttgagcccaggagtttgagatcagcctgggcaacatggcaaaactccatctctacaaaaaatacaagaattagctgggcatggaggtgcacacctatagtcccagctactcaggaggctgagagaagggaggatcacttaaccctgggaggttgaggctgcagtgagccacagtcttcgcctgatatcaggcgaagactgtggggaggaatggggtgggttttgtatgttcaaactgtcattttatttttacgttgttagatatggggagtagtgtgattgaggtggagtagattaggcgtaggtagaagtagaggttaaggagggtgatggtggctatgccacagtcttcgcctgatgggta

SEQ ID NO: 148631 - DNA, 202 bp, Homo sapiens
gttatccccccagacttagctacagcaagtaagtgaaaggacctgatagatggtaatggaaaacagctttcctgttgcatgcagatcaggacagatcccctttggtggatataaatgtagtaataatggagtaaacatttaaaatgttaatatatgctccatctgcagcttctcagtcttttttttttttgagacggagtct

SEQ ID NO: 148632 - DNA, 335 bp, Homo sapiens
tagaaattgaagacaagtgtggcaaaacctggaatgtttctattaaagtaagagcacttgagatacatttctagaagatccattaacaaattcctcatgtagtacctagaagtaaattggcagccagaaaagtgataaaacagtgcttgggagattgtgcagctatttgtagctctgtgttttccttatgatttaaaagtttatattttgctgtcaggtaaatatggaaagactgttacacatattggcatctctggtgtttcctgcatatatattctggacgataagattttcaaacagcaaatttaatgactagtttttagaaatagataata

SEQ ID NO: 148633 - DNA, 617 bp, Homo sapiens
  misc_feature (548)..(548): n is a, c, g, or t
gcagcaacatggttggagctggagaccatcatctttagtgaactaatgcagaaatggaaaaccaaatacatgttctcatttataagtaagtgctaaataataacacatggcaccctgggaggcagagcccagcagatcagttgaggtcaggagtttgagaccagcctggttaacatggtgaaaccctgtcactatttttaaaaataaataaattagccaagcgtggtgacaggtgcttgtaatttcagctactcaggaggctgaggcaggagaatcacttgaaccctgtggttggagatgacagtgagccaggattgtgccactgcactccagcctggacaacacagtgagactccatcttaaaaaaaaaaaggaatttaatcttcaggtctattctgaagccacagggaagaattagggataacctcacggagatgaaagctaataccacaaatgcctagggaaggttcacttactgttccagcaagagagtaaggtgtctccccattacaattatcattaaaacaaaaagggtcttctgcaccttntggtgctgacaggaagtgacaagattcattccatccgtacaagttcagagaacaatttaagggtaagcc

SEQ ID NO: 148634 - DNA, 440 bp, Homo sapiens
atatcccagaaaaatacaggaccagacgccagcctgatcaaaatgctggctgctttgaggacaaccatcccaccaagtccattagttgctgggtctgaggacctgtctgagtgtctggctgttggagcaaagcaaagatcccgattggggtcagtgttctcatggtgagttggagggcttctcaagtgtttgaaggcagatccgtaggctcatatatgggtcctttgttctagctttgagcttatctgactaaagtggacagagagatggaggggatcatagtggctgggtggcaggactagattgcagcttcagacagagcagcatctggaggcttccatggtgaattttagctccagatcaactgcaagaaaaaaccagcaatcccaaaaggacccacagactctctgaaggaaccagactgctcctgcaggacccag

SEQ ID NO: 148635 - DNA, 361 bp, Homo sapiens
ttctttctttctttctttctttctttctctctttctcttttcttttctttttttcttttttctccttatctgtttttggtattagtgtgatgctagcctcatagaatgaattagggagaattctctcctctttggcttttctggaatagattcatgagggttgatattagttcttctttgcacatttgggtgaatttggctgtggatccatcctgtcttgggattttctctattggaagccttttttgttactgattcaataataatactcattattggtctgtttaggttttacatgtcttcctgattcaatcttggtagattgtatgtttccaggaatttattcttttttttttctagg

SEQ ID NO: 148636 - DNA, 285 bp, Homo sapiens
gtgggttctcagtaatgaaattcaagcattcaggataccagattggctgaaatattaatattttaggaaccacccagccttataaaaacagggcgtgagaaggtggcgaggcctataccgttagggatggtcctcaggtgtcaactctgagggttcagaggacttggggctacccaggagcactacagggtaactgaagcccacttccagaatatcagaacctttgcttccagtgaaaccgtcacgtaaggtggagtttacagggttgttttgtggctgtgtctg

SEQ ID NO: 148637 - DNA, 444 bp, Homo sapiens
tagagggatgtctgccgcgagtcgtgtgatattcgggcctggtgtgaccatgtccacctgtgatgtcatgcttattgatgacagcgagtatgaagaggaagaagagtttgagattgccttggcagatgcctctgacaatgcccgcattggaagggtggcgacagccaaggtgctcattagtggtcccaacgatgcctcgactgtgtccctgggcaacacggctttcactgtcagtgaggacgcaggcacagtaaagattccagttatccgccatggtactgacctctctactttcgcatctgtctggtgtgcaacgcggccctcagacccagcttctgccacaccaggagttgactacgttcccagctctcggaaggtggaatttgggcctggtgtcattgaacagtattgcaccttgactatcttggataacacgttcgcgag

SEQ ID NO: 148638 - DNA, 295 bp, Homo sapiens
tgaaactcctcctcgcgctacggacgctgcacttgtgggcaatctgcacctgttctcccctcccagaggccagctggaagggggtcccccaccattctacctctgttcccatctcaaacagggctcagaaatcctcagtacaatactacaattggtcccacaccaaagacttttcacactccaactcattctatccttaccaaaacactcttactttacccaggagacacagaaatgtggcaaagcttacctgggatcacagatttagggggagtgaagggggcgtccgtagcgc

SEQ ID NO: 148639 - DNA, 326 bp, Homo sapiens
atgagtacttagttggcagatatttatcagttgcctactctatatacatctctttgttagatttgatgggctgctcactctgtccctctgcccacctgatgttagttaatctgggggacaaccatgtaataagttacttcctagtatctatagtgaccagttatttgggagtcacctgattgaccaaagactgtgtttttacagtgttgtctcctttatttttttcttaggattctttttgcttttcttttttacaacagcctactgtgtcgcatcactgaatctagtttatagtttttcgtttctctacattccatcattttaga

SEQ ID NO: 148640 - DNA, 265 bp, Homo sapiens
cgctagttcatttttccaggcgtaagtcctccagagagagttaggaggcctgagataattattctaaaactgcccacagcattttacagcttaaggcgagtgtttaacaaaatcagttcctcccaacaatactgagctaaatattattatacaatctctaccgataaggaagttgaggttctcagaagattaaaactaaaaacaaaaagaaacaaagaaggctattcaaggatacttggaaccgcttctgaagttcactctggag

SEQ ID NO: 148641 - DNA, 339 bp, Homo sapiens
caagggttgggcaatgtattccacatctataatttgatggaggcagtgggacagaggctgtttttcaagaatgcatttggagaagcggtaagagtgcaggtgataatctttctactttataggatatggcaaccagactaccaggaaaaatgaagttatcactctacttccaatcaagcagtgaattttgatactcagcagtttcagttttttccatatgcattaccacatatatttatatctcctaaatcagtgggagttccttaatggaacgcataaggtactactctgagcactaaatatgtttgctgtgatagtacaggctaattccaatccttg

SEQ ID NO: 148642 - DNA, 109 bp, Homo sapiens
aacacattgcagtcaacaaaatccatactgtaggaaaccacagaacaaatgtatagaacaaatgacctggtgtctttaaaatataaattccaaggagcaggggagttgg

SEQ ID NO: 148643 - DNA, 356 bp, Homo sapiens
gtgggtggagggggagtatgaaaaaagaaatacgttgatcaatgtgggataaagttttaaacaggtgcagttagttttagtaacctattgtgcaaaatgggaattgtaataaataagacattgtaaataaaggaatgcaagtatagtaggtagggcaaacaaaagaaaaacggaaagaaataaaagagaagcactgaaaataaaaaaggagaccaccaattaagcactcatattttcaattcataggaaagctgtcgttagaaaaagcagaaaatttgtatctcatcaaagcagaatttatgcacaaaaataaaaaatgagtatcagcatggaactaaagtatgtttacaaatagc

SEQ ID NO: 148644 - DNA, 341 bp, Homo sapiens
cgagctcggtttccgaattccggcatgggataagaaaatgaaatcataaaaaattactaggaaaaagatgagaaaattgttcataaaactgaagtgtggaagatcctttatgccttacactgccctgagtgatctcattcatacccatggcttcaattgtcatgaatcccaaattcattcctctgtcagaactctcttctgagcttcagacccacatactcagctgcctactggacacctctacttgaatatcacaaactcaactcaaaagcaaacctgtcaaatttaattactagtagccctaccccaaacaatcttcctgctcagtgaatgacacccat

SEQ ID NO: 148645 - DNA, 377 bp, Homo sapiens
agcaagactagaagagccaggaatggcctcctgtattgatcaatatctaagctcagtctttgaaatgaaatgaggtactaagtaaggatggatgattgtagatgggtaaagaacttcaagcagtgagaaaataatgaccaaagttacagaactcgaggtaggctggtttttggaggaggtgagatgtatggtaggtagttttcctggagtggagagatggagctagatcagcaagctgaagcataaacatgaagactttgtgcactacaaaggctcaagatagatctgtaggaaatgggatgtgactgacaatcttgaaagagagtgctgtgttcacatttatattttatataggtcatactagtggccatgtggag

SEQ ID NO: 148646 - DNA, 134 bp, Homo sapiens
ctatttactaaactatgcaactgatcatttttgttattttaggtacataatattatcagtgttgtgcttctatttctgcttttgctatttagttcaatgatttctttttcatcccttatttaattggttagact

SEQ ID NO: 148647 - DNA, 341 bp, Homo sapiens
agagtcaacagagtaaaggaatgctctatgatttttatattggtcaggaagaacataaaaatgtcagttaatgttagtctttgatgagtgaagtatacatgtgtaattcctagaacaactactaaaagattagtaaaagagatgtaaaagacatgaaagagcacattccaaatgaacagaaaaaaaaaacagaataagaaaaagtgttaaatcgtccaaaaaggaggaaagaaaggggaaaaaaagtaacaattctaaatctttatgtgcctgataacacggcttcaacacatcgaataaaatgtttacagaactgtaagtagaatcgcagcggaagattt

SEQ ID NO: 148648 - DNA, 400 bp, Homo sapiens
actgtaaactagttcaaccattgtggaagtcagtgtggcgattcctcagggatctagaactagaaataccatttgacccagccatcccattactgggtatatacccaaatgagtataaatcatgcttctctggaatcttaagtatagattgttgagttcattctcttctattcatggcgtggatatcatttggcctgagcgggcttcctctgtatattattttatttacttattatccccacttccttcccttccccacattttaatgtattaatgtgtcatccttctgtgcctatgtgttcttttaacacatggtgtcggggtctcagcagctcaggcgggaggagcggcagtggccaggcagcctagcttcaccagggctcttacgtgcagcggccgc

SEQ ID NO: 148649 - DNA, 252 bp, Homo sapiens
cattgatgttatagatgaaagtcaatgacaaaggaaataaaagccatgtcacacccaaagacatgaccaacctcaaaaatttggttttaagtagctagatctctgactgggaaagtgttattgtccccaggattttaacacctagatggcatttctgagtttggtagatgtaatggccataagaggagtgagacaaacattgactttttctgtcttaaagcagttattgggaaatgatggcttctctttgag

SEQ ID NO: 148650 - DNA, 361 bp, Homo sapiens
acggggtcatggttatagctgagtcatgatgtcatacaaactgtagtgcagcggtataattggagctcactgcaacctgtgcctccccagttcaaaaaattctccggcctcagcctccagagtagctggaactacaggtgcccgccaccacacttggctaatttttgtatttttagtaaagacggggttttgccatgttggccaggctggtcttaaactcctgacctcaggtgatctgcctgccttggcctcccaaagtgctgggattacaggcatgagccatcgtgcccagcctccatcgctttgagcatgtaatcttttcaacagccctgtgacatgggtgttaatgttatacccattt

SEQ ID NO: 148651 - DNA, 425 bp, Homo sapiens
tgacgagatgcatactacataggtaaaagatggggacaaatactttctatttgcttataaaagggaagaggcagctattccctgctatcctgaatgtgtctctttgaaatgttatgaatattaactccaactctttggtatataaataaaatcgcttcaggagccatttgtttagccctcttggaccaagagacatttccaaattcctggaaactcattctgtattgaaatgtaaatgcttagggagatctccatagtcttcttggcacctctggacttaacctaggaacctctctttgctgtaatctcttaatctaccccacttgatgctctcagggagataaaataagttttattattgtggagcagagcaattaactagataaatgactacagatctaaatcttaaggtatgcatctcggca

SEQ ID NO: 148652 - DNA, 132 bp, Homo sapiens
tcctaccacataaataaccattctgggtcatacaaatacatatgctcttgcaaagatgcaaaaaaagatgctaactatacttatctccttctgggtcagtatttacaggtttgcccccattccttatttcca

SEQ ID NO: 148653 - DNA, 375 bp, Homo sapiens
ctggtgattagttagtgttaaagcaatcaggattaaagtcagggaggccacaaaagaaggataagatattgatgactgtggaattgtcagtcggaaagtacatacatagctttacttttatgtgttagtaagaaatcagtgatgagaaatatgagcctgggtttcttctcactttaaagggtcatatcatcaaagcctggagtgctccacctcttcccaaaagtccaaccaagcatcttaccagaattgtttttaactatcagattctagcatgagaggtcagaaattggggattgacgaggcaggttggggaaagcacgaaccaagacattcagattggtttgttgtatccaagtaaagagagaaatttatctc

SEQ ID NO: 148654 - DNA, 143 bp, Homo sapiens
tattacattcttgagtatgtttaccatatgataaattatatgtggaaaaagctttgcaaactgtatcctctataaaggtaaagtatcatttcttccacttattaacctttgatcctttccctttctgtatctccctccaagaa

SEQ ID NO: 148655 - DNA, 228 bp, Homo sapiens
acaggcccaggcacgttccagctcacagcctgtttagcaaatcgggtatcagtttaagattatgaggtccagccccagccaacggatgcaggacacagcagtaaggacaacccaaaggcgtaagggacaaatatgtctgcttttcctttgttcaggagtgctctcaccatcgttccatctgcaattgagcaccctttctgcataaagtaaaaattgccttgctgagag

SEQ ID NO: 148656 - DNA, 480 bp, Homo sapiens
agatcgcaatgtttcgggggatcgcaatgtacggggagacggcgatgttcgggggtaccgcgatgttcggggggaccgcgatgttcggggagaccgcgttactcggggggacggcgatgttcgggggggatcacgatgttcggagggatcgcgatgttggggtagaacgcgatgttcgggggcatcgcgccggtgctaccagaagcctcctggcctgcggggcaagcagcagccgcaggaatcagacccggcggaaaggagccgcggaggggaactgagtgccttcagccgggcatgttcggcgagatcgcgatgttcggtgagatggcaatgttcggggagatcgcgattttcggggagaccgcgatgttcggggagatcgcgttgctcggagagagggcgatgttcggagaggccgcgatgttcggggagaccacgatgttcggggagacagcaccggtccttccagaaacctcctgg

SEQ ID NO: 148657 - DNA, 271 bp, Homo sapiens
ctaaaaactttaacaatatttccttaatagcatcaactaaccaatagcatcaacttaatagcatcaactaactaatcagtattgaaatagctctaattatctcataatttcttttcacattggtttatttacatcagaatccaaatataaaccacatattgcatttggttaatatgttccataaatgtctatcaatttatccctcatttttattcttgtaatttgttaaagttctttgagtgttcacaaattttagttttgtggattgtgt

SEQ ID NO: 148658 - DNA, 243 bp, Homo sapiens
ttagccatcaacatggagaattccacaagcagatttccacgactgatccatctttgatttgttaaaatgaacctcacttggctgtggtgctatccttttattcattgctagattatctgcgtttggatctactggttacagaaaatctataaaacttttctagttcatacttgtttcatttttattatttctttccttgtttattcattgatttttaattaaaaagacaaataattattgtat

SEQ ID NO: 148659 - DNA, 521 bp, Homo sapiens
tgggaggagggctgttttaggagttcttattttccttttaagagagtggtttttgagctacttatgaccttcatgccatctaatgttggaaactttcgctgagcagatagcttattataaaaagtatttgtacaacatccgcatttcagagaatgggatgctagctgccagttgcgtggtggtgtggaaacttaggagtgatcttaattttccaaaattcttcaggtctagcacttgaagaaataataggtagatttgaaatgaaacaacccagggatattcctgaaaacagcagcattgaccgcagccaatgtaaatcaggtgtggatcgtcctgggtagtaggagtttataaatgccacagaggatgtttgctgccagacatacctgaattttaggacctgctgttggttaactctgggttgatccacccttaaccccttgaaaatcagaatctgtgttaggtaagtctgtgtatgattaggagacaggccaattgaaatcaaaactgcttggcaaatc

SEQ ID NO: 148660 - DNA, 544 bp, Homo sapiens
atcccaattatgcattagcatgcaaaaagtcactctcagcagcaccatgacagtttacaaatgccatggcaatgtcaggaagttaccctatatggtctaaaaaggagaggaaccctcagttctgagaactgctcacccctttcctgggaaactcgtgaataatccaaccctcctttagcatataatcaataaataactataagtagccttagtccagcagcccaaactactgctctgcctatggagtagccattttgtattccttttttttttttttttttttgagacggagtcttgctctgttgcccaggctggagtgtaatggcatgatcttggctcactgcaacctctgcttcccgggttcaagcgattctcctgcctcagcctctcgagtggctgggattacaggcatgtgccaccacgcccggctaatttttgtgtttttagtagagatggggttttgccatgatggcctggctggtctcaaactcctgacctcaggtgatccaccctcctcggcctcccaaagtgctaggattacagg

SEQ ID NO: 148661 - DNA, 154 bp, Homo sapiens
agctaagaagacagggaggaaagagccatgaaaccatgaggagacagatgaactcaacagctaagaagacagggaggaaagagccatgaaaccatgaggagacagatgaactcaacagctaagaagacagggaggaaagagccatgaaaccatg

SEQ ID NO: 148662 - DNA, 197 bp, Homo sapiens
ttttataacaatgattactttaaaaaaaaagctacagaaaaatagttaatacaattacctttaactctacgctagtatgtagcttaccaagtcaattcagaactaacaagaaaaagacaagttattacaaatatttctttatttttatttatttatttctttttttgagacggggtcttgctctgtcgcccaggctg

SEQ ID NO: 148663 - DNA, 217 bp, Homo sapiens
tctctggaggaaagcactctgctgttaacccttaaacacccttaggagatgggcacttatggaaggaaaaaaacctctccgggtgtcaggctctacaccccaggtggaagttcttgctctctgggggttatctgagaatctggtgaaaacttagaccctcttctgaaaaacatatcccacaccacaccaaacttaaagaaagttctgtgggggtggg

SEQ ID NO: 148664 - DNA, 297 bp, Homo sapiens
gtctgtgtttgctcatcaccatgtcctcggaaccagcccagtgtgtggtacattatttgacactcaataattgttgaattaataaatgtgagaaactgtggtctgtgtttctcagaatcctgttggtctatgggagaatgctctgcatgttgtagacattttgaaaaaaactcacgaaccatttgaaaattaaagaagcatataatacaaaaaaagaatagcaaacgagatatttcaggaaggtagatgtcattgtgaactgttttcatcagagagttagaagactgaaggttgtgt

SEQ ID NO: 148665 - DNA, 470 bp, Homo sapiens
tcatgcaggttgtcagggaagcgggggaaagctggcagtcacaggcctcacccagctcccacacaaacggaagggccagtctcactcccaccatgccccctcaacagccccaagtctgtttccaggcagtaggggatctgggcctgagaacttgccccaggctactcacctcccagctgtgaaagaaaaaggcttggttctttccccacctatggagtctgcacaccggattcgtgccctcccccttctggccaggaggcttctcgccagttcaaattgttacaaagttcagctggagacttccttctccctatagtgtttcccctcctattcctctggctgccctcccgaaggatccctgtggtgccaggcaggaatggcctgcttgaagacccagcgagctcccaaggctttcctgctgcttcctctacttctatatttcgctgggctctctaaattgactcagctcc

SEQ ID NO: 148666 - DNA, 309 bp, Homo sapiens
ttgaggagaacgtggcaaaggagaatgacaagtatacatgtacaattaaatagacattcatcttaaaatgtatttaatttaatttttttatttttttttaaagagatgaggtctatgttgcccaagttggtctcaaactcccgagcgcaagtgatcctcccacctcagcctcccaaagtgctaggattacaggcatgaaccaccaagcctggccttaaaatgtattttagcaagtacatactgtgtgtcaggcatcattacaggtgttggaccacagcagagaacaacagaaaagttcaaagaaccctg

SEQ ID NO: 148667 - DNA, 398 bp, Homo sapiens
cagtgcacctttcaagaccaagctcaagtctcatgcttttggtgacacattctctggcttaccccatccaaatgcattctgcctgcctctaattcaccagaaaactctactcattgagcaccaaaacatgaatacatgtgtcccctaccctgggtggccccctcagccttgcaacctaaccagagcccagagcaacaccttaccccatccccgctggtgagtgactatggggaggcaggggctgctatcaccctcttgtatagacactgaggctcacagcacgtgggcacacaaggccatgcagctgctgaatctaccctaagcacctcaacacgatgcctggaaggaaaagcaggagcagaggaaggagaaggtagacaccaggaggatgaggatca

SEQ ID NO: 148668 - DNA, 440 bp, Homo sapiens
cattctaagcagctttatagtgaaacatttcatttagaaatctggaccatctttcttcagtttactgtaatccacattcactgagtagaacttgtattgctcattggaacccagtttattccagggccctgggtcattctttctggcccaactaacatctggattgaaatgccagatgcaagacatacagtgctgctctggtacctctagctccattaaatacaaagagggggatcaaactcagttccttggcctgaccaaggacctggtggagcatgttttcagcaagggcatctgatttaaaaggagagaactagcttagctgccaggcccttgactaagtagtatctcagaataaagtaattgaaaattaatgagtatctacttagggtctctaaatatatttaattttctatggagggaactttttaaattgaaaa

SEQ ID NO: 148669 - DNA, 419 bp, Homo sapiens
aatgggtgctgctcagcgggatgtcagacaggaatccctggttgcttggaaaggcatccccgaaaccggggactttcaactattggcgggtccttacttggttcaaatatcaattaaaatatcaggaggactattacataccccaaaaagagctgtggaaacacctcatagcgcacacgtttctttaaaaaaaaaaaaacaacagacaccataggaaagtctcatgtatttaaaataaagggagttaattagtaaatttgttttttctgaaagcagtcttattgatacaaaatagcccaaaccgggttcacaaaggttgaaaacagagttagcttataattagcatttcaactgtccacaagcggatcttctagattgtcagcacaaggaaattctgttctcttcattggcgtaaatgc

SEQ ID NO: 148670 - DNA, 597 bp, Homo sapiens
aaatgcctctgctgctgctgctgctgctgctgtacactgctgcttcaataaaagttgctaacaccactggctagctcttgaattctttcctaggaaaagccaagaaccctcttgggataaacctcagttttggggtttgcctgtcctgcaacataatcaccaaatgtttctttttgtttgttttaggtattttcacatatatcatttcactcatttaaacctcacaataactattatgttagaagaagagactattgtaaagaagaatgagaaagtaccttagcatactggaatgagcatacttggaatcaaacagttcagggttagaatcctacctctgccatgtatgaactgagtaactttcaacaccttactgagcttctcttcatctgaaaaatgaagtggactaaataacacaacttaaaatacccagctcatacaaggtatttaagaaattgagcagagctcaagaccaggctggccaacatgctgaaatcccatctctactaaaaatacaaaaattagctgggcgtggtggtgcgtgcctgtagtcccagctactcgggaagctgaggcgggagaattgcttgaacccag

SEQ ID NO: 148671 - DNA, 261 bp, Homo sapiens
accagtgcaggaagatttgtttctaggtttaccttcacagcatttatggccttccaagctgacctgaggcaataaaagcatcctagactggtagtctccatgccaaccaagctctttactcattctttgcacttggcagtttgcattgccacttgctatgtcattttagtttttcctttcatgttttgtttaaataaactttattaagtatgcagttagataaattttaacaaatgtataccactgtataacaaacaccac

SEQ ID NO: 148672 - DNA, 530 bp, Homo sapiens
tgaaggtgtctgggattgccagcaatgagcattggttgcatggatatgtttagaatggaaaattctgaatatatgtgaaccttccaaaaaaaagtttttaaagttgtatcagttcattacagtacaaatgtaaaattaggggaattgtttaggagtacccctcttagacccctaattaggagttggaggtctcagtctgtgaccaggattagagttcgttctatggctggaatctgggctcagccaggataaggttctgtgtggatccagtactaatcatcgctgcatcagggctctgcctggcaggagggctcgggagcctttgctctgtgtccacagctcgactgctgccgttccaggatctgaccacttgatgtctccacttcacaaattgccaagtgaggaaagagctggatagagctgcctagacacgtaccggccctgagctgggataggttggaggccatagctcagggaaagacttggaaactgcagagaatgaatccaagtggcagcaaagctggctgggc

SEQ ID NO: 148673 - DNA, 369 bp, Homo sapiens
gtgatagttatagcaagattagcttctattcctttttcttcacggctatgtaccaacctgattcatggggtatgaatgagacctgcttcatctgaaaacttttaaaatagtaattcacttttatggttcttttcttactttttaaaggaagagacttgtattatctgattatgatttgcatttattattgctgttaccttggcttctaaattaaaatctgaaacaaattattttacttttttgggaattcataaagttttcttctttaaatttttatttattcatttattttttagagatagggtctcactctgtctcccaggctggggtgcagtggtactatcatagctcgctgtagcttgaaactcc

SEQ ID NO: 148674 - DNA, 373 bp, Homo sapiens
agtgcggcattgagtattacccagtctcgcctttcagtcttgttgttacgtccacatcatgacatgcaggcaaccgaggcaggtggcctgggctaccaggagccaggacaaggctgtgggggagctgagccaccagcttgaagtgccttgtgggagaaaacccgaattggattatagtccccggatggaatggagtgtggcaaagccagttctgctggggtgggaggaaaacagtgagtttagaattcaaaggacagctgaatcctctagccactcccttctccatcccctgggctgggagggcagatgtaggcaaggtgtgccttcggaacaggagggggctgtctgtaaggcatgagtgtgtgtgtgtatg

SEQ ID NO: 148675 - DNA, 247 bp, Homo sapiens
cgaaaatgcagggtgaccctggcgcaggatcgggtctgagagctgctcaccgacccatgcctcctctagcaaatcgcctctctcacagtcacctcaacagcatctcagccgttgtccgacactgggtgattctgcacgcccggctcggaaccctgtgcattgcccatctgtgagccgacctcctgcctgaagccaccttctcatagcgctcagtactggggaccctggccgggaagtttgcacagag

SEQ ID NO: 148676 - DNA, 465 bp, Homo sapiens
gacaagatttctggagtttggaaagggtgagagattgggtcagcaaaagacacattctgatctttatgctgggatgcaatttatagatacagggatgagacccaaaaaagctgggagagatttgtcatcatggttgcaaggcaactgccggtggctgatcccgtaaaggatacacatacctagaacagagcctaaaaaagcatcaagcatgaagggtggagccacgatgcttggactcgagttctgctcctgtgcattcctcggtaacttaaactacctgtgcctcgatttttcctggggaaaaaaggaagtttgtagccagtacattggtgcctgccttaaagtagaactactccatgggctgaagaggaagttcagctgggcgtagtggctcacacctgtaatcccagcaatctgggaggcccaggcaggtggatcacctgaggtcaggagttcgagaccagc

SEQ ID NO: 148677 - DNA, 157 bp, Homo sapiens
tgatataatgtgagatcgcatgctggtcaatacaatactaagtaaactcaaatggtgatactgactgaggctctgcaaagaggaaaagcaaactcctatctggaaattgtgtctatttctatgacaaggaaatgctggtccttccagtgtggaaggg

SEQ ID NO: 148678 - DNA, 128 bp, Homo sapiens
agtgttaggaacttttggttctcagccagaacaaagaaatcttgggtatcaaatgtgctacgctgcagcagccatagtggtattcacggatagaatattctagcagccctgcagacgaatccctttgc

SEQ ID NO: 148679 - DNA, 404 bp, Homo sapiens
agtatacatggcttcttgtgaagattgagaagaatgtttggtaggaagttaaagaagggctcaaattgaaatttgagttttaaaagagtgcctagataaaacctaattgcttacctgaggaagtttggttaacactacccaaataagcagaatagagaagggtttttaaaatgattgtctgaagaatattatgctggtgcttgtttgtaggtatttgtgtaaaaatttattttttggcctagtaggttttagaaattctgaaataggtagagttgacaagttctgcagggcgtttgtcagtcatcagtgtgctttgtcacccttctgagtagaatgtatagtttatgctgcttcccacatgttgaataaatatttgagaagcagcaaagtaataatgccacttg

SEQ ID NO: 148680 - DNA, 397 bp, Homo sapiens
tctagaggatccacagcggccgacctttttttggccaactttgttttaaaaggcagaaaaataaggatatttaaactggacaaagatggccaaaaaaagggaaaattcatgaagggagatcctattcataataggaacataaatcacaagactgcaaattcctatgcataggaataaccacatagcaaacatttattgagtgctatgtgttgcaagcacatttgaagtgcttcaccagtatcgcctcatttaatcttcacctccaggatactcagtatcccagttctattgatgaaggaaccaagactcaaaaagatggaataacttctctaagctcatacagctaatcaacaatggagttgagatttaagccaatttcccccagtcctcacaatgg

SEQ ID NO: 148681 - DNA, 693 bp, Homo sapiens
aaaggtacaatcacagacacaatgcgaacagcactgtaagagtcagagccttagatgctgctgctgcctctgccccgctccgcgcggggagctgcagttcagagttcgcttcctttcatggacttactctgtttgcacaggctcttggatattctcttccttttccttccctttattgaaaatacatgtgacatactgctgtgagttacttttttctaaaacaaatttctcatgtacatagttatatatcaattttaaaaactcttcttcattgtagtggccacgtggtattatgtcatatgcctgtgccatttcttactgaatcagtccccagttgatggcaaccttagactgtttctatatttaataataagctggattgcagtaaaaattcttaaagttctatctttgtatatatgtgagttttcttttgggtaggttcctagatgtggaattgctgtttttaaaagtgtatgtgcattttaaagtttgccaaattgctcaccaaagaggttttctagtttatatttttgtcagtagtgtgtgtgtgtgtgtgtgtgtgagagagagagagagagagagagagagagagagaatgcccccttttttattgaaggagaatttgtgttattttgatgtacagaaaactcaacagtgttcatttcacccagtttattggcaggttctgtggcc

SEQ ID NO: 148682 - DNA, 299 bp, Homo sapiens
tgcccactacagaaaaaaagttgatgtgtaatcaaagcccaccttagctgggtattttcacatctccatcgcatgtaatgttcctaaacaacatgatgaatttagatacatggaaattatatatccataaatagattaggttggagcaatttgtccaaatcatggagtcagaatataaacttgggtcttcttgactcagagtccaccgctccatttaaacatcatttgtagagttccctggcatcctgctttaataaaccaatctcaatgtaccagactgttccagagagcagagttga

SEQ ID NO: 148683 - DNA, 387 bp, Homo sapiens
tttgaggcagaaagatcagcaacaagagattaccagctgttatatttttatgaaaactgtttcttacttaaaactttcaagtatctccaagagcattcatcaccgggaatgatgtatttctaatgcctggcatttgaagaatttccattatacttgctaagtagtctctataaagctgtctttgagtttgattagtgtaccttaatccacagagcataatgactctggatgaattgatggcctcaaaaatagaagatttgttgtaatttctggacctggcacacgtaaggactaaataaatcttaactactgacttgaattgtaaagcagaagacccaacctggattgtagtaatcccactaagatactgctctccttagagcccta

SEQ ID NO: 148684 - DNA, 126 bp, Homo sapiens
gtaagtgggatcctgggcatggctgcagaaagtagcctcagttttccttgtctgcagaatgggctggtaggatgagataatgggggttgagcagtcagaggccttgaccaaaagcttttttttttt

SEQ ID NO: 148685 - DNA, 1135 bp, Homo sapiens
ctctctcctcagcctcccaaagtgttgggaatattggcattagccactgtgcccagcccaattatatgtaagatatatttacacatgcatatatgtacaatgtaataatcatttgtgacaacaaaagaattgggggtggaactatttcaaccagtagaataatggtgacaaaatgatggaacacacaatggaattttatgcagctataaaaacaaaaaagggccaggcatggtgggaaatatttcattacataccttttaaataatactttctgggttttgtatcatgggaaagtattatctatttaataattagataaggaatttaaaatagccattaaaaacttgtcagagatatatagatggttggagacaaatttatgagatataaaagaggaaaagctgaaaatgaatgagctaggcattcatttcaagaagttgaacaaacagtaaaataaacccagaaaagtagaaggaaggaaaataaagattagagtagaaattaatagaaaacaaatacaacagagaagctcaacagagccaaaaattgtttctttgaaaaaactagtaaaactgactaacctctgatgtgactgaccagtaacaaattagtgatgcaaaaataacccatgaggaatgaaaagaggaacctaattacagatgccacagagattaaaaagatagaagaatacaatgaactttatgccaataaatcttaaaagttagatgaaatgaactcctgaaaagaaaacttaaactgtcccaagtagaaacagaaaactttgaatattcctaaaactacttcagaaaatgaatcagtagttaaaaatctacccacagccaggtgcgggtggctcacgcctgtaatcccagcacttcaggaggccaaggtgagcggatcacttgaggtcaggagtttgagaccagcctggccaacatggcgaaaccccatctctactagaaatacaaaaattagctgggcatggtggcacacgcctataattccagctacctgggaggctgacgcacgagaatctcttgaacctgggaggcagaggttgcagtgagccgagatcatgccactgcactccagcctgggtgacatagtgagactctgtctcaaaaaaaaagtaata

SEQ ID NO: 148686 - DNA, 257 bp, Homo sapiens
cagctgataagcatggggacctcctattctgataaaaattccaaaaaagtcctgagtgattaataaacagcacattgaaaattagaaatgagttctatggcaggggatgaaacaggcaacaaagcctattttctttgcaatgaagcgcatcagatattaataatagccattgtaattatctttatcatgtattaagcattttgtgtttttcacttttacacaattagatgatccccataggtattaccgcctttttt

SEQ ID NO: 148687 - DNA, 1418 bp, Homo sapiens
ggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaattacaaaagaaaaaaaattagacactgcattaatttcttgttcttttggaatatcttagtaactgaggatcattttctaacaatgtggttgacataccttcagttgctttccacatctaaaagagttatctttcatatatgtacaagttattggtagtcttatttttgggctgtttgttgacttatgccccatttgttttacttgttctttaatataaacccttccattttttaacaattcctaacacttgatatcttaatatcagtcactaacattagtaacttcttgtatgttatattatggcagatctctttacgttttttctcacatctatctgctagtccaggaatttgttactaaatagattttcttggatatttggttgcctcaaagtgcttacatttgttaacagattgtaaaccacatttatttacattgatgaatgggctgttgaataatcattgtaaagcactttgtatatataaggtgctatataagtgtgaaatatcattcatttataaatgaaatgccttctaactt

SEQ ID NO: 148688 - DNA, 233 bp, Homo sapiens
tgccgggacgacctagaggacccgtcaattctactccaggaatttgttactaaatagattttcttggatatttggttgcctcaaagtgcttacatttgttaacagattgtaaaccacatttatttacattgatgaatgggctgttgaataatcattgtaaagcactttgtatatataaggtgctatataagtgtgaaatatcattcatttataaatgaaatgccttctaactt

SEQ ID NO: 148689 - DNA, 3044 bp, Homo sapiens
cccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaaaaaacttctgaatatactttaggtatcagaaagccaagaataaaatttagctctaacggtggcaactccatgtccggtgtccagctttggacagggtttatgacgtttctgtttctctagtaatgattaatgattcctcaggagattcgtgatgttgtctggtctatctggaaatttaaagtcactaggagctttgcctcatcgtgagtgatgctgtgctgtatttttacaaactctcgcatacagcaccttcctggggccacgttggcttgtgcagtggagcttgtccaggcaccagcatggagcaagtacagggttgctgtgttgggttggagcacactgtcaccacagtgtctgaagtcttataaacaggaagatcattttctgttttccttctaaccagggtgagaaaatacaaagtaaagaactaaagaatattaaaacctagcatttatgttccacagtgtgtatttcagaagtttgtaatccagaaaatatagtagtgtataatatctgaaaagagaatcaagtatacaattgtacatatttttaaagaactttgaaaaactccgtcatatcttttaccatttgtctatttgatagtaatgcagaaaaaagtccctaaagaccctgtgttccaaaatttaccaagattgacatttctattagacatccttaacctaagtgttttaattagattattagactataataaggatgaaattgctgtctgtaattttgttgaggttttattgttaatataataaaagctcaactgtacaaaattaagctaaatgttatccagtcagaaacatcagcctgagccaccgcgcccagcctacatttataattttcattctcttttacctataaaattcagtgtattagtttcattacataggagaaattatatttctaaacattttatgatgtttaaaaacaaaacaggctgttgtaaaa

SEQ ID NO: 148690 - DNA, 2184 bp, Homo sapiens
  misc_feature (2149)..(2149): n is a, c, g, or t
cccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaacagtctgtgaactactcactgaatgaattttgttctgtgagatgagaggttttcattttcatttnctatttacagccccagtgtcctgcctctaagggat

SEQ ID NO: 148691 - DNA, 1347 bp, Homo sapiens
aggttaggtcacttaatataggaggatgttttctcatgtacttgctatttgcaagttcaggtttcatttggttctttatgttaaatacgaataagtaacctcaaatcaagctaaatgtaattaagaattttcagcaactatattcaagtgtttgatttttaaattctttctttctttttaataagaaagatgacctaaaaatcagtggtatttgtttgtcctcagaagccgtagttgaagaaagatattagagtatacacagaactggagccatacattgtgctaattttttacattaagtacagaagtctgagcacagcatgaatgcttctgcctgacaggaccacaaagcagcagaagttagggataaatggagatagccatgagtagaactgctgtagggcttcaggaggctacgcagacctgatcaactgcaaagtttccaaagtaaaagattaaaaactttcagacggttcttacctctacccgtgtttcacaaatagcctgaggatccaactatttttaaagcaaattggggccagacgtggtgcctcacgcctgcaatctcaccatttgggagacctaggtgggggtggatcacttgaggtcaggagtttgagaccagcctggccaacatggtgaaaccccatctctactaaattacaaaaattagctgggcatggtggcatgtggctgtagtcccagctacttgggaggctgaggcaggagagtcacttgaactcaggagccagagactgcagtgagctgagatcgcaccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcagtggctcacgcgtataatcccagcactttgggaggccgagacaggcacatcatctgaggtcaggacttccagaccagcctgtccaacatggtgaaactccgtctctactaaaaatacaaacaattagccaggcatggtggtgtgtgcctgtagtcccagctacttgggagggtgaggcaggagaattgcttgaacctgggagacagagattgcagtgagccgagatggcgccattgcaccccagcctggcgacaagagcgaaactctgtcgcaagaaaaaaaaaaaaaaaaaaacagtctgtgaactactcactgaatgaattttgttctgtgagatctacccagatattttttctctatctgggttggaaaggccccaggcttttagaggggagttttacttctgacttttt

SEQ ID NO: 148692 - DNA, 2883 bp, Homo sapiens
ggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaattacaaaagaaaaaaaattagacactgcattaatttcttgttcttttggaatatcttagtaactgaggatcattttctaacaatgtggttgacataccttcagttgctttccacatctaaaagagttatctttcatatatgtacaagttattggtagtcttatttttgggctgtttgttgacttatgccccatttgttttacttgttctttaatataaacccttccattttttaacaattcctaacacttgatatcttaatatcagtcactaacattagtaacttcttgtatgttatattatggcagatctctttacgttttttctcacatctatctgctagtccaggaatttgttactaaatagattttcttggatatttggttgcctcaaagtgcttacatttgttaacagctgagattacaggcacgagccaccgcgcccagtcgtacttctgacttttcttcagcatctgttgtatgctattattttgatgtttacatttataattttctttcttttttttttttttgtgagatgatgtctcgctctgtcacccaggctggagtgcagtggcgcgatctcggctcactgcaagctccgcctcccgggttcacgccattctcctgcctcagcctcctgagtagcggggactacaggcgcccgccactacgcccgactaattttttgtattttttagtagagacggtgtttcaccatgttggccaggatggtctcgatctcctgacctcgtgatccacccgcctcagcctcccagagtgctgggattacaggcgtgagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaaaaaacttctgaatatactttaggtatcagaaagccaagaataaaatttagctctaacggtggcaactccatgtccggtgtccagctttggacagggtttatgacgtttctgtttctctagtaatgattaatgattcctcaggagattcgtgatgttgtctggtctatctggaaatttaaagtcactaggagctttgcctcatcgtgagtgatgctgtgctgtatttttacaaactctcgcatacagcaccttcctggggccacgttggcttgtgcagtggagcttgtccaggcaccagcatggagcaagtacagggttgctgtgttgggttggagcacactgtcaccacagtgtctgaagtcttataaacaggaagatcattttctgttttccttctaaccagggtgagaaaatacaaagtaaagaactaaagaatattaaaacctagcatttatgttccacagtgtgtatttcagaagtttgtaatccagaaaatatagtagtgtataatatctgaaaagagaatcaagtatacaattgtacatatttttaaagaactttgaaaaactccgtcatatcttttaccatttgtctatttgatagtaatgcagaaaaaagtccctaaagaccctgtgttccaaaatttaccaagattgacatttctattagacatccttaacctaagtgttttaattagattattagactataataaggatgaaattgctgtctgtaattttgttgaggttttattgttaatataataaaagctcaactgtacaaaattaagctaaatgttatccagtcagaaacatcagcctgtggccaggtgcggtggctcacgcctgtaatcccagcactttgggaggccaaggcgggcggatcacctgaggtcaggagttcaggaccagcctggctaatatggtgaaaccccatctctactaaaaatacagtattagccaggcatggtggcaggcgcctgtgatcccagctacttgggaggctgaggcaggagaatcatgtgaacccaggaggtggaggttgcagtaagccgagat

SEQ ID NO: 148693 - DNA, 2549 bp, Homo sapiens
aggttaggtcacttaatataggaggatgttttctcatgtacttgctatttgcaagttcaggtttcatttggttctttatgttaaatacgaataagtaacctcaaatcaagctaaatgtaattaagaattttcagcaactatattcaagtgtttgatttttaaattctttctttctttttaataagaaagatgacctaaaaatcagtggtatttgtttgtcctcagaagccgtagttgaagaaagatattagagtatacacagaactggagccatacattgtgctaattttttacattaagtacagaagtctgagcacagcatgaatgcttctgcctgacaggaccacaaagcagcagaagttagggataaatggagatagccatgagtagaactgctgtagggcttcaggaggctacgcagacctgatcaactgcaaagtttccaaagtaaaagattaaaaactttcagacggttcttacctctacccgtgtttcacaaatagcctgaggatccaactatttttaaagcaaattggggccagacgtggtgcctcacgcctgcaatctcaccatttgggagacctaggtgggggtggatcacttgaggtcaggagtttgagaccagcctggccaacatggtgaaaccccatctctactaaattacaaaaattagctgggcatggtggcatgtggctgtagtcccagctacttgggaggctgaggcaggagagtcacttgaactcaggagccagagactgcagtgagctgagatcgcaccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcagtggctcacgcgtataatcccactgagattacaggcacgagccaccgcgcccagtcgtacttctgacttttcttcagcatctgttgtatgctattattttgatgtttacatttataattttctttcttttttttttttttgtgagatgatgtctcgctctgtcacccaggctggagtgcagtggcgcgatctcggctcactgcaagctccgcctcccgggttcacgccattctcctgcctcagcctcctgagtagcggggactacaggcgcccgccactacgcccgactaattttttgtattttttagtagagacggtgtttcaccatgttggccaggatggtctcgatctcctgacctcgtgatccacccgcctcagcctcccagagtgctgggattacaggcgtgagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaaaaaacttctgaatatactttaggtatcagaaagccaagaataaaatttagctctaacggtggcaactccatgtccggtgtccagctttggacagggtttatgacgtttctgtttctctagtaatgattaatgattcctcaggagattcgtgatgttgtctggtctatctggaaatttaaagtcactaggagctttgcctcatcgtgagtgatgctgtgctgtatttttacaaactctcgcatacagcaccttcctggggccacgttggcttgtgcagtggagcttgtccaggcaccagcatggagcaagtacagggttgctgtgttgggttggagcacactgtcaccacagtgtctgaagtcttataaacaggaagatcattttctgttttccttctaaccagggtgagaaaatacaaagtaaagaactaaagaatattaaaacctagcatttatgttccacagtgtgtatttcagaagtttgtaatccagaaaatatagtagtgtataatatctgaaaagagaatcaagtatacaattgtacatatttttaaagaactttgaaaaactccgtcatatcttttaccatttgtctatttgatagtaatgcagaaaaaagtccctaaagaccctgtgttccaaaatttaccaagattgacatttctattagacatccttaacctaagtgttttaattagattattagactataataaggatgaaattgctgtctgtaattttgttgaggttttattgttaatataataaaagctcaactgtacaaaattaagctaaatgttatccagtcagaaacatcagcctgtggccaggtgcggtggctcacgcctgtaatcccagcactttgggaggccaaggcgggcggatcacctgaggtcaggagttcaggaccagcctggctaatatggtgaaaccccatctctactaaaaatacagtattagccaggcatggtggcaggcgcctgtgatcccagctacttgggaggctgaggcaggagaatcatgtgaacccaggaggtggaggttgcagtaagccgagat

SEQ ID NO: 148694 - DNA, 1891 bp, Homo sapiens
aggttaggtcacttaatataggaggatgttttctcatgtacttgctatttgcaagttcaggtttcatttggttctttatgttaaatacgaataagtaacctcaaatcaagctaaatgtaattaagaattttcagcaactatattcaagtgtttgatttttaaattctttctttctttttaataagaaagatgacctaaaaatcagtggtatttgtttgtcctcagaagccgtagttgaagaaagatattagagtatacacagaactggagccatacattgtgctaattttttacattaagtacagaagtctgagcacagcatgaatgcttctgcctgacaggaccacaaagcagcagaagttagggataaatggagatagccatgagtagaactgctgtagggcttcaggaggctacgcagacctgatcaactgcaaagtttccaaagtaaaagattaaaaactttcagacggttcttacctctacccgtgtttcacaaatagcctgaggatccaactatttttaaagcaaattggggccagacgtggtgcctcacgcctgcaatctcaccatttgggagacctaggtgggggtgtttcaccatgttggccaggatggtctcgatctcctgacctcgtgatccacccgcctcagcctcccagagtgctgggattacaggcgtgagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaaaaaacttctgaatatactttaggtatcagaaagccaagaataaaatttagctctaacggtggcaactccatgtccggtgtccagctttggacagggtttatgacgtttctgtttctctagtaatgattaatgattcctcaggagattcgtgatgttgtctggtctatctggaaatttaaagtcactaggagctttgcctcatcgtgagtgatgctgtgctgtatttttacaaactctcgcatacagcaccttcctggggccacgttggcttgtgcagtggagcttgtccaggcaccagcatggagcaagtacagggttgctgtgttgggttggagcacactgtcaccacagtgtctgaagtcttataaacaggaagatcattttctgttttccttctaaccagggtgagaaaatacaaagtaaagaactaaagaatattaaaacctagcatttatgttccacagtgtgtatttcagaagtttgtaatccagaaaatatagtagtgtataatatctgaaaagagaatcaagtatacaattgtacatatttttaaagaactttgaaaaactccgtcatatcttttaccatttgtctatttgatagtaatgcagaaaaaagtccctaaagaccctgtgttccaaaatttaccaagattgacatttctattagacatccttaacctaagtgttttaattagattattagactataataaggatgaaattgctgtctgtaattttgttgaggttttattgttaatataataaaagctcaactgtacaaaattaagctaaatgttatccagtcagaaacatcagcctgtggccaggtgcggtggctcacgcctgtaatcccagcactttgggaggccaaggcgggcggatcacctgaggtcaggagttcaggaccagcctggctaatatggtgaaaccccatctctactaaaaatacagtattagccaggcatggtggcaggcgcctgtgatcccagctacttgggaggctgaggcaggagaatcatgtgaacccaggaggtggaggttgcagtaagccgagat

SEQ ID NO: 148695 - DNA, 1925 bp, Homo sapiens
  misc_feature (1890)..(1890): n is a, c, g, or t
ggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaattacaaaagaaaaaaaattagacactgcattaatttcttgttcttttggaatatcttagtaactgaggatcattttctaacaatgtggttgacataccttcagttgctttccacatctaaaagagttatctttcatatatgtacaagttattggtagtcttatttttgggctgtttgttgacttatgccccatttgttttacttgttctttaatataaacccttccattttttaacaattcctaacacttgatatcttaatatcagtcactaacattagtaacttcttgtatgttatattatggcagatctctttacgttttttctcacatctatctgctagtccaggaatttgttactaaatagattttcttggatatttggttgcctcaaagtgcttacatttgttaacagctgagattacaggcacgagccaccgcgcccagtcgtacttctgacttttcttcagcatctgttgtatgctattattttgatgtttacatttataattttctttcttttttttttttttgtgagatgatgtctcgctctgtcacccaggctggagtgcagtggcgcgatctcggctcactgcaagctccgcctcccgggttcacgccattctcctgcctcagcctcctgagtagcggggactacaggcgcccgccactacgcccgactaattttttgtattttttagtagagacggtgtttcaccatgttggccaggatggtctcgatctcctgacctcgtgatccacccgcctcagcctcccagagtgctgggattacaggcgtgagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaacagtctgtgaactactcactgaatgaattttgttctgtgagatgagaggttttcattttcatttnctatttacagccccagtgtcctgcctctaagggat

SEQ ID NO: 148696 - DNA, 3142 bp, Homo sapiens
cccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaaaaaacttctgaatatactttaggtatcagaaagccaagaataaaatttagctctaacggtggcaactccatgtccggtgtccagctttggacagggtttatgacgtttctgtttctctagtaatgattaatgattcctcaggagattcgtgatgttgtctggtctatctggaaatttaaagtcactaggagctttgcctcatcgtgagtgatgctgtgctgtatttttacaaactctcgcatacagcaccttcctggggccacgttggcttgtgcagtggagcttgtccaggcaccagcatggagcaagtacagggttgctgtgttgggttggagcacactgtcaccacagtgtctgaagtcttataaacaggaagatcattttctgttttccttctaaccagggtgagaaaatacaaagtaaagaactaaagaatattaaaacctagcatttatgttccacagtgtgtatttcagaagtttgtaatccagaaaatatagtagtgtataatatctgaaaagagaatcaagtatacaattgtacatatttttaaagaactttgaaaaactccgtcatatcttttaccatttgtctatttgatagtaatgcagaaaaaagtccctaaagaccctgtgttccaaaatttaccaagattgacatttctattagacatccttaacctaagtgttttaattagattattagactataataaggatgaaattgctgtctgtaattttgttgaggttttattgttaatataataaaagctcaactgtacaaaattaagctaaatgttatccagtcagaaacatcagcctgtggccaggtgcggtggctcacgcctgtaatcccagcactttgggaggccaaggcgggcggatcacctgaggtcaggagttcaggaccagcctggctaatatggtgaaaccccatctctactaaaaatacagtattagccaggcatggtggcaggcgcctgtgatcccagctacttgggaggctgaggcaggagaatcatgtgaacccaggaggtggaggttgcagtaagccgagat

SEQ ID NO: 148697 - DNA, 3023 bp, Homo sapiens
cccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaaaaaacttctgaatatactttaggtatcagaaagccaagaataaaatttagctctaacggtggcaactccatgtccggtgtccagctttggacagggtttatgacgtttctgtttctctagtaatgattaatgattcctcaggagattcgtgatgttgtctggtctatctggaaatttaaagtcactaggagctttgcctcatcgtgagtgatgctgtgctgtatttttacaaactctcgcatacagcaccttcctggggccacgttggcttgtgcagtggagcttgtccaggcaccagcatggagcaagtacagggttgctgtgttgggttggagcacactgtcaccacagtgtctgaagtcttataaacaggaagatcattttctgttttccttctaaccagggtgagaaaatacaaagtaaagaactaaagaatattaaaacctagcatttatgttccacagtgtgtatttcagaagtttgtaatccagaaaatatagtagtgtataatatctgaaaagagaatcaagtatacaattgtacatatttttaaagaactttgaaaaactccgtcatatcttttaccatttgtctatttgatagtaatgcagaaaaaagtccctaaagaccctgtgttccaaaatttaccaagattgacatttctattagacatccttaacctaagtgttttaattagattattagactataataaggatgaaattgctgtctgtaattttgttgaggttttattgttaatataataaaagctcaactgtacaaaattaagctaaatgttatccagtcagaaacatcagcctgagccaccgcgcccagcctacatttataattttcattctcttttacctataaaattcagtgtattagtttcattacataggagaaattaatacactgaattttataggtaaaaaaaaa

SEQ ID NO: 148698 - DNA, 513 bp, Homo sapiens
ttgcatctcgaaatcccaatcaaaatttccagtttaacatcctgtttgactaacattattcagtgcttaataaatgatggattttttttttttttgagacagggtctcactttgtcacccagctgtagagcagtggtatgaacacggctcactgcagcttcaatttcccaggctcaagtgatcctcccacctcagccccccaaacagctgagactacaggtgtgcaccatcatgcccagctaagttttgtagtttttgtagagacagggtttctccacattgcccaggcttgtctagaactcctggcctcaagcgatctgcccaccttgacctcccaaagtgctgggattacaagtgtgagccaccatgcccagccttgagttaatttctgtgtatgttgtgaggtaatctcattcttttgcatatgcatatccagttgtcccagcacaatttgttgaaatgactgttctttcccgactgaattgtcttgacactcttatcaaaaataaattg

SEQ ID NO: 148699 - DNA, 460 bp, Homo sapiens
cagcatttaagccaggaagacagagaaatgttggtagaatactgaaggacatagctagttaggaaaatagaatcaattaggaaaaaggaagtgaatgcttagttttcttgtatgaaaccagaggcaggagtaggctatcccatctaaaaaagatgtcaggtggatcaggtttgatgtcttatgcctgtaatcctagcactttgggagaccgaggtgggtggatcacttgagtccagctgttcaacaccagcctgaggaacatggcaaaaccctgtctctacaaaaacaaaacaaaaccaaaacacacatgaaaaaacaattagctgggcgtggtggtatgggccagtaggcccatccacttgggagactgaggtgtgaggatcacttgagcctgggaggagaagattgcagtgagccaagattgtaccactgcactccagcctggatgacacagcgagac

SEQ ID NO: 148700 - DNA, 878 bp, Homo sapiens
cgccaccacacccggctaatttttatatttttagtagagatggagtttcgccatgttggccaggctggtctcaaactcctgacctcaagtgatctgcctgcctcagcctcccaaagtgctagaattataggagtgagccaccacacctggccagattaggcatgtttttaatagatacgttatatcatacaatgtgggatctgccccagtttattaatcattccccattaatggatattcccattcatttcttcaggattcttctcatcgcagtgctccaggcagccactaccaatcgattggagttagcctgtgaggtaaaacctatttgtcatgtctcacccagtcccgctccttatcctacattctagagaagagaacagactagctccgtgatcaaagtgaatcagtggcttgggcaggactagaactgaattttcttgactttcagcatttcctctatcccatgttgtcactcccttggagtcatctaccctgcttttctcctctagagtaaaagaacaaatataatttcttttctgcgtgctacctcttcagatattcaaagtcagttatgccattccccttgagtcttctcttccccagaggaaaatctcagtgccttcaaatttttttttcttaaaacaaggttttcaaatccctttaccatcctatgagctgttccttctatcttcttcccccctagggctatagaaatcccaagtgtggcttccacattcaccttctatagctatttatttattcaataaatatatattgagcaccttctacgtgccaggcactgttgtagcactggctgactgtatggcttgcgttttggtcagtagagagaaacacgtcgattcgatacctgagag

SEQ ID NO: 148701 - DNA, 220 bp, Homo sapiens
cgccaccacacccggctaatttttatatttttagtagagatggagtttcgccatgttggccaggctggtctcaaactcctgacctcaagtgatctgcctgcctcagcctcccaaagtgctagaattataggagtgagccaccacacctggccagattaggcatgtttttaatagatacgttatatcatacaatgaaagtgtgctcggcgccgaaggggcc

SEQ ID NO: 148702 - DNA, 476 bp, Homo sapiens
atagggagacagtggggaaccgggcacagtcctcaccctcagggaggttacagtctgacaacaaactaacagacgtggatccatgttggcactgccagctgggcaactcacttagtctttccaagcctcagtttcttcatctgcaagatggagatgataatagcactcatttatagggttcctgaggcttatcaggagacaaggctgcaaagtgattcgtagaatgcctggcacattaaaggctctcaaaaatgttaattattcttgttattattgtgacgaatgacgctgttactgggaattaggtaggaacttggagctgcttagaaaaaagataaatgaattgcttttcatcctctgggcaaaccagttacccttaggaggcagaacattcagaatttcaaagaaggaggattgagtaggcatggatcttaaaaagttgaggtaaaaagcagcaaggcaaagaaacaaaaaac

SEQ ID NO: 148703 - DNA, 373 bp, Homo sapiens
ttgttcttactgtgcatgatattttattgtgatttagaaaaaagatgtatctgcgaaaaatagaaaatatactggccgacaaaataaagattacaaaagagctcatcagggtagaataaagggccaagattaacgaaagtacaattcacaaggctaagtgttaaggcccaagtagtcaactgcacaagaatcagataaggaattctgattccagtaaaaactctgaaaaaggaacttgtttagctggtgtatttttcaatttgaggctcagtaatgaggatgcacactgaagaacaatatccagaaaataaggtagaacagtcctcttctggattcattagaccacacttggtatacagagtttgcttctatc

SEQ ID NO: 148704 - DNA, 235 bp, Homo sapiens
atacaaaaaactaaaaaattcagaaatgttgggtgtgctgggccaactgcataccgcattaaatacacaattaagtccccatatatacttctttatctttaggagtgaattggttactctcagttctttgctttgattccaatttatgtgaatctatagcttatttgagagctcattcctatctattaacaaggtataactctccatttatttattccacagcatctttctacaa

SEQ ID NO: 148705 - DNA, 205 bp, Homo sapiens
gagccatgcggaccctgggggagccaaggagaccacaaatgcaccggacgtggggcaacaaacccaagtgatcaccaggagttgtggattcccactagtacaacctgtaaaggttttctttcttttcttttaaattattattatttatttttgaggcggagtctcgctctgtcgcccaggctggaatgcagtggcacaatctcgg

SEQ ID NO: 148706 - DNA, 417 bp, Homo sapiens
gtaccaaatcatgggatccattcagcttggtggttaagaggtgaagagctatgccatctgaaagaagtaccaagatggaaatcttgcagggaggtcaggtagaaatcagtgaaggagagagcaaccaaggtttcccaattagatggaaagtagaaaagagcagaatggaaagacatacagaaaaccatgtaataacatgaaaggaattaaggaacatttaagtcctttagaagtgtgctgagtctgaagtagtttgtagtgcaaggttaagatgactgtagcattttttgagtggaatacactgaggagaaacaaaaacagtctaatgatttccgtggcttctagagagttgcaacattcattttctgcagtttaaattatgtttcctatggcaagaaaatagctgcatagataaac

SEQ ID NO: 148707 - DNA, 327 bp, Homo sapiens
tgctgttgtttcttggtgctgcctggcactgccaccctgatggtcggctctgagttggaggccagctttcatggcagcgttgttggtgggcgtgcagggtgtgtctgacctgggcctgggcatcaggtcccattgtggttgggtccacagggccccttgcctcattcgtggaggtgctgggggaattctacaggctgaggacgtgtgaggctccagggtccagcgtgcaggccggatgttcctagcgttgccggccacgcagacagccgtgccaccaggaggttccctggcaatgggagacaattgtctgctcagttcagccttcag

SEQ ID NO: 148708 - DNA, 332 bp, Homo sapiens
tattggcagatgacaccaaattactgttgtttgaaagaagaaccaggactggattgggaaggagtgggtagatccatgctgttgataacattctagttcatggattggccagtgagctcacagatgtttgttaagttacatataattaaaataaaagagggtcttgaatggaccagtgatgagagagtgttccatgacccatgatctaattctgggcacctgaagttaaggaaaaagaaggttatgctaattccaagatactttcctctgtcctgctagagtgttacctgaatgcaagattagcatttctcaaggaaatccagcatgttcct

SEQ ID NO: 148709 - DNA, 383 bp, Homo sapiens
cctgggcaacatagcaggatcccatctcaatttaaaaaaaggagtaattcagaatatgaaaaaaaaagtatgggaaaaggtcaataaagaaatagaagtatggccaggcatgttgcctgacacctgtaatcccagcactttgggaggctgaggtgggtggattacctgaggccaggagttcgagaccagcctggccaacatggtgaaaccctgtctctactaaaaatacaaaaaattagccaggcatggtgtgggtgcctgtaatcccagctactcgggaggctgagacgggagaggcacttgaacctgggaggcggaggttgcagtgagctgagactgcgccactgcactacagcctgggccacatagtgagactccatctc

SEQ ID NO: 148710 - DNA, 439 bp, Homo sapiens
gccagacgagggtgggcataaactggggaaccctatggcttctcttcccctcccggatcagagaaaagggtgccgctaaggctggaggttgtagaaatccaactgggtccccagacttccatttctgtgggcaaggtactctggctccaaacccatgcacaagttgctgttctcatagcaacgctaatccctgtgcctgagggcacttccgccttgcctgggtgctggttgtgttggggcatgggagacaggtgcacctgcagaaggaatttgcctgcttctcatgccaccacacccatttaacatttcatgccccaaatccctggtgtggtcaggcagatccccaaggagcctgaatcacccccctacccgacagtaatttcactgctacagtcaaacacatccttctcctccatgctggcctgtggttcactggggg

SEQ ID NO: 148711 - DNA, 354 bp, Homo sapiens
cagattttcccgaacagaacttctgccttcagctttctggcataccctaaagcagtttcctacagttcatgctctgacccgaatttaatactcctatccagcctggcctcaggttagaatcacacatgtatcttgcaactacttgccgctaaaccccagcttaggctgaaccctttcttgagagcagagactattgctcacactgtaactagcatggtgcctgattcccactagggtctcagaattattcattaaacgagtaagtatcaggtactaaaactgtgccaaaatgtaaagacagaaacaattactaataaattgttactctattattatcagcaagaatacttttaa

SEQ ID NO: 148712 - DNA, 1466 bp, Homo sapiens
gcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcaccgggcccccgcgcgtcgcggacaccgtgttcctcgtgggcgagggcgccgtcgagcgcatggcggagcgcgacgagcccacgccccggcctccgccccggcgcccagcgcgggcctttgaggatgaggaggaggaagacctgctcataggcggcgctggttcccgggctctgggcgcccccgggggcagcttccgcgccctggaagccgctccaggactgggcacctgagcctatgttctggctgatgggcttcagccactctgagaggaggggctctaggaagctttggctggttaggcctgcgggactggtgggtccctacttaggtcaatggaacggctacttttggcgagttgccgggcacaggcagggctggggctcatcttcagacactcctaggtagtaagaggactgactataccctggctgatctgtgggcaattgtcagaccaagaagtctgggctgggtccagtccccgatggagccactgataacagaggcaccagcttcctcctggaaccagggtctctgagggccacagaattgtcacgtctccctgagtctggatgcagggcacccaacaccctccctctttctggggtttgggtctcctaggcccaccctttctaggacaggagccgctacctctgggatggactgcgtgcctgtgtggggcaggactgcccttgcgaggagggcctggccaggagcaggggcttggagtggggctggtgcccgggacagaagtgggaaatagatgggggccccaacaccgaagctgccctcacccctccatcagggctgatcgtacatacctccctcctcggccccctgagattggtatggggcacagaaggcagggggtcacccccaccctattctgttctcttctcccagcctcccagcatgtgcctggaaccttaaatgggcacagccagggtggctggcatgggactggcactctgtacctccactccgtcaccagggacagccccgagggggtgaggagaggggccttgctctgcaattcccagagccagatcttcctcatccaagcaataacgggacgagggagccagggccaaggacactcagggacactgttggggcagcggccccacatggtaatgttttctttagagagaagaaaaaacaactggctgtaaacgtaaattatatttcttggagaaagaaaaaaaa

SEQ ID NO: 148713 - DNA, 1639 bp, Homo sapiens
gcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcaccgggcccccgcgcgtcgcggacaccgtgttcctcgtgggcgagggcgccgtcgagcgcatggcggagcgcgacgagcccacgccccggcctccgccccggcgcccagcgcgggcctttgaggatgaggaggaggaagacctgctcataggcggcgctggttcccgggctctgggcgcccccgggggcagcttccgcgccctggaagccgctccaggactgggcacctgagcctatgttctggctgatgggcttcagccactctgagaggaggggctctaggaagctttggctggttaggcctgcgggactggtgggtccctacttaggtcaatggaacggctacttttggcgagttgccgggcacaggcagggctggggctcatcttcagacactcctaggtagtaagaggactgactataccctggctgatctgtgggcaattgtcagaccaagaagtctgggctgggtccagtccccgatggagccactgataacagaggcaccagcttcctcctggaaccagggtctctgagggccacagaattgtcacgtctccctgagtctggatgcagggcacccaacaccctccctctttctggggtttgggtctcctaggcccaccctttctaggacaggagccgctacctctgggatggactgcgtgcctgtgtggggcaggactgcccttgcgaggagggcctggccaggagcaggggcttggagtggggctggtgcccgggacagaagtgggaaatagatgggggccccaacaccgaagctgccctcacccctccatcagggctgatcgtacatacctccctcctcggccccctgagattggtatggggcacagaaggcagggggtcacccccaccctattctgttctcttctcccagcctcccagcatgtgcctggaaccttgctgggaagagagagctccccctccactccccaccccatagcctgagccttccagctgtcaagtttgaaaagaagccaccgtgcctccagggcctcctgcaccgcagagaggggctctctgctctgggaggctgctcagcgcctctcccacggcctgcactctcctttcccttaaatgggcacagccagggtggctggcatgggactggcactctgtacctccactccgtcaccagggacagccccgagggggtgaggagaggggccttgctctgcaattcccagagccagatcttcctcatccaagcaataacgggacgagggagccagggccaaggacactcagggacactgttggggcagcggccccacatggtaatgttttctttagagagaagaaaaaacaactggctgtaaacgtaaattatatttcttggagaaagaaaaaaaa

SEQ ID NO: 148714 - DNA, 259 bp, Homo sapiens
acattgcccagtgctatgcttaatctggtatgtacacgtcaacaattcccatatctctaagttccagcctcttctccttaaactcctgactcatttatccaaccactgcagatgtttcatggtcatctcaaacttaatgtgtccaaaagtcatgtttctagtgttcccctgaaacctgctcttcataaattgttacccatctcaataaagagcaactccattctttagttgctcaggccccagacctgagcaagccagg

SEQ ID NO: 148715 - DNA, 141 bp, Homo sapiens
cggccagtctctgggttcgtggaagaggaggccacgtagaaaaagtaggggacaaggcagggtccctcactactgtgtgggaagcccgcgtggggtgagctgggagctctgagtgcagcgcacctggccgtggggcaggcc

SEQ ID NO: 148716 - DNA, 491 bp, Homo sapiens
aagcaaggagtgctcaagaagggaagaaaaacaaaatggaagagacagactaacaccacatggataaagagactttattatattttaaaattatatacagtaattattatatacattcattcataaattctatataagtaaacattctaatcacagtgtttcaattccatttttctcaaaacacacacacacacacacacacacacgaaaagcctgtaacctttgaaagcctaaaatgtaggagttcctccaggtactcacttcatagttcagatggatcttaccagattattagcaacaagaattcagtgcctatatcacagttaaaattatagttaaaatatttaatagagggacacccaccctcaatgcgggtgggcaccatccaattggtcaggggtatggataaaacaaaaatgcataggaaagctcgctctctcctggacctaagacaccctccttctggtgcttttggacatccaaactccagg

SEQ ID NO: 148717 - DNA, 324 bp, Homo sapiens
cgagctcgctacccggccactctagtccaaacaccaccaaatgacagagatgcagaccaagacaaaaggaaaaaacaacagaagggatttttgtccttgagacgtgctatgcaaattcttttcaattagtttcctattaatgattccatcttgaacatttagagctgctcaacccaggcagcatctacgttttgaagtagtaagttctccattcctagcagagtcggaggagaagctcagctgttatccaccagaaattctattaaaaggatgaaaggttgaactagatgacttctcattctgaagactgtaattcagcagaac

SEQ ID NO: 148718 - DNA, 172 bp, Homo sapiens
aaaaaaaaaaaaaaaaaaaaaaaaaaaaaaggcaatcatctgcaacccctaactggccttctaaatactgcacatttgaatttataaaatatatttatgctaacagaatgacttcttacctgttacttatatgaatcttactaagtttcattcaaagaagggtcctacttct

SEQ ID NO: 148719 - DNA, 365 bp, Homo sapiens
gcagttggttcaaagttacaagtgcttgtgaccctcccttgagctcctccaggcccacccctgtacagaattcaagggccacctgaacaaactccttgctttttctcatttttgggctccttcgttcatgctacaaagaggatctgagggacagagtggcgtctctactagctggggtaagggaggaaatggacagtaatgggggacagggccaagaagagggatggtgatgaatactccagagcaggatcgggtagcagggcactgggtctctcagcatgtatagcccttccaggcccaatagctccatgcgcagctcatcttctagccctagccccaactccaaccctgctactgacacctca

SEQ ID NO: 148720 - DNA, 481 bp, Homo sapiens
cttcctggttgtttattttcttgccctcagtgaggccaggctctctgggggtggcgaccctgagggacccatttgactgagaccgcctttctccagccacccgaggccttcccaaggcagcagcagcagtgccctcccattccaccctcataattcaaggtggctgtgccccattgcactgagaaatggcaagaaggaggcgtcagcacacccatgagtgtgactctgcagagtctctcacaactgctggggggataagcatgccagcctagctcgtgtacatgccagtgctttctaagccctaaagcccacataggcacagctgccccttcagtgaccagtgggatttcctggggcagggatcttgtatcaccctctgcctcctggtctccacagaacaggaatcccaccttctgtatgtgcacagcagtgcaacaacagtgcatccattctgaagggagggctaatggcaggatcagag

SEQ ID NO: 148721 - DNA, 444 bp, Homo sapiens
tggcttcacccccaagaggccacacctggccgcagcacagtttatctggcccgtttcagaagcagcgtcagagagtcacagagtggcgaacgcaggagaatctgtgcgcgagaatctgtgttctagcatccatgcaagcgagggaaaggcgtttcgtcgttagaaaaatgcaaaatgagtgattctcacccacacgtgagactggattcagcaccacagtgtggctcccgtctgctgggagccagtagtgtttgtgctttggttttgctttttagctgcagagttcacgtgaggtgtggacatttgagttgctctatcgttacagggagcttgccttttctctgctggttggttttcacttttgctgtctctgtttagaagaaggcactggaacgggggtgtggtgggaagggccctgttgccgggatgggagcacagtcaggg

SEQ ID NO: 148722 - DNA, 296 bp, Homo sapiens
agctgagaacaagaaacaaaaagaggaacccaaggatatcttggggcacttgtcaagcgtctggctgaggacagggtgctgaggacacagcgggagccagatgctgtccctgtccttgagagcttactgtgcagtcagcaagcgaggcacatcaatagatcatttccatagaatacagtaagtgagacaatggatgcgtgtttgtgtggctccaggaatttggccaaaaatggtttagcagaaagcactttggctccctgccgaaggggaaatggacagcctgtcttccctcttct

SEQ ID NO: 148723 - DNA, 570 bp, Homo sapiens
gcagtgtacttgctagaagtgaggcatagatttgcttcaaatttctcccaccatatatcctcactcatggctctgaacttccactttacagaaagacctagggatgagcacaattcagccacattcctagccactttaagggaaggatggcctttgctccattttccgatgagctattcttctttttctcctgagacctcatcagaatggcctttattgtccacggttctaccaacattctaatgatcatcacctaaataatctctaagaagtttcagaatttcctcacagctgtcttcttctgagtcctcaaaagaatacccctagtgttctagtcatggcaatctagactttttataacctgatcctccaaattattccagtctctgtgcattactacttccacttctacattttgggatatttgttatcacaacagccccacctcttgatactgattttttgtcttagtccactttgtggtgcaatgagtgaataccacacactggctaatgtgtaaggaaaagaaatttattttctcccagctctagaggctgggaagtcaatgtc

SEQ ID NO: 148724 - DNA, 421 bp, Homo sapiens
agaacacaaaatctgcagtgtctgtataacctatcatgtgtaactgggcacaccccaccgtaaaaacattaagcagcctacattatgctcatatcagggacaattattcctcagactgctttatagtaaaaaatccattagattagcaatagcagcccttatacagataaataaaatgaggatcaggagataaaaaccttggaactgttgcataaactgcaccaaaatggaaaaacagggatttgtaacatccttgccagatgttagctgtaaggtatgtttctgtaagaagtggatttagacacagactagtgcagagaccatcttccaggcaagatactgcctgactcctgggcaaactccttttgtggatgcctccagccttttttcttgaattttttctcttactcattttctactg

SEQ ID NO: 148725 - DNA, 291 bp, Homo sapiens
acaatagctgttgtggtgagaatagactataggatggcaagggtgagtgcagggaggccagtcaggaggctattgcagtaatccaagtgagaaatgatggtggcttggaccagggtggtaggagtagaatactgagaagcagtcagattgttgggtgcattttaatgtaaaagcaggatttaacaaggctttacatatttgaggagcctctgtctagggtgatatggtttggctctgtctccacccaaagtctcatcttgagttgtcatcctcataatccccatctgtcaa

SEQ ID NO: 148726 - DNA, 642 bp, Homo sapiens
tggtaataaatcagaagaataaacaatgagtatcttagtttctacttacgcacaaagctttctcataaactctcccattcatgacacagtgttctcaatagcagtttgacatagctgatgcagacattcaaataggaacatgagttatgaagatattcaaataggaagaggggtataaaaaagacttactgataggagagcagagaaatgataattttgatttcggtcagattactctggctgttacatagagaactgactgcaggaaatacaaagggaaattaggaagctacttcagtggtgtggtcaaaaaattacgacctccaaaaatgtccacacacgaataatccccagaacctgtgactatgttaccttacgtggtgaaagggacactgcagtgtaattaagtggacacaccttgagatggggagattattccgcatttctcaagtagcccaatttaatcgtatgaattcttaaaagcagagggtctttctggctatgtcagaaagataagatgtgagaaggactcaatctgctgctgctggatgagatgaagaagaggaccacgaactaaaggaatgtgagagtctctagaacctggaaacaaccctcagctgaaaaccagcaagaaatctggat

SEQ ID NO: 148727 - DNA, 275 bp, Homo sapiens
gtctgtgggcttttctgggtccaccctgaagactccctgagtgtccttgactcatcattgtttgcttacgtggagcttaaggagagttctcttttccctgacacatgtactcaataattttgtatgcgatctgctgctttgggggtttttagattatcaaatggataaataatcttagccttggcacaagaaaagctctttagttcttaacctgaagaagacttgaatgtgatttccaagtaagaaagttggaatgatgttgacatgggagtgga

SEQ ID NO: 148728 - DNA, 271 bp, Homo sapiens
caacatgctaaccacggtgctgcttgctttacgtatattgtatcttaaacaatcacaacggctgtttccatccagcaattggagattgttttcgagcatggttacttgtttccacaggcatgctattaacaggtgtcaagcaaaaggaaagctttttttttttcctcttttaatgaacaggaagactgagtttacagctcctgatgcgaaccagttcaagttcagttgcccctcaatgtactcctttttaattagaaaaacaacaaatgta

SEQ ID NO: 148729 - DNA, 417 bp, Homo sapiens
gctcaaaagccaaaatcacctaacagtttctcaaaacagcactgttaacttttgggcacacaggtctttgttgtggaggggcaatcctatgtggaggttttagcagcacccctggcctctgcccactagatacagtagcactcccatccaccctgcctcctacattgtgacaataaaaaatatttgacagacattgtcaaatatcccctaggggcaccccccaacactggttgagaaccactggcctaacaccaagaattattttctcaatatctaacatttagagtcacctttgaacacattttttaaaaaaaaacagtttggccggctacagtggctcatgcctgtaatcccagcatttgggaggccaaggtgggcagatcacctaaggtcgggagtttgagaccagcctgatca

SEQ ID NO: 148730 - DNA, 418 bp, Homo sapiens
tgacctcatttttatggcatcccactgtatagctgcttcttcactcttatttaggcagtgtcttcgcagtttcctgccttgaatacctcttgtatacatttaccaccttaattatttgctgtgtacattttccttgatgccttctccccactatgacagcagattccctcttctgattttccactgatcagcacggcccttcaaaaaccttcacaaaagcccgttagaaacagattgagagacgcatttgtgaagctatttaacaaatttaagtgtcatttttaaagtattcattgtaaattggagcattgtttcatatcggtatcattggagcattgtttgatatcggtaacttgctttaaactgattaagcacatgtaaagatacatgctaccaatagaagaggatgaaaccgaga

SEQ ID NO: 148731 - DNA, 497 bp, Homo sapiens
ctgagattgtcacattccagcaatgacatcaccaagttgtgtaaggattgttgtatgtattaaaactgaagatcacaaacttttgagagcacaaatctatgccttcacttgcataagcttaccgagtgcctttatgtggatttattggcatgtgttcataggaaagaagtggtcacaattttaatgcataatgtgatgtgtcagtaagtgtatatttggattatttatttgttaaacaaatgtgtattgggtacctcctttgcctggcacaccattagaaactaggaaactgaaagtcagtatgacacttctgtgccctcatgaaggttatgacctgatgcagaagaagtaaaccaaccattaggagacagtacaacaaccagtgtaatagaaataggcccgggaaataggaagtttctttcagatgaaatgggatctacagagacaactgcattgtctgggagaaacctggagggaagggggcattcttggcagaa

SEQ ID NO: 148732 - DNA, 406 bp, Homo sapiens
aacctggatgatgctaatctagaaggacattcacagctcatgaaagaatcatcactgctaatcaaatcagagagaaaacccaccactctgcaccactggagacatttcatgtactgaatatttcataagatgggggctgtaactgaagcagaaattctcaacagcttcaggttgcgtgcaaatatttacttaaacattccagcacagtccaactggtgtgcagcaccagcaccagtgagcctggagtgatctttataaattatggtaattatatgtgacatgattcttgctaggtcacaggagcttgccttggtctttcccgctttgccagtagttcccctacttgaatgattaagtgggcaggatgccacaggaaaccggatgcaagcacaatgacaaatgtctg

SEQ ID NO: 148733 - DNA, 295 bp, Homo sapiens
ttttgaccttcagtaactaatgaatattctagaaatgtcaccaatttaaaaaaaatcatgatttagatgagaggcaaaatggggtttacaagcttaagctcatcttgattattctactttgaaaatattctactttgaaaataacacttttatgaaattattaactatgtatgtttgaagcagcaaattttaagggtgacacagctggcaggcagaaaaacaaataaccacacctctttcttggcaaaagtgagaactgtttgaccttttgcttgaaggagtactgtttaaacac

SEQ ID NO: 148734 - DNA, 358 bp, Homo sapiens
gattcagatgcagggagcatctgtgaacttcagggtgaaatccccgattcggtcctggtactcacatgcacttgtaagacacatctttggggacagctgtaaggttcacccccaaacgccaccagggaagggagctggaggagacctttgcctttcctgcctataaagcagacccagtagaggctgcaattggggtggggcaggaagacaaaccctgcacaaggtcagtgccacctctgtctagctagctgccctcagcctgagcttttccacggagaatattcctctacccaggaaaatcattatcagcccggcagcaacagcagcagctgttctctggcccaggaagaaaggttcc

SEQ ID NO: 148735 - DNA, 287 bp, Homo sapiens
cagcaaggttctccttctctagaaggcttctcatgacacagaggcctagtattctgaccagcatctccatagagtcctttccttttattctctttatgctttgttggaatgattggccatgaaatattacaacctgtggcatgtccagacgcgagcgggcccccgaaagcagagtgctgacggctgcgtttgctgtgctttgaggctggcatgcggggcctgacctagatcaccagccagcccttgttctcctggatgtcttagggctctgtcctggcacaggggcc

SEQ ID NO: 148736 - DNA, 443 bp, Homo sapiens
ccaggatgagtgtatcccccctttcttcctaacaggctctgggtggtgcagagcaaaggggtggtgacgagaaggggagaagaggagagagggaaggagagcatgacacatacaggaagagaaccgataaacagagtcaaaggaggctctggcagacggattacatggagcataaaaagaatttcccaactgggaagcatgcctgcaaagacatttgctatcttaagaaaaataaatctcacatcctcgagtctggccatggctggtgaatctccacttggggaagggcggctcagccccaaatctggcttctaagactcttcaggtgcctgagattccgtctgtcatcaagccatcttcccccactcttctggcctcaagagctgctccctcgcttgccatcctggcccaattttatacacagtcccatcctttaatcctcc

SEQ ID NO: 148737 - DNA, 438 bp, Homo sapiens
tatttaatgcttcagcattgtatctctctgccttcatgttggttggttcttccaggaagcagacaccaacatgggattagaaatgcaaaagatctattggggaaagataatagggaaagggaaaaagagtaggtagggaaactttagactgcaataccaagtgagacacatgaaaaagaaaggaatcaagtacaatcagataggaagagcattgtactgcaatgtaactctgagcaacaaggaacttttgtgcaaagatcatctatagaggagtccccattggttgggagtggcaagccttgcttggttattggctggagctaccttagtagagcatgacctcagcttcaaagccgtggcagatcctaaagacacccacagctaggagctgtcagctaactctactccttgtggcagattttgtcttgaaaataaatc

SEQ ID NO: 148738 - DNA, 490 bp, Homo sapiens
tgtgcatctatcagagaggatgcagggcatgcaaggcaaggcaaaaagtagtgcctttaaagacacaggagggctgctatggctggaagaaaaatgactcacaaaaatgtactactgttgcacactagtgctctggtgactgaaaaggcttgggtaaagatgagagatatctgtccagatgtgtatggggatggggataagaagtgggtgcatgtatagctgcactatgaaggcatgtgtgaatacatatgcatatgcatatgcatgcagtgagattgcatccacacgcttgcatgcagcagtaatgcagaacaggtaggtgtgcagtcttccttctaggaattatcctcagcccccaccccatctttcctgcttgggttctagttctggctctgtcacttactagctggatcatcttggacaatctgcttaacttctttggatccctgtttgtccatctgtgcatggaccggggatccttagagtgacc

SEQ ID NO: 148739 - DNA, 497 bp, Homo sapiens
  misc_feature (1)..(1): n is a, c, g, or t
  misc_feature (12)..(13): n is a, c, g, or t
nattttactttnncccggccgcagagctccaccgctgaggccaacgaggccaaggctttattgccttaaaaaaaatacttcaagcacatatgacaaaatttgaaaagttaatatttctaggtgttaacatttctaggaatataggtttttgttacatcatcctttatactttctcaaattaaaataccacaagcaaataggacaaaatttgaaaagttaatatttctaggtgttaccatttctaggaatatgggtttttgttacattatcctttatactttcccatatttttattttatttcccattaccctttatactttcccatatttattcaaaacaaaaaaatggaaagcttctgtgcttattctgagctgttatccaagtgtgggtagaacatgaatgaactccaaagcagtccaggttcaagtccatgaagtctagcagatgagctcagctcccgtccggagcagacacagggctgtaatgcatcccccat

SEQ ID NO: 148740 - DNA, 815 bp, Homo sapiens
cagaaatatctggggagaggctttggaatcataaagagtcggaattaaaatactgttgtgccacttaccaactttgggacaagccgatctgtctgcacctcaatctcccagtctgtgaattgggaccagtgattcctaccacctgggggtactgtggacattcaccaacacgatggatgtgaaagcatcccacttatctcagtggttaagttgcaagaatatttccaaagcagatgccaaactgtacgctgatgccaaaagcaagtatttgcaaaactgtaaaggaaggagaagaaaacatcagcctcttgggaagctaccaaaggagagagaacctggactcagtttgttctgctctcttttagggaaggaggagtgagctcctagctagtgagaggcctctgtacgttgggactgtgcattcactaactccactgtccttacatttgccatttatttgaaaaagatgacctgtgtgtacgaggacctgggtttgaatcttgacttgttatatatgggttgtgagaccctggataaaccactgaactttttcgggcttcagattcctcatctgtgaaacagagaccataatgccaaccttattctaattttgtggaaaaagaaaagcataataacaaatgcaaaatcctagcagagttaataggacagaaaaggtactcaattggctattgtttttaattaatggaaaaatgatattaaacaatagctttctagaaaatgtatatgtttgtggtatattaacataaaaacatgttaaaaaacaagtaataaaactgtatatgcgttcttcaata

SEQ ID NO: 148741 - DNA, 830 bp, Homo sapiens
  misc_feature (13)..(13): n is a, c, g, or t
  misc_feature (83)..(83): n is a, c, g, or t
  misc_feature (86)..(87): n is a, c, g, or t
acatacaagttgnccatggcatgctctggcctccagtcctctacaaagatgtagggcaggaactaccagttgtcagcacagcnccnncccacattgctcttctaatggagcctttcacctcagatgttgtttctcgactgatgggaaggatccaagtatgtaaagattatgttctagatcagctttggtctgtcctttcacaaaagatgtcttttctgcctttagttgcaagaatatttccaaagcagatgccaaactgtacgctgatgccaaaagcaagtatttgcaaaactgtaaaggaaggagaagaaaacatcagcctcttgggaagctaccaaaggagagagaacctggactcagtttgttctgctctcttttagggaaggaggagtgagctcctagctagtgagaggcctctgtacgttgggactgtgcattcactaactccactgtccttacatttgccatttatttgaaaaagatgacctgtgtgtacgaggacctgggtttgaatcttgacttgttatatatgggttgtgagaccctggataaaccactgaactttttcgggcttcagattcctcatctgtgaaacagagaccataatgccaaccttattctaattttgtggaaaaagaaaagcataataacaaatgcaaaatcctagcagagttaataggacagaaaaggtactcaattggctattgtttttaattaatggaaaaatgatattaaacaatagctttctagaaaatgtatatgtttgtggtatattaacataaaaacatgttaaaaaacaagtaataaaactgtatatgcgttcttcaata

SEQ ID NO: 148742 - DNA, 519 bp, Homo sapiens
tacttacacagggtcttgctgtgttgaccaggctggtctggaactcctggcctccagtagtcctcctgcctcagagtccctgagtgctgaaattacaggtgtgagccaccatgcccagccagaagcatccattgaaatataggtgacatactagtaagagatacttgttatcccaccgtcaaaattgatccctaaggaatttttgtattttttgtagagatgggtctcactttgttgcctaggctggtctggaactcctgggctcaagcgatcctcctgcctcagactcccaagtagctgtgactacaggcatgcacagccatgcttggaaaaggtccctaaagaattctaatcctcccttccccatcattccagtttgcggacattttttaaaataaaaactaaaggggaaaataaagatgagatcactggttgccttgtaaccagtgttttactgtatttgatttatttggcctgtaggtgttttccatttggggagctaaagaccctgggagctca

SEQ ID NO: 148743 - DNA, 516 bp, Homo sapiens
  misc_feature (37)..(37): n is a, c, g, or t
  misc_feature (496)..(496): n is a, c, g, or t
ccttttctaggactcttcaccaaataaccaggaaagnattaaccacagggagaaaagagactaaagtcagttgtcatcacatccagataaactttccatctattcttctgaagacagctttgagagattacctgggagacattatctgcacgatgagacaacatttgttcacagtgaagttccactactcaccttcccatcacctcccccaaagcacagaggaactttgtcctagtccattgttcttttgagttattcatttcccctggaaattatttactacccctcacaattgcttacatttccccttctccttctcccctatgaagatggtatataccgaccgtccaacctttcgagtttcatattttatgtggctcccacgcatatgcacattaataaattcatatgccttttatcctaaaaaaaaaggagaaagaaataaagatcaatccatatccaaaaaacaaaaacaaaacaaccggacaactaattnttggggcctttttggcctca

SEQ ID NO: 148744 - DNA, 204 bp, Homo sapiens
taggtaaacttccaggattttgccagtcgtgtgggacaaaaaagagagagagactacagagggaggcttctgtctgttactgtctggtcacccttagtaagtagcaggcaaatacattagaaactcagatttctgtgtatgagacacaccagagtgggccgagggaagagagaatcctgtttggagtgaggaggaggcaggagt

SEQ ID NO: 148745 - DNA, 249 bp, Homo sapiens
tccctccagcccccagctcgggcatgggggagggtggttggacaagatgacctctgaggtttcttctacaaagaggtggattcctctctctgcctggctgacagctgagtgacaggcctgctctgggaggacatccagatgccagtttctggtgcacccggggaactggagttcaaacaatttcacccttccacctgcccagctctgcgcttgttaccgagagctgcttctcgggctatggaatgggcg

SEQ ID NO: 148746 - DNA, 211 bp, Homo sapiens
ttactcatctgtagcacaaagggttccttatcttccctcagtttaagttaatggctgttagccaaaattcttgatttctaagacaaaatttagggaaataataaaaactggccaaactactactaaacatactatttttcatttctttacattgaggtatgtgaattaaagacaagcctgttctttccagcaataagatccaccttttttt

SEQ ID NO: 148747 - DNA, 122 bp, Homo sapiens
cattagtcagattcaccaaatagcagcacactcttattccattgctatggaggcataaaatatatcctcttctggctggtcgcggtggctcatgcctgtaatcccagcactttgggaggccg

SEQ ID NO: 148748 - DNA, 551 bp, Homo sapiens
ggcagaaagccagggggaaaggttctggcagaggggagcgtgaagtgtgtaaagttaggaagtatccagagaggaagaagaaaagaaagggtgtgcaggtttaaggagtccaacaagcagggcacccaggagaaacttgatggcaagctctagaccttacaccagaccttggaatcactttcttagagaagatgtctctctctaaaccatctcctaggaaaggtcaggagagctgcggcagagtctgggagcactggagagtgctgtgctgcaaggcgcaacgtccacctcccctaaggacagttgggaaaggttgaccatgaaccctcttgcttccactgttctcttagaacgctccagaatcaaggcgctttctgtggaactctacttcaagggcctctttcttggtgggcatgtctaactagcaggtggataacagttctttgtgacattggttatttcttaagagaacctccaggtctgccaccaaaagtgcacgagtaattgcaatgggaaaggaactgacgcttattacaatattaataccagga

SEQ ID NO: 148749 - DNA, 285 bp, Homo sapiens
cctggacaaactttgggttctagcgaagtgggctgagcccagtggaatagattactctttggtaataaagaaccatcaattcttagttaattgtttaggtccctacagaagaatgataaagacagcagcctcctggctttcaattcaattcaccttgcttgtgggggtgctgcagaacttacagaagtatttccagaggaggccacgcctttaaacagcctacaacaaaacatttggcctttggcacttaatgtattgaccatgactaagagcctgggtgtggga

SEQ ID NO: 148750 - DNA, 491 bp, Homo sapiens
actcagcgaactctctgatctttgacaaacctgagaaaaacaagcaatggggaaaggattccctatttaataaatggtgctgggaaaactggctagccatatgcagaaagctgaaactggatcccttccatgctgtggaagctttgtactgtcactctgctcaataaagcctgcagctttttattctctcggtctgctccatgtctctctttcaccgtgggctgccgccacaccaaatctttggcgtggctaaggcaagaacctgctgggattacaggtgtgagccactacaaccagtctcatcttgcattttaaatggttctttttttatgcaggatttttgtgctttggccattttgaaaatattgattcaatgagttgtagacttccaaatgttgacatagttcattatatagtatcgaaaactacatttattactatcaccacaaatttcataagaaaagtattttaacactagatggctgggcgca

SEQ ID NO: 148751 - DNA, 520 bp, Homo sapiens
cgatactgggactataggcactatagtaccataggtaccataaatacaacatagctgtgcgtggtagtgggtgcctgcaatcccagctactcaggaggctgagatgggaggatcacctgagtccagaagtttcaggctgcagtgaggtataatcatgccactgcattccagcctgggtgacagaactctgagaccctgtctgaaaaaaataaaaaagttatcctgggcagacaaacagcttttatttctgaagcagagacattgtgcctggtggtaaaaataagaaagaggagagagcttctcatttcctttcacctctctgagaactaaaatttgttgggctcttaaatgctagataatcctcaccactaccctagaaggtaggtagtatatattttattgtgaggagtttgagactgaaaagctaactcacttattcaagaaatgttcattggtacctgctatgtcataaatactgtgccagattctataaaatattccgtggcttcatggggcattg

SEQ ID NO: 148752 - DNA, 249 bp, Homo sapiens
aaagatttttaaacggagtaatagatcacatatctgtgttagaaatacaactttaagatggcagataactgcatcttttttctgaggggcaaatccagtaatctcattaaaaaataattaataacagatttttttttttttgagacagagtttctcttttgtcgcccaggctggagtgcaatggtgtgatcttggctcactgcaacctctgcctccttggttcaagcaattctcctgcctcagcctcct

SEQ ID NO: 148753 - DNA, 741 bp, Homo sapiens
agaatcagaaacccacgatcaccagattttacccacatttgatcacttcaggaaacaggagttttctctgtaggaagctagaacccaaattctgctttaacatcaatgactgaatcaatcaaagcagactgtgggcaaggaagactgcagctttcccctcccctggtgtacatcttcccgcttcctcctctagactcaaaattcctgccacaagaaaaccagaagggatgagctcagaatgtatttctccctgtcactgccttcctgttgccccacctgtgccacctgatctccctacctcccctcagtaatgatctacaacatcatgtcaccccctcacaacaggggcattctcctctcagacatggagtcaccctgggactgagtgatcagcctggggatccccttggggctcaggcccccccttcctggctagcttgcggtaggggagtaggtgagaaggcaagagtggcttcagaattacagaatccagttgtttaatccctggcctgatcctctgggctccaaggctggggctgggtcctgagctcctcagaataggataaagggaggaaagagtggggcagtgatggagccaggtgaccttgggattatctgggttataaagcatacctttggtcagcagcaggggaggggacagtcctccttcctgtataccttctccctctgcccccacccaaggcctccttaccctttccctgcctgaggactttgagcacg

SEQ ID NO: 148754 - DNA, 413 bp, Homo sapiens
tgtatgctaaggctctccctggataaagtacatacctttcatgaggtagcccttgtgtctcaagacagcttcctgtcacactgcaacattcatctctccaggcactgagactgggacaaggacgagaagtaagtggtggtttgtgttttctttgcatttatgctcctaaccactgggtacacagcacactaagttagataaggttcaacctcaacaacagaccaggggcacctgtctgcatcttctaacaaccaatagctaatgctcatttgaaaaaaaataaatgaagggtttgacccaaggcatcaaagctttggattctgattttcctttgtctcaatggcttttagatttctaagacctccctttccgtttctctccatctgacctccaaccttccccagattcctaat

SEQ ID NO: 148755 - DNA, 441 bp, Homo sapiens
ggggtgactcttggtcagaggttgagtgtttccctaggtgtggaggtgcacggagaagagaggggtgcagttcttaaaggacacatggcttatgccacaccccctgccccaacccccggagtggccagctttcctttgactggggaggaggcagctgtccagggttgtcctcacctctcctcctggagaatgtggtcccttcagaaaggggacccagtagtgggtgacctggtgcaaaccacccactgcctcctctgggccttcctggggctcttcggctctcaggagaggagggagctcaggctgtggctgctctgtgagttggacacggacgctccagccgctgggcccagcagtgtgaatggccatagagaacaggggcccagaggctgctctcgaggacactggcagcagttgtgctctgggctcgccatccttgaa

SEQ ID NO: 148756 - DNA, 154 bp, Homo sapiens
tgcaaagcaaatctctctttttacaggcaaggaagctgggctaagtgagggaggctgggagagctgtcaagcggctgcattgcggtttgtgtgggggcagagctggggctgcttcccctctcgggctctgggagcgctgaggagggggaggctg

SEQ ID NO: 148757 - DNA, 545 bp, Homo sapiens
aaataagtttttgtctttataaagggatggtactataagccctgacagttatagtctttttaacgtcaactaccatacctaaacattgaaacagaaagatatccacattattcaaaaacagatcaaaagactgatttttttaaaaaaaatccatcatgattaaaaaagatgagtttaacacacaaacatgtcacctctgccaagtgatgtggagaaactccacatcaaactcaaaactgttcttcaatttcaaatcaagctattatcagaaatatttttaatagctccagtttgcaaagaggtgaatgtcaatttatggaacatttgccattgagcgaaagactgataaagaataagtacagttaacagatcttgcaactcccttactgataatccccagtgaaattaaaataaaggctgggggtggtggctcatgcctgtaatcccagcactttgggaggtcaaggcaggcagatgacttgagctcaggagttcaagaccagcctgggcaagatggtaaaaccccatctctaccaaacatacaa

SEQ ID NO: 148758 - DNA, 110 bp, Homo sapiens
tcccaaagtgctgggattacaggcatgagccaccatgccttgccaccattttttaagtgtacagttcagcagcatttagtgtagttgtgcaagcatcaccactatcccat

SEQ ID NO: 148759 - DNA, 311 bp, Homo sapiens
tgcctcagcctcccgagtagctgagattacaggcatgtgccaccacgcccagctaattttgtatttttttagtagaggcgggatttctccatgttggtcaggctagtctcaaactccagacctcaggtgatccacctgccacggcttcccaaagtgctgggattacaggcgtgagccaccacacccggcgagtaatagttcttaagtagaggaatgagatgttaagtgtgtgtcagaaaatgaatccctcctgccttattccattgtcatatccctttgggatactaaaatctcggggagggaaagcctat

SEQ ID NO: 148760 - DNA, 408 bp, Homo sapiens
aaactatctgaaaaggaaattagaaaaataatcccatttacagtagcaccaaaaataataaaatacgtaggaacaaacctactaaggagatgaaagatttctattctaaaaactacaaaacattgatgaaaaaaggtgcacaagacacaggaaaatggaaagttatcccatgttcatggattggaagacttaatattattaaaatgttcattcttcctgaaatgatctgcagactcactgaattcctatcaaaatcccagtggcattttaaaataaaaatagaataaataattctaaaattcatatggagctataaaagaccacaaataaccaaatcaatcttgagaaagaacaaaactggaggcactacattttctgatttcaaaatatattacaaagctacagtaa

SEQ ID NO: 148761 - DNA, 371 bp, Homo sapiens
ataagagtgtctgtgtttactctcctgtttaccaagccagtgctaaacacaacagcaccgagctgtttctcagctttcctctggtcccaacaaagaacccccaagtcaccacatcctatagggtttgaagtttcagcactacattctgccacttctttgttgtgttttttgttgttgctgtttcgttttgtttttttgagagagtctcactctgtcgccaaggctagagtacagtagcactgtgtcagctcactgcaacctccatctcctaggttcaagcaattctgcctcagcctcccaagtagctgagattacaggcgtccgtcaccatgcctggctagtttttatatttttagtagagacggggtttc

SEQ ID NO: 148762 - DNA, 384 bp, Homo sapiens
caccaaaagccactacctgaaaacaatgaccaatctagtattgggaaaataacagaaatgaaagcaactacttccaaaaagttatagggctgcttgagaaacaaacaaacaaaaacaagcagtttgttttgtttttgtttcatttaaagagtgttagtgttaaatataaaagaaataatcataaattatttttgtttcattttaaaaaatgattaaataaatgcatactgaacacagaaaaacagatttctgaagagtgacaggaagacaactgtattgattttctaggagtgaaacatctcaatcaaattcaaataaattaaatcagagcactaaaatgtgaagaagctgataagctttagaggagagagatgcttaaagcca

SEQ ID NO: 148763 - DNA, 178 bp, Homo sapiens
ccccattctcatgaaaacaggaatcataacaatgaagaaaaataaagtatgacctactgcaactatcatcagcaccccacagagtgggtacgcatgtgagtgtgtggtgtacatgtgggaatgtgtgcaagtgggcgcctgtgcatgtcagtgtgtggtgcgcgtgtgggaatgtgtg

SEQ ID NO: 148764 - DNA, 325 bp, Homo sapiens
taaaataaaaacatcatgttaacccaaaatgaaacaattgcaatattgaaaatgtatcttttaaactttagtggatgtttttccattttttattttctgttaagtattgctaaagggcctggcataaaggagggccactgagattacggtaagaaaagggttcattttcttcctgtggcaggtgttctgaccagttgaacactagggatgcaaagatgaaaggcaacaggatttttctgtaaggcccgtcatccagcaggaataggaaagtgcattgttctatgtaaagccatagagactggcctctggaagtggctggctctca

SEQ ID NO: 148765 - DNA, 229 bp, Homo sapiens
gaagaaacgaggataacactgactagagactataagaagaatgagttttgtttcatgaagcttttgtttccattacatgtatataagttcccatgcgtgtagtgtgttagtgctgtactacatgcttcttactgtgggttgtagtcaaaaccgctgcattatttggtagaataattggtgttccagtcttctgaaaatggttaatatctccaaatctcacactgtgaat

SEQ ID NO: 148766 - DNA, 135 bp, Homo sapiens
aagaggaagatgggaaaagcggattgggatattaaagttcagaggctgttaggtcaggaaggtgacctactccaaggataagagtagtttaaaaagagactaaaatctctgagaacaattactataaccccctca

SEQ ID NO: 148767 - DNA, 363 bp, Homo sapiens
tgcccgcctcggcctcccaaagtgctaggattacaggcacgagccaccacacccagctaaaatgggatccctctttcattcctcatgcattcaaaacctctcaggcaggaattttgtctgcttcacttttgtggtattttcagaacgtggaccatgcctggcccctggcatttagttgggaagtaatgaggcccagtgcagagaaggacaagcagctcatggttacgccctgctgtgcctgcaactctgtcacaggggaggccacgagcagggggtgcagaaaacagagctcgcagtgctgagtaggccctgtgcatgggagatgcctttgccctgggccctgcggaggtttcagacagatgg

SEQ ID NO: 148768 - DNA, 332 bp, Homo sapiens
ctcctgcctcagcctctcgagtagctgggactacaggcacatgccaccacgcccagctaatttctgtatttttagtagagacaggtttcaccatcttgaccaagatagtctcgatctcttgacctcgtaatccgcccgcctcagcctccgaagtgctgggattacaggcgtgagccaccgcgcccggccagcagcctttctttccttgaggattcttgccctgcccaggtgcagttaggccttagccaaggtcttagggaaacgcttatgcaacttttatgccacccctctggcacagttcccttccttcttgtactgtatctactaactct

SEQ ID NO: 148769 - DNA, 789 bp, Homo sapiens
ctaggctcagagaagaatggaagcagaggctggaaacaaagctgaggctgcggaacaatccagaggacactgaaaagaggacaaatgttggctgagagcttcctgcttcattgacacaagaagatgcaaaacactgaggtcactttgctagaagtcagtgcaaattcctgagtccctttgctataccaatcagctctcacactattgtttccccacctgggagaggacttacctgtaaatcctttcccagtgtttgatggcagttattggccaagtcagtcctctgtgcatgggcgccaggttattatcccaaatgtctctaaagatagcttatttaatatcgaagctccatgcagcattccttgcttctatataattatcttctaattttgaaatccaaatattttaaactctaaacacaccaagaggaatcctcaaccttcatggtcaaactttaaacactgtacagtggtattgccccaccatttcacctaggaaacacagctttatggaattcttgttttctttttatgagaagagaaatgcacctatctgcagaaattaaaaaacaattatcaatagtcaaagtacaatttgaaaataaattgatctaatattcttttttcttcatataaatttaattagctttttcaaaagtatgtttaccaagaataatatcagaataattttaataaaacttggttgtcctgtcatcactatgcacatgccttcattttattgctttattttaatctctgcatgtttacactggttggctctctgtcagcc

SEQ ID NO: 148770 - DNA, 512 bp, Homo sapiens
tttcacttctgtaaataaagggggagaaaatgaaatgtgattggaccaccctctccttctaccacctccttaataaagatgaggctggccccagaatcagaaattctgctaaattctcagggttaggaaagaatctgtagttcttccttttgtccttaattgttggatccctttcaatttgtgcagattctacaattacaggatcagccagcaggggtcagcaaggctccttaactgctatcaagcatagagcaagcctgcttttttccattatgagtataaataccagtgatagtaatactccatgaaacagcctaatgaagatagttatcccaacaatctctgtaattttcctactctgtcaaaagaaggccattcttcctatttcttgctcattctccccacaaagtggatctcaatgattgtatttaaaatttggaaggaataattctaagccattgccaatgaaggcagcattctagaaactttgtcctttaaaacacacacacaca

SEQ ID NO: 148771 - DNA, 584 bp, Homo sapiens
catgttgctgatatttgtcttgatgggacttttaatatttgcaaactaatcaggatagcaaggttataccaataatttctgaagacaaaaaactttctgcattattttattatattgaagaagaaaacttaaaaaaaaattccagtgtcttagcctcaataatctgtacacttttttgcacacatttatctcctaaagattttaattggacaaatggccacatctcagaagcactattgaaaaatgtgtacaagaatgtcacatctgggttcagtctagtcttttattagtgcttgatcagcatgtattggacagaatcgttaacacaaaacaagcaaggtaaatcatccactacacactaccaccctgataaccaccttgtgccactgaataaaaatgtggatccaggagaaatcaaaggacatccttcactcatttgatttgattccagtttagacagggggttaagggtgtttctgcttttttggggttttagtggttctttttagtttaaccaaataccctagctgatcttgcagaaagtcttctggactctgaaataggatggatcatctcatctcagc

SEQ ID NO: 148772 - DNA, 342 bp, Homo sapiens
tgttggggtagttgcttcccaatcctattttctcaattgtaaaatggaaacaatatcttatccaattgaaataaatattaaataagatactttaaacaaaagataaaggtgctttacaatttacaagtatgaggtataacttaaacagctaactggaagacattaacataatctacatagaatgaccttcagagcaatatggtttgcaatttaaggaatgaaaggaagataaattgtaatacaaatgtacctttctcagagaaggctgaaaggtacaacgccaaaggcattatctgcggactcaggcttcagattacctttgccacttcctacatgtgaaat

SEQ ID NO: 148773 - DNA, 540 bp, Homo sapiens
atattttcccattttccacgttataaggaaacttaaaaatccttttcctaactctaaaacaagcctcacatgcccttggatgcgtaacaacccattctaaaaagcactcatgcatcttggtgtggaaacggatcatgggaactctggagacctggcactcaagtagttaaggaaatgacaatttcaacagatttctgcaaagctcctttatggatagcccagcaggtgtttcttccattaaaacacagaatattaacggaggccttgatttacattctaagcctgatttacacaatggttttgttatgcaccagcctttgtccccaagtattaattctgctaaatatttcccaggcagtcactgctagatctccccaaggaatgagcaatgataatacagcctgtacctgctattttgccagcatcccatttcatcaatttatggcaagaggtaaaattggcaagttcagaaatgagacagtaaggtacacagtttgagtatttctgtcttttctctaaggagatacagctattctgcag

SEQ ID NO: 148774 - DNA, 320 bp, Homo sapiens
ccctcccaccattgtgtgaaacagtgccaaagaatttcattaaactggctgacttcaaggatggtgaactaggactgcttctaaaaagcaggctgatagtaactgagggaattgcctaataaggaatagacgggaggcatgctgcccctacataatctcttccttataaagagagaagtatggatgggatatgttgagagccttcttagagtcagtttgttgcaaatttcacctactctgttcttttccatccatccccctgagtcagttggttgaagggagttattttttcaagtggaattcaaacaaagctcaaacca

SEQ ID NO: 148775 - DNA, 457 bp, Homo sapiens
ggtgggggtgaagaagagctgtattcttctaaatatgaagaaaatcatgcggaagatgggtgaacgagtttgatcccaagccctacaatgacaagccaggctaaatgtagcttagaaccttcttttcccattgagtagtttccttaatttaaatataaaaataaagaaacaacactctggggattcctctgttgcttctctcaaacacaaggggaacttccttccgtgttgcctatccccgtctactttccactctttacctccagtgctgtctccaatctcctgagccctcctgaccaatttccaacatcgttgttccatatttcaattgtacccctctttccccctcaatgctcgagctttcctcatctttttggcaccattttgtcccttctggacctcaatcaccagcagggcacgtgcaccctctgcccatgcgaagaggcactgttggcag

SEQ ID NO: 148776 - DNA, 277 bp, Homo sapiens
attttttccactcccttcctgcagtatcttctgctctcagagtctcagaaaactcccccaccccaacctcacagccttctggacccctctaaacctccacttgttcttgcctggacattttcacctccccctcactgcaatactgagtcttggggcatcttctccgttggaacctccaggccccctctgtgttcactctgtgtttaacactcttcaacctccacgccaactcccatctcaaggactttccccataaagctccagacttcccccaagc

SEQ ID NO: 148777 - DNA, 346 bp, Homo sapiens
cgcaaatctagatgtttcagcctggatcgagcgagggttagagggttagtcaggccagggtcaacttcagagtcatgggctccctaaatgcgacttctagggttgagttgctgtggacgagcgacccatgtcggaatcccgcgcccacgtggctgcccaaagttccgagtctccgggctgcaggttctagtcacggaaccgagttgggagagtcataggggctgggacttggaggatcggctgaggtccggtgctcttggctgtgttcgcggctcggagccgtcgcctgactgaggggcccgtcacagatgtgtgatgtataagctctgcacgcaacaggagctca

SEQ ID NO: 148778 - DNA, 778 bp, Homo sapiens
gagacggggtctcacccaattggcccaggctggtctcgaactcctgacctcgcgatccgcccccctcggccaccccaagtgctgggattacaagcctgagccccggcgcccggcccgtagactttactttttagagccgtttttggtttataccaaaatggagtgtggtgtgtcctgaattccccctttggacagcctcctgccccacagacacccccccccgagtagagtccctcagggacccatcactcacatcggggtgcatgcctggtgtgtggggggatgaggaaccccatgagagcatcacgcagtgcagctccactccctgaagaccctctgctgggcctagattttaaatattttctttccatagcaagtggaattgttacctggaaaactctggaggtgccactttggttgtagtttgctagttcatgtttgaattaaacaccgtctgtcacgcccaacctgtgcctgcgccccgctggctggaatgtagcctgggtaagcgagtggccggcacgccgcggtgccacgtgctggtgagcccaagcgaaggtggactcagcagccccagccacggagtggatgccatttcgttgcttaaaacacttgtttgtgccaggaaatgagaaaagaggagtgtttgtgtcggtagttgtcaatcttagctgacctgaacgggctgggatgaggtcctggcatctgtgtttagtgttcacattgtttgtacggacctactgagcagcccgggctcaggacagtgcatgtgggcccc

SEQ ID NO: 148779 - DNA, 605 bp, Homo sapiens
gagaaataaaaactaaccacacaatccaaacattgtaggatactcactagtataaataataatttacttattaaccatttattaaaggcctcccaagctgcaggccctgtgccaggttttgcacagacattacagcaaaacattatgtaaatcaggtggcagtttacttgcctctgtgttcttcagctaaagcatttgcccacgtcttttacctttcttgggtgaagatcaggatcagcacttgataaggtttgggttcagccagcagtgggatcattcaaacagattgaaggcaaaaagacatgcgtttgtttgagcccaaaagtgattagaaatggactgggtttgaagtgagggatgggagaaatcttagccgcctgtgattaaaagagaaaggaggggctgagacgtgcggatcacgaggtcaggagttcaagcctggccaacatggtgaaaccccgtctttaccaaaaatacaaaaattagccgggcatcgtggcgggtgcctgtaatcccagctacttgggaggctgaggcaggagaattacttgaacccaggaggcgtagtttgcagtgagctgagatcacgccactgcactccagcc

SEQ ID NO: 148780 - DNA, 130 bp, Homo sapiens
caggcacagtcaggagggtctgaagatacacgctccactgaagggctgtggctttagcaggggaaaaatggaaagttcgattttcagtaactttcgaagtcattggacagagcatgtgttaccgaccaca

SEQ ID NO: 148781 - DNA, 462 bp, Homo sapiens
cgcaacagcagcaactcccttattcctcaaaattgtgttattgcaattgttacagcctagtacagttttgtgactccataatcatgtgtgtacttaacaaacattaaagtatgttaatgatgtgttctaacaacatcatatctctattaatctgttttctaatatatctgttttctaatataaacatagaaataaataaccaactcaatatcatatatttatataaaatgctaatattcacttttggaaaataccaggccaaagcattgtatcgtgatcgtgaggattaacaagtcaggattactttgcagctttacaagaggataatattttagaggaattgatccttcccataaaatgttcagccttcgggttagtcccttttcttattaatggcaatggctgtctgaaatccaaagttaagtgcccaaagcttttctaaagaaagataaactcaccttt

SEQ ID NO: 148782 - DNA, 378 bp, Homo sapiens
gtgctctgactctgttagtcagcatttcagatagagcataatacattgatttgataaaacatttttctgaatccctctttctacattaatgtttatattttcaaaacgattgtttgaaagaaagtgtcttatagaatccattgtttggcatcttggtaaccaaagaaatgggtgtctgactgaattaaacctttttaaaaactggagtgcactcaatatagttgccatatgcatcctagtctattttgtatttgacttaaacccagacgtgaagctgtatgaaattgtagtccagaatttagattaaagatttaatcgtttatctttgaagaacttgtagtctttttttcttagtccacaaatataattacattgcaa

SEQ ID NO: 148783 - DNA, 535 bp, Homo sapiens
cctgccagatacacaatttgttcaacttcttcatgttcttgatgatagtccccaaaaagaaagcgtcaaagaccaagccaagcaaaattccatttactcaatcacacatgcaacttccagccagctctgttttccccttcactggggtaaatgcctccagtagaggcagcacacagaattgagagttatgtgaggtggacttaaaatattcacagaaagcttccattcagagtctattattaaatattctaattttcttccccatttgcctgccctccctgcctgctgtagatctgcctgcagcaattaactaacagcccatcaagactccctgctccaaaatcatccacacctttaagcatagttatcccacacttgggaatttatcctagggaaaaatctaaaagaagacaaagcagtatgtgcaaagataatataatgcagccactaaaaattattacaaacacaatgtagaaataaaaaatatttgctgaataatattaacagatgaattccacacaaaagttgcataaag

SEQ ID NO: 148784 - DNA, 421 bp, Homo sapiens
tctagagggagaccagtgctgcctctcacagtggcagttttttctctttgcaagaggaggggctgttcaattccatagaccagtgggcagatagccagttgaatactctgtgcatggtttgatcctttattagttcgctctaatatttttctgtagatccttttgtcctggactcaaaatctaatccatgcattgtatgataccgtagctctcctaaggtttgtgtttccttcaaaatgttttagttttcttcaactaaatttgatttttgctgttagaagtgacatatttttatggtatacactatgttccttttttctactgcgagtcaattttttgaattttcgtgagaaagaatatatctacaaattgcacgaaagtatcataaaaacagtactctagacttttcttttcttttctt

SEQ ID NO: 148785 - DNA, 233 bp, Homo sapiens
gtggctttaccataggacttaaaacagctccatatatcggttttaaatttaattatacacatgatcttatttttttctttagcctgcaattgcttgaaaacagtgactgtattttatttttgtctgtgtaccatctataacaggcagctcctgttaggcactacacaaatatttgttaaatgaatgaatcaatgaatggaataagacatacttgctgaattgcaaaaaaaaaa

SEQ ID NO: 148786 - DNA, 192 bp, Homo sapiens
atttagattggagaggacgaaggccctgaggtccaagaacattgaaacctgacagtggacgtcaatggctgcagggaggagcctggcgagacgcccacgctgccacgtgcccagcaacgttggagcctgtagcacttctcccctgccctgctctattttatcttttttaataaagatggctcctgataaatg

SEQ ID NO: 148787 - DNA, 191 bp, Homo sapiens
cagggcctatgacaagtgctttacatgccccatctcagctgtgggggacaaagaagaccacaagccattttccctgtggcatggggagacatttgagcagagcctaagaattgagtaggagtcagcagacacaggggaggcaccaacacagtcagggggccacatggtttgtctggaaagccaccagcaga

SEQ ID NO: 148788 - DNA, 582 bp, Homo sapiens
ttgcttgaacccaggaggcagaggttgcagtgagccaagatcgtgccactgcactccagcctgggcaacaaaacgagactccgtctcaacatacatacatacatacatacatacgtttcctgatcagcattataatcacaccaatgtagcaactttcaagagaacgtaaaaggttccatttaaatgtagtgattggccagttgcagtggctcacacctgtaatcccagcactttggaggccaaggtgggcggatcacttgaggccaggagttcgagaccagtctgggcaacatggcgaaaccctgtctctactaaaaatacaaaaattagtctggcatggtgacacacgcctgtaatcccagctacttgggagactgaggcatgagaatcacttgaactcaggaggcggaggttgcagtgagctgagatcacgccactacactccagcctcagctaaagagcaagactgtctcaaaaacaattaattaattaattaatgtaaatgatttagttaattactgtagaaagtaatatgaaacttggcattttgttgacccagaaacacaactcagcattccatgt

SEQ ID NO: 148789 - DNA, 296 bp, Homo sapiens
aaagtcaacagctataatcttacataagattaaggaaatataaaaaacttacttggatacactgttggcaactacttcctgtaagctggctgctgtcaaaataccagtttcttttctctagtgtccttttagttccccaaaaaattggctgggtgtggtagctcacgcctgtaatcctagcactttgggaggctgaggtcaggagtttgagaccagcctggccaacatggcaaaaccccatctctactaaaaatacaaaaattaactgagtgtggtggcatgtgcctatagttcca

SEQ ID NO: 148790 - DNA, 626 bp, Homo sapiens
ggttgtactacagtaacagtaggagattttcacacctcacaattagcaatgcacagatcatgcagacagaaagccaacaaggaaacatgagacttaagctacactatagaacaaatggacctaaaagacatacacagaacataccattcaacagtggcataatacattattttaagctgcacatggaacattctcaaggatagatcatatgtcaagccacaaaataagtcttaacaaatttaagaagatggaaatcatatcaaatatcttttctgaccacaatggtataaaactagaaatcattaacaggaggatcttcagaaaattcacaaaaacatggaagttaaacacatgctcttgaacaaccaataggtcaatgaagatattaaaaaacaaattaggaagtttattgaaaaaaatgaaaactgaaacacacagcatacaaagcctatggaatacagcaaaagcagttttaagacagaagtttttataacaataaacactgacatcatatgtcttctgcaaacaggaacagtttaacttcttttccaattaagatgccttgtatttctttctcttgtcttattgctctttctaggacttccagtattatgttgaacagaagt

SEQ ID NO: 148791 - DNA, 408 bp, Homo sapiens
gttctatttttccacatcattctaatacttcgtattgtcagcattcttaatttttttttgttttggtgggtgtgcagtgatatctcattgtggttctaatttctatttgcctgatgactaatatgaaaatttcctcatgtgcttactggtaattcatgtatcttcttcttttctgtttttaagtcttttgctcacttttctattgtttgtatttttataattaatttgtggttgtaatttattcattctagatacaagtgctctatcagatacatgttttatgaatattatttcccagtttgtggcttacctatttattttattttatttattaagacatggttttactctattacccaggctggagtgcagtggcatgatcttagctcactgaaacctctgcttccc

SEQ ID NO: 148792 - DNA, 234 bp, Homo sapiens
gctggcccctgggtgcacagctagcaaggggctggctcttcagatcccaagtttcagactccgaagcctggagtgttagctacaatctcgcatttcctttgtcaccctggagtgtgagagtgtgtgtgtgagtgtgtgtgtgtggtctgcatgcctatgtgttttgtgtgtatgcgtatatgtgcgtatatctgtatacatgtgtgtatgtcttcgtgtgtgtctgtgtgctgt

SEQ ID NO: 148793 - DNA, 249 bp, Homo sapiens
cttatctgaagtaggctgtagctaacatttgactcatgaaaatgaagtaagcattcaaaatgtttttttcctcaaagctaacaggccaactcggaatagggatatcgtaatattaaagtagaaaggcttttcttttgtggcaaagctgtaggcaactttgagaagtactggatttagaataaaatttctatcctctgtttgtaacagagttagggctaaagtttgtgggtttctatcatctgtcagagg

SEQ ID NO: 148794 - DNA, 228 bp, Homo sapiens
atattactggcatttggtaatggactggttcaagatatcctgagtacatcatgtaacaggatatacactgaaactgcatgctttggagtcgaaaaggcttgattctaaatctgttcaaatctgagatgacacaggctaggcaagatatttaagtcctgagacacgaaataatacctataccttccagtgttgtatgtacaggacccaaaaccattaacaccagcaggt

SEQ ID NO: 148795 - DNA, 463 bp, Homo sapiens
gatcagctcggacttacaccacgatcacctcattgttattttttcttctttttctgtggattatagtatcctttttttttttttctagtttcttaaggtagaagctgacatcattgagaccttcctttttttctaacacatgtttactgctttggatttctctgtaaatactgcttttgctgttccccagagattttgatatgctgcattaattccctttgatttcttctttgacttatgggtcatttagaagcatgttatttatttccaggtatttgaggattttcgagttgtattttttatcactgatttctgatttaatttcatcgtggtcacagtttaaatgacttgaatcttttaatgttcatttgttgttattccttccaagtaactgcttccaaataactaaactgcttgaaactatttttagactatttataattgaaatggctgtatgaaagtg

SEQ ID NO: 148796 - DNA, 810 bp, Homo sapiens
tttaccgatcctttgcactgctcggatggagtagcaggaggcaaacgtggggaagctattggagcagccctgttgagaaatgatgagggtctcaaatgagttgggaacagaggggtggacagaagggagggagccaagagagcttccagaagcagaagcaacaggacttgatgatgggctggggaagagggcacatgattctagtgccgtgatctgcactgggacaggaagcagaagtagcatgtttgaaggatgagggaaacagttcatttggttttagaaattggtgacatggtagaaatgcattcaggtagttggaaatatagtcaggactgtcactcaggagaaaacgggctagaaccaggaatcctggtgtcatgggtacacaggtggcagacaaagccactggtagatgagaaatcctgctcagggagaaagcattaagggagaagaaaggatggaagagagaaggccagggaaggagacggaggagtgggcacagaggtgggagggcaaccaagagcacatgatgggacccagaagccaagagagaaaagactagaaaaatgggacaaggagggagaattagctcattggccgaattggcaaccacagttttagggaagtgaactaaagcccttcatttttcttcctgcagcatctctcagggcctgatgttgccttgtagttgtttacttggatattacatatctgcctgctacagtgtcaggtgcctggcatgtttttgcaggacagtattcacagcacttagaacacgtcttccttatagatggtgctcagtgaatatgt

SEQ ID NO: 148797 - DNA, 264 bp, Homo sapiens
ctgtgccctgtaacatggggataattctagtacccagaacccccaaaaagtggggagggtgaatcaagataaaatgtgcaaactgttcagacaagaggccaggcaggtgagtgctgttgaagtgggggctgctgcaatgactgacaaggcgaaactgacgcgctctgcatgccacttccgggatcccagtggaatttaaaatacaagcttcccctagctctccaatgctgggtttgtctaatttcgtgcttcaaaactttggca

SEQ ID NO: 148798 - DNA, 971 bp, Homo sapiens
aacactgtcttcaggagctaacagtcccgctgggtcagggagcttccatgcgatgactagagctgcacattaggattacctggagagatttaaaactatcccattgctgggctgcgccagagaccactgacatcagaacacagatgggtgaagcccaagcctcaggatgtttaaagtccctcaagagattccagagtgcagctagggttgagaagcactgaattagggaaagttggtatgaattttttggtgctagagggaagttcaggggtgggagggaggcaggaagggctttctagaagagcagcttctagagtttcccaagggaaggccctagaacggcactgtctgggacaggagctatgagcccccagttgttatgggtcatctgaaactgcattgagcaaaatacacacacacacatacaaacacaacacaccatagaatactattcacgccataaaaagaattgaaatcctatcattggtggcaatatgggtgaccctgaaggacattgttaacgtgaaatacagccaggacggacaagacacataaggcataatctcactcattgtggattcctaaaaaagctgccttcatagaagcagagcatagaattagtgttcaccaggaggcagggcgagggatcggacgcgcacaggattcatgcagacagatggccaatgggtacaaaagttacagctaactagggatggaataaattcctggtgttctacggcagaatcagagtcgggagtcgacgcgtattactacacattatgaagtgtaccctcaacttgggggaaaggcttaaagccctattgatagcaacagagacgaacacaacaactcctctatgggttggaatagactcctataggactggcagtttctggcaccacagggcaaggggtcttacacgtcccactttgagcctccagcaaagcacacataagggcttggccaaaccg

SEQ ID NO: 148799 - DNA, 378 bp, Homo sapiens
ttctcctcatcggagtatgcagtccattctcccagagatgacaccaataccaagtcgtcctgggactggcttattgtctgacaaagtgctgtgaggatgtgacactttagctatgtaagaggattgtgagtaaaacacaataatctgatttttttttgtaaattttttttgccctctcagcattaggttttgaataatttattattccttcttcatatactcctggcggtgaggttaatttggtcatcttgcaggggcctggctggtaatgaacatttttatatcaggcctcggagtactttctccgtaagacataccacatgtttaccacttaattgcccaagttgcttgagagtgttagcgtctgggggggttgga

SEQ ID NO: 148800 - DNA, 115 bp, Homo sapiens
gagtcgagatcgcaccaggtgacacagcaagactccatctcaaaacaaactaacaaaaaacaaaactcaaactgcacattaaataacagtgcattggccaggtgcgttggctcac

SEQ ID NO: 148801 - DNA, 338 bp, Homo sapiens
cttgggggacattcttggttcctctctttcccacacacccacatttggccaatagcaaattctaacagcttcaaaatatatgcagagcctgaccacttctcactaccaccacagtcaccgcccagttccaagccaccatcatctctcacttgggtgactgcaactgcttctgcccttgagcccagcaatttgctccccaaatagcagccaaagtggccttttcaagagggaagccaggtcatgtcactctctgctcccagcctaccaaggctcccatctcactggaagtaaagctttgggttgcttaagaagtcccatgttttgggtgctcaaaaagt

SEQ ID NO: 148802 - DNA, 342 bp, Homo sapiens
aatggggatagcagagaggatattatgcaagcatggcgcggcgcccgcatactgattagttttacaacctaccttcaaaatatatgcagagcctgaccacttctcactaccaccacagtcaccgcccagttccaagccaccatcatctctcacttgggtgactgcaactgcttctgcccttgagcccagcaatttgctccccaaatagcagccaaagtggccttttcaagagggaagccaggtcatgtcactctctgctcccagcctaccaaggctcccatctcactggaagtaaagctttgggttgcttaagaagtcccatgttttgggtgctcaaaaagt

SEQ ID NO: 148803 - DNA, 354 bp, Homo sapiens
tactatgtatttgctacacactcaacagaatatatgagcttttctctttcctttattcttcttttttaattggaaggcactgctcatgaaatacaattctttgatttgttctctagacagtagaaagacgtcatggttatttcttccttggtaaattaagccccattgtcaaacataactagtgagaaaaataaatgcattgtgtgaaatcctaacctttaaacataccacatttgcttacatatttttctttctgtttcccttatttttactctaaaatatgaagattcgtaggcctcatctgtcttttcatttttcccatattttcaacaaaggtagccactcctccagagt

SEQ ID NO: 148804 - DNA, 417 bp, Homo sapiens
cctgggttcaagcgattctcctgcctcagcctcctgagtagcttggactacaggcacccaccaccaccctcagctaattttttgtatttttagtagagacagggtttcaccatattggccaggctggtctcgaacccctgaccttgtgatccacccacctcagcctcccacagtgctgggattacaggcatgagccaccgcactcggcagtcccagagtcttatttccttatttttcttataatgacatattcattatttgccagctccttcacaatgggagaggctctgcagaatttactgtgatgagtttgcaaggtgaaagcaaaagaacaattatttttcttggtagtttaaatgagatcttgctatggaaaagtctgaggtaaaaccccaaagctgtttctcccccaaaaaa

SEQ ID NO: 148805 - DNA, 247 bp, Homo sapiens
gtgtagaggaagttctggaataaatgtggcagttgttagaagacattatagttagaagacattatagttagatggatagacagtaaagaaggggcttttgtattaaaatagaggaatagtggttgggaatagaaaatatggagctaaaattatgccaacccacttctattaaataaattctatgacaccttagcctttgggaaaatgactagccttcagtggagcacatgtcaagggaagcattgtc

SEQ ID NO: 148806 - DNA, 481 bp, Homo sapiens
gatatctcaaatactgtaaaatacagtataactaagaataattagccatgaggtcaaacttcaatttcaaacattataaaagtaaaattaagagttaaaatctaaaaccacatgaaaatttattcttcattataatctcaaatttgaaaacgttatataagatttatgcattcattagaaagtgatttattgtaattttataagatttgccaatttttaaaggtgtatttttgatcaatgcaattaaatgttaaaattattatgctatacattattagttcatgacacattttcaaatatgaatgtgatgtagaaacaggtgattatcagaaaataaactctgtttttagtttaagactaaattaaagctaccaaaaagaaatttagtttcaagataggaaagtttatttgtaaggatgctgggatgtttgaacccaagatgagtgatgtttaaaaggttttgcaatggcattcaatgaat

SEQ ID NO: 148807 - DNA, 396 bp, Homo sapiens
agacctcattcaatcctgattacctcccgaataccatcatattgaggatgagggcttcaacataagaatttttgggggggttttggggggccagggtacaaagatttagtccagaacaatgatacatatgtaaacagagtctggcacaaagttggtattcagtaaacattagtctccttttttctctcccctctaatgtacttaggagtttggattttggatgatgtttaatatttatttagaatttgagctgtgtctgacatgtatttagtaattttgaatatattcaaaattaagcttgttaaatttgtgaattatttgataattgatttattttgcagtattagaaacttgtaaatttaaaaaaattgccattaaatgtttttccacaagtac

SEQ ID NO: 148808 - DNA, 655 bp, Homo sapiens
catggccatagctgattcttgaggataaacttactgatcctcccacctcatcctccctggtagctgggactacaggtgtgtgccaccatgcctggctaatttttgtatttttggtagcgaagaggttttgccatgttgcccaggctaatttcgaactcctgagctcaagtgatccattcacctcagcctcccagagtactgggattacaggtgtgagccaccgcccccagacggatggttttaagtttctattgactggcatcggctacttcagcagaagctggatccataatgcattttgttagctttgtaagagttacagtgagatctgagttaactattccttttcccaaattaccctagtgatgttttaatgctccttataaaccagtcccctgctgtggttccttcatttggtatgaccccaggctacacagccagtaagaggcagagatggggatttaaaacctgatcttcctgtttgttgcttctacgatctgccggcacttcttgagattcatgagcgtgtggccgtatgatcactaatgaattaactcaatcaatatcaattgaatgtctattctgtcttacatttgtatactgtttaatggtttacaaacagtttttgcaggtataatctcatttaaatcttacc

SEQ ID NO: 148809 - DNA, 552 bp, Homo sapiens
ggtagctgggccagggtacagtgagtagggagaagctgggagcaggaggagggcgggcagccccagtgtgcaaaagaggaggggcagcctcgccgggaccacctgtgcagggcagcagcttggtggtctagcgcacacccctctggctgcctggccacagaacagcaccctgacaccctcgactcagcaggatgtaagacacccatgtgggaggcgaggcctgaaacccaggaggcatgggaggctctcctgcagcaagagggacggaaatgaggactgcccgggcccctgtgttggcagcgtctgcctagtggagggagaggagcggtctgctgtcccaccaggccgaggagccaggagccagggaccatgcagctttgtgaaagagtggccttaagggacctccctccgccaccatgctttctagactcctagccagccccttctctctgcgccttgtcctccccctccctccaagagcagaactcttgcttcccattttgcaaccacgtttttctgtctttttcatccaggccacccagctccctaaag

SEQ ID NO: 148810 - DNA, 110 bp, Homo sapiens
tgtagtgagctgagattgcgccattgcactccagcctaggtggccgactgagaccctgtcttaaagtaaaaaattctgaaaaatgctacgaccgtgaggtgaccggccat

SEQ ID NO: 148811 - DNA, 421 bp, Homo sapiens
gcaggcaagggagcaaaactgaggagtggtaataaagagctcagagccctccgcggtcatgccctaggaaagcaagaacacgtgtgtgtgtgttcacacgcatgcttgcagggtcaggacctggcaagtggctgaggaggggctgcaggaagcacctgtcaggacataggattgggatcactgacatctgggttgctggtgaaattctgtgaagagatcatcctccccacccctctggcagggccagctaccatcaccagagcctctagacttcttctgcaacccatggcccatccagggacctatcccacttcctaagtcccttcctggctaaaagccaagaccactggttcccctccaaatctctgtaggttgctagtgcctgcacttcccactctgcttgcctccctacctaatttcc

SEQ ID NO: 148812 - DNA, 296 bp, Homo sapiens
gtcctcctgcctcagcctcccaagtagctgggcctataggagcatatcgctgtcctgttacatcttttaaataaattctctttagagtatcatgttttccacaagatacatttatgcattcattcactccatggatatttatggagtatcttttgttcacatggtgtcttacagacagcagtgcatatactatgcaagatgtagacaccaatgaggcaaagctcctccttcaagaatctgcttagagagacaagagttataacacatagacacaacaaaaaatagtggttgaaaga

SEQ ID NO: 148813 - DNA, 469 bp, Homo sapiens
ccccatctaaatcaatttaaaaatccacaacgaaactctggcaaaagccattcatgcacttctctagcatgagcaaaaatttaaaacataacgctgccttctaagtcttctaatcccagtaggtcagttctaacctattattcatttcggtctaaagtttacttattctcattcatggaaatgctgaagtaagagtcaaagaatgaaagcactggagtctttacccttggaagatttttccttttcgtgtttgcaacttcaccagctcggaaaagcttccattccgttaaagtgaccggcaaagttgtatcttttgtaagctttgaccgcaaataagcctgtgagttctttacttccatagtcttccggtgaaggaactgaggttttggagggagctaaaacaggagaagatgtactggtaagatcacctagttttgctgttgttgcttgtttgtttgtttgagatggg

SEQ ID NO: 148814 - DNA, 773 bp, Homo sapiens
cttagcatggccctagacaaactgtgctcagctgtcacacatggcccctcaaggcctccagcagggtctcttctgttaaagttggggaaggaaaggaaaaagtatattttcttttgctggggactacattctcttaatgggattctggctccaatgtgcagggtatttacaatgctgtgtggggcacgaaatttgtggtatgcatttttgtgcattcatttcattttagctgcattcgaaaaagcagtcagtttagaccctccttatcttgtgatattggtagcaatagccaacagcgattgcatgttttctgtgtgttttttggaggcataccgggtcctgtactaagtgtactatgtgtatttttggccgtttaatccttactgtaactctgagaagtaggccgggactctcaccatcctttatgcatatggggaaaccgaggcccagagcggttccaacaccagtcagtggcggagtcaggatttggcccaggcagtctggctccagagccctgacccataatgttgccaccttcccccacacgtaggccacagtgatagccagacagcaacttatgtggcagtattagaggttctgtcctgcccctcgtggttgcttggagtgggtgtccaccttctgtggaataagacttagcagtggttctcaccctccagggtgtgtcggaattccccagagggccttttcaaactggactgccgggttccagccacagtgtctggcccggcaggtctgggtggagcctgagaatt

SEQ ID NO: 148815 - DNA, 319 bp, Homo sapiens
ctctgggcaagagaattatttgaggttgtggtcaccaaacacattaaccataagaaaccatttagtctgacatcgagtacctgattcttatattctcctgggaattatgaaactctctgggacccatgtgttctgtacacaaaatctttttcttccctcttagcttcagctaaataccaatagtattcaatgagatacaatagatattgcaagtatgtgctagaaaatcaattggtattgatgctctaatcagcagggctgcagctggtatgtagacacaccactggaaatggtgattaagatcatattcaaaagcatt

SEQ ID NO: 148816 - DNA, 661 bp, Homo sapiens
aggctcgagctactgtccttgtggtttggtgtaacctttaagtcacattgaaagattttgagcttctctggttagtggctgcggatgcagctccttcattaaatgcagtacatggaacttctaccagtagcctcttccccacaaatgacccacattgttgtaaagttagcaaccactgacaggaagtggcagaatgcgtctcagccacacagcagatttcattagacactctcccaaagtagctgtttgggtcaatttggcctcagtaggtttatagagaagaatggcttaatccattatttctcattgttacatttgtcttgctgtcatcttagccttaatggatgttttcattagaagcacagtgtcttccttggaagcaagtgcacacacatatgatcagagagaggaacttccagcaagctgagattttaaaaatatttccaaagttgttaccaacttactggagaatcttttgtttattgggtttgtcatttaaatctgtctggagagtagcagctccagtgacaccgcaggagggattttgggctgcactcacctttgtgactgattgctttgaaaggtcagctctatagatgttatatgaaagcagaattcctagggactggctgggaaattaaaatatacttcttgagtcaaa

SEQ ID NO: 148817 - DNA, 592 bp, Homo sapiens
gaacagcctcgtgggtgcccagctgagctgccctatttcctgtccatggtttggcaatcaggaaacccatgatcctgagaaaaggctgaaaagagcctttagacaccaaagattagaattagccaaggacctgacctgtagagattctgacttagggtgggcccaggaacctgtggccacagttcgaaaaacatagtattagctttcactctcaaacaagcagctcagctgcaatgcctctaaaggtgtaagttatgataaaaaggaagtgaagtcaaggtgtgtatggatgtccagtatccaatagtttcacccgaaggctgaaacaaacccaggaagccagcgggtgaaaaatagacgttagtttacaattctgggctttagtcccaagacaattcaatcaagagagacccggcagctattttgatgtgatagctttgtccaagctgctgtccacttcccacccaagtctaaagaaccctgacatttttttagctcagtggttacatggaggacaagagctgttttgaaagaaggctgcagttgggtgcctggtgcaaagggtcagacttaatgtaggttgtcaggagga

SEQ ID NO: 148818 - DNA, 158 bp, Homo sapiens
caggagtcctaactcctattattactttccctttactgacaaaaaaacttaggttccaaacggagtagataatcattgagagagtcttcttagacaccctccataacaagggaaaggacaaacttcttagcccatcatttgattctagctgcttagtt

SEQ ID NO: 148819 - DNA, 422 bp, Homo sapiens
tactaaattctgcttgtagaatccaatggatacatttctgtcttcataggacttgctgcctctgaagcatctgacactgttaatcactcccttcttgaaactctaccttgaatttatcttttccctctctggctactccctttcaattcccccttgcaggctcaaccctcattttcaaggggcctgggacaagaatacaaatggaagcctacataccatgtgtctaaatatttttaaaagttctaaatcaagctgttaaattattattccatccttctatcttgactaataataacctgaaaggccaagttctatttttgagttctcaggttcccttcatgttacgtagggacataggaaggaaaatccataccccttccccttgtctgcagccaactccttttctcttcccacttttagct

SEQ ID NO: 148820 - DNA, 552 bp, Homo sapiens
acgggacatctggattttttttaatgataaggtatcctatttgatcacttatgcatttatggtatttcataagaatgtggagggatgactcaataaacatagccatctgggggaaaaaaagaattgggtgatttggtagattgtattactgttcagcaaatatttactttccccagcccccaccaccacggaaggaatatacttcctcaccctgttgatattgcacttggccacgtgacttgctttggccatgagaatatgtgtggaagtcacaggggccaggcccaaggcacaaagtgtttccattcatccctttgagcaactgtcctcggccatgagaaccacaagtcccagacagtggaggctcccgcaagcgcgccgaggagtcgcagccggtcccgggggcgggggtcggaaaagagcaagaagacgagcaggaaagacacctcgaggaactgctcgagctccacatcccaaaggtcgcaaggcagcacggccctgggcggaggagagaagcagcggacgcccggaggagaccagatccagtctcct

SEQ ID NO: 148821 - DNA, 383 bp, Homo sapiens
tcctgacctcaagtgatccaccttcttcagcctctcaaagtgccacttttcctaatttttgactccctttccatcctgtatacttcttactatctcctgactagaggcattttccaatacattcctgtctcctcacagccttaattcccattttaaaatgaaaaccaaatctacctgccacgatctcacatgaggaacttcattcctcagagggctacgttcccatctctccccagcaacgcatcaggaacgccctccctccatgggaatgacacagcccatgctcttctgctccattctctgacctcagctgtattccctatttccctccctgccactgctttccaacctgataaccttgaaagcactgaactcctgtctct

SEQ ID NO: 148822 - DNA, 219 bp, Homo sapiens
ccagattgttctcttgactctggtccttctaaatccagcttgtaaatggcaagtgcagttatttctggatttgtatctgtaatggtggaagtaataatacacacaatacaagctagcagatgataatgaagtcatttatttatggctctaaagtgatatttttgcatgagctttactcccaattatgttttgcttgaagtcccccccagtatacatctg

SEQ ID NO: 148823 - DNA, 359 bp, Homo sapiens
tggcagtttcctctccagcctcatagtcccaaagccttcactagtccatccatctagtatgaattctattcattcgtcactgccattccagaattgatgctcacagctgcttatcttaggagatctggccaatgtactcctcctgcatgtctttccggagtcttgttcaggacacaatccttggcccttgctacaagtagaagctgcagctgccttccaacacaccttctatgtcagcacacagggctgcaggagctggtccccttcttctgttttaatttttgtgttttcctcattagacatgacaaggaccacaccggagttaactattttggtcaccttacattttcttttttctt

SEQ ID NO: 148824 - DNA, 366 bp, Homo sapiens
aaaatatactatttctatatctgtctctgtgtatttgtatcaaaaaatgttaaaaatttgtctgactagcttcctaatattgaaaaaaccttccaaaaccttcttatgaatattttatagattatgtttaaataacaccagcatgcagtaacataccatagtgcagccataactagtcaaattctacaattgccaatgatggtatttgtttttctactcctaagttttaagcacttcagctttatgtgtacacatgaatgtgttggctgagtccatgactcagtgtatgaaatgtgttttttatgaattttaggaacatttgaaattacaaacacggtcagggttagtggctcatgcctgtaatcc

SEQ ID NO: 148825 - DNA, 619 bp, Homo sapiens
ctctgctttgtaaacttcttaagtaaaagtggccaagaacagagggaaagaacccaggtgaaagagtcaggcctgggctcagatcctagctccatctcttactgactatgtagccccagacaagttgcctcccgtctctggacccatcagcccaatacccatttacagggtggctgtgaaatcagaaagtagtaatgtgtgtaaaacgcccagctcagtgttgggcacttgatcaatggaaggtttcaaggagctttttgaatcagaggccccatcagtaagaaggaagtttggtttctggcacagctgagacccacttctaggctggctttcccctggtgctcgttgaacctgtccccgagggacactgggtcagaaagcacctttgggacaggttcacagggcaagtattctttggggtctctgcctgccccccagaaaataactaccactcatcaaataccttttatatgtacttcgctaaaatcttcactgtggtcctgtgaggttcatggacataatctccattttccagatgaggaaacttagtgtcagaaaagggaaggttcatttgacatttattcaccaagccttttttttttttttttttgagacagag

SEQ ID NO: 148826 - DNA, 204 bp, Homo sapiens
tttaaaccttgaagaatgaatgggaattagccaggtgcagaaatgaggaaaacgtggtaaaatgcttataagagagaaagaagagtctttggggcagagagaacagcacatgcaatggtgctgtggcacatggcagcatatgtgttttgagggagcaaatatatgaggaaaaatcttatttttaaaactttcaaggtccagact

SEQ ID NO: 148827 - DNA, 308 bp, Homo sapiens
gctgtttatggtgcataggacccagatgttgggcttatgacccattccctaccccatcctattgggtcattcagtatccatcatcccctctgcaagcgaggaaacagaagccagtgcccattccaaataataccaaaacctggggtagaattctgccctgggatttcaagtctgatgctcatattttcagagtttccatgtcaagaaatcccacaagccttaatcattcctcacacataaatctacaaatatctctctcccatgtgctctaaacagcaagccgcttggcccatttccctgcttcctcc

SEQ ID NO: 148828 - DNA, 493 bp, Homo sapiens
gaagggagcagacttaagaaaatgcaaaagaaacatataagcattacgtttgaattatggtgctccttggaatctatgacatagcaggcatagtggttaagactgaagtctctggagtaggaatgtctgaatgaaactctggttctgccacttaccagctatgtgacctcctgctgagctgcttgtgcctttgctttttcatctgtaaaatgggattaatattggtacttaacttacatctttttttggggtaatgatgaaataagatcatgaatgagaagggcatagatgatacttgctagttttattacgaccattttcttcttttccaattacattaatgcttttcccttgtggttaacccccacatagctttattcctctgagatcctcttccactggcctctgctcttttattaaataaagaaattagattcagagatggcctcccactcccagccttgaacttgagttgaatctccctagagagggc

SEQ ID NO: 148829 - DNA, 749 bp, Homo sapiens
agaaacatttagtgagcagtattagttgctatcacaagtcccacacagatggccacggtgctcacaaaccacaactcattcgaatgtatctttggtaagcacttaataacaatatgagacaggttctgtgtgcttgactccagcggttctcaaacgtgagctgccgaaccagaatcacctgggggacttgttataccacagactgctgggccccagtcccagagtctctgattcagaagatttgaggtggggcccaagaatttgcatttctaacaagttcccaggtgatcctgatggatgggaactacacttgagaaccactaggcaacggtttctttttcttttttttttttgagacagagtttcgctctgtcgcccaggctggagtgcagtggtgcaatctcggctcactgcaagctccgcctcccgggttcacaccattctcctgcctcaacctccagaatagctgggactacaggcgcccgacaccgcacctggctaattttttgtatttttagtagagacggggtttcactgtggtctcgatctcctgacctcgtgatccacccgcctcggcctcccaaagtgctgggattacaggcgtgagccaagggtttctttactgactcagtttgcgaatctgttacaaagaggcccagcaggtgcatcccctaagtactcagggcttctgctgcgggcggcagcagggagaaagcatgcctcactgcagcgggcaaggagggggagtc

SEQ ID NO: 148830 - DNA, 187 bp, Homo sapiens
taagtggaaggagtcactgctgggggactggaggcctctttggaggatggggtaactggggcttctttgggggttggaattgctggggtctttttaggggagggaacagtcatagctgggggaatgagggcctctttgggggctagagttgctggggtctttttagagagaagagtcgctgttgggg

SEQ ID NO: 148831 - DNA, 202 bp, Homo sapiens
attatattgaagcaagtatcatatatcagattcaaatataagaattttatgaagtagttcttttgtttgtgttttttgtttttgtttgttgttttgttttgtttttgagatggagttttgctcttattgcccaggctggagtgcaatgacgcgatctcggctcaccacaacctccgcctcccaggttcaagtgattcacctg

SEQ ID NO: 148832 - DNA, 176 bp, Homo sapiens
cagaaattcatgtcagaacagagtaatacaaacttttgaccattattaactttgtggttggtgcagtagacccattgtaagctctacagggacaagtattttgtctggtttgtgcactgttttcctggtagctagaaaagtacctggtttgtaagtgctcaatgaatattaaatga

SEQ ID NO: 148833 - DNA, 377 bp, Homo sapiens
tgcccagttggctgctgcattgcttctccttgcaggtggccagcagcccatggtttggcatcctgcactttctgtttggaacacacactggcctatcactctgtttcccaaggtccttgggttgagctacctaagcctggcgcattcaacactgagactcaccctgtgctgcaaacattccctgtgtgttttacaaacattccctgtgtgttttggcttgaccttttaggagcaaggtttgttaattaagggagtaccctcaccttcttaccactgccctcttcgtctctcccagcctctatccccatcgtcccctcttctcagtcctagaatcactttatttcctactgtctctgtttcttcctctcctcctttta

SEQ ID NO: 148834 - DNA, 255 bp, Homo sapiens
gctgtctgcaaatacttaagctttgagttgtttttttctgaagtgcgaacacaatcaattgggttaagtctcccagcccctaagtgggggtatttatgttttttttaggagagaaactttggaagtaaatcagaagtacccagggccaatggccagagtcttagaggaaacataaacctctaggatccagtgagtatccacaaacttagagcactgcgaaggaaacagttgggttagcgttttattaggaaggtc

SEQ ID NO: 148835 - DNA, 289 bp, Homo sapiens
aaaggaagtaagtaagtagatcaaactatgaaagacctttaggttaaagaagtttacatttggggcagaggtcactgggaaacgactatttttttttaacaaagtagtagtttagtaaggagctagataatggtagtgagtcaacagtgatcaatttagtaatctaggcacaaggtaccaagaacttggaagcagcagtagaaagagagaaagaaatcaattattaatccatatcaaataaagtcaagttgattgattacagataaagaggaatcagtgagcaataatt

SEQ ID NO: 148836 - DNA, 809 bp, Homo sapiens
tttcaataattcttctttccacagaaaatcaactctataaaggttaaagaattgaaagcgaactgaccttgggaagctacacctacatgaatcaagcctgaagaatgggaacctagaatgctattttattttgtacctatcaactttattgcctcttccttatttgttatgaaggagtttacagattccacctcaaaatgctatgtgaaaatttcttccctcaaaccatggatattgtttcattaccttcaggagctgcctgcagtgtctgacctagaaaaggctcgcttgaagtgcacccagcagatgtacaagctgtaagagtgaagctgtagttggtgtatggctggagacctagaaaaagcaagcaagaaataaagtgcaccttaagaggattatttattatcaattaagtaccagaagtaacatgcagagttgtagatatgatagccaaaacatttaagagtactctctaaaacactctttaaagaaggtctgaacctcataagaggctaagtattgggcaaaatttcatttatcactgataaactaataaattctcagccatagaaaagaccttaaaattcatgtgaaccatccacccttctcttgattccctatacaagatgtcattgaaaaggctgtcctgcctatcggatcagagcactccgtctctcaaagagcccattacatctttagagagccttagagttatccttattttggttgaaagtccttccttatattgtgatgaaatctttctatcactttcaccccggggacatataggacaaatctaatttcttttc

SEQ ID NO: 148837 - DNA, 807 bp, Homo sapiens
  misc_feature (1)..(2): n is a, c, g, or t
  misc_feature (26)..(26): n is a, c, g, or t
nnggtaagcaatgtcctcgtacacanacatctgtatccaggttaaagaattgaaagcgaactgaccttgggaagctacacctacatgaatcaagcctgaagaatgggaacctagaatgctattttattttgtacctatcaactttattgcctcttccttatttgttatgaaggagtttacagattccacctcaaaatgctatgtgaaaatttcttccctcaaaccatggatattgtttcattaccttcaggagctgcctgcagtgtctgacctagaaaaggctcgcttgaagtgcacccagcagatgtacaagctgtaagagtgaagctgtagttggtgtatggctggagacctagaaaaagcaagcaagaaataaagtgcaccttaagaggattatttattatcaattaagtaccagaagtaacatgcagagttgtagatatgatagccaaaacatttaagagtactctctaaaacactctttaaagaaggtctgaacctcataagaggctaagtattgggcaaaatttcatttatcactgataaactaataaattctcagccatagaaaagaccttaaaattcatgtgaaccatccacccttctcttgattccctatacaagatgtcattgaaaaggctgtcctgcctatcggatcagagcactccgtctctcaaagagcccattacatctttagagagccttagagttatccttattttggttgaaagtccttccttatattgtgatgaaatctttctatcactttcaccccggggacatataggacaaatctaatttcttttc

SEQ ID NO: 148838 - DNA, 229 bp, Homo sapiens
atttaggtccattgtacatataggtccattgtttaacaccatgtaaaagacaggataaggtatgttaaaaacatagaaatactaccatagttggtgaaagtcaacataaccattcctatattacaaaaggaaaacaaacctgacccacaaaataaacatacctacaaacttacagccattcttcatgatttaaggaattactaaaagttctgcttattaggccgcattc

SEQ ID NO: 148839 - DNA, 195 bp, Homo sapiens
taggtttctcctcaatcaaatatttaattgtcagtactactggcaccaacacacaatctggaacatttttttactctctagaacttttcagttcttctaaaaatagcttatatcatacagatcttaaaataattgttggagagaaaaaataaggagcaagttaataagtggcagagtctagagacatacttcttg

SEQ ID NO: 148840 - DNA, 291 bp, Homo sapiens
aagctacatctgttagctcccgtgtatacagcggaaagttaccaagtgaattaagttttaatataaattgctttgttcactattaagattgatgttggacacactgtactgtaagttgcaaactgcaattacaattcgttgcaattatctttggttgttaatagcacaagatagcatgtcactttctaccaagtgtataatttatcatttgtggttttttttgtgaactcttgtggtattccaaatgtataatcttgttgtatttatttcccagtggtccaacaaaatgca

SEQ ID NO: 148841 - DNA, 446 bp, Homo sapiens
tgcttaccctcctctgctagttgtcagcatccatcttaaatcgatgcaatggaacctttccctgtttagattcactgtggccaccttactgcaggtgacaaatactacttgtcattccctcccctttgcggtacacgcgggaatatacttggggctgctcacataattcattctgggcaatgactcgtgttgtgcatcatatccagaataacgagcgtgtaaagaccaggcaggactcgccagtctttttttcagtaacacctacgttgagacaatggggctgaaagaaacagccttgatcactgagttaccagtggaagggatgactgccccggagaaatgcaaactctgcatagcaaactctgtatgtgcaagaaatgaacttttattggataaatcaatgggctttgggggattgtactgccactcagactaagccagtagtt

SEQ ID NO: 148842 - DNA, 479 bp, Homo sapiens
actgctgtcagggctgagcctccacggccctcctgcacctacagaacggagcccttgcatctaaactagccccgacctatacgctccaatttcccccaaccatttccactcccagcaggatggagcaggtgcactttccctgattccacctgctaagaacaatgaaaacccctgggcattctatgctagatgactataagaagactccaaatggcagtctgaagaaggcagaccagctgggacctcaggatccaaggaacaacacagtggtgagcttcctgcatttccttttctgcatatagctcagacttggaactgaggagaccagcaactcagaaatgccaaggagcacaaagagaaaatgccccaacaaatctccctgtttcaagacagaaaacttgtagataataaccactgtatttcagccaaacatcacacacacacacaaacacacaaaacccacagtcctactcacaacc

SEQ ID NO: 148843 - DNA, 402 bp, Homo sapiens
ctttaacaaacttttaaacataaattatttaaaatactgtcctaatgcagttttgaatcattgccatttaacagcatttactttacaattagatataacaaatatatattaagctgtttctcctgtcaatattctcgtgtgtcagttttctttaaaaacattttcagagggcaaatgcctagaatgctgttgtagaactaccttgtttatttgtaacccaccttgagagtgaaaggtactgtttttatactgtctcaactctgtgattattcaagctttttatttaagtcagtatttcaaagaaagaccctggaattttctttttcaaaaagttctgcttgcataaaggacctgtacctgtgtctaaagagaagaaaagcaaggcctccttctggcatcaag

SEQ ID NO: 148844 - DNA, 342 bp, Homo sapiens
taaaaggggaataaaagcctcctagaatggaggcacctactgaaatacagcaaaagctcctggatgaagaacacataacaagggggaaaggaggaaggtgtagctctttgggcccagggcagtctctcctcatcactgagcccagttaccacgcgcttcctaggtacagcggtcacaaaagggacccacggaaggtacaagggagagaactctcattcgggtggggctaagggaggacaacacaggggaggcctcaaagaccgtccttcagggcaggcagcatacggcaggagctcacagtgatgttctagcaaccggagcaacacagctaaggatgctgag

SEQ ID NO: 148845 - DNA, 359 bp, Homo sapiens
gcctcctcatgatctctcaaatgcttcatacatactccaccctccagttctgtctgggtggttcttacccgtctggcctgctcgtgtgtgtgtgtgcgcgcgtgcacgcgtgtgtaactagcctgatctttttggtgtgtgtgtgtgtggcagagtctccctctgtcgcccaagctggagtgcaatggcatgatttcagctcactgcaacctccatttcccggcctcaagtgattctcctgactcagcctcccaagtagctgggattacaggcgcccgccaccacaccctgctaatttttgtatttttagaagagacgagccgggtgcggtggctcatgcctgtaatcccagtgctttg

SEQ ID NO: 148846 - DNA, 502 bp, Homo sapiens
tagatattaaaaggtattagcaggatatcataaataataatttgaaaatatatctgaaatgttaaaaattactagaaaaaaatagcctagcaaaattaactgatagaaaatctgaatcgtactataaccattaaaaattttaaccagtagtatgatatcactcctcaaagagaattacaaaatccaggtaaattttactagtaagaaatgatccttaatgaaaatacacacaaccaacaaaggattaatattcagaatataaaagaaatacaaatcaataaaaagaacgacccaatacaaaaatgagcaaaaatcttaaatgggcacgtaacagataaggaaacctaaaggaccaataaatatatcatacctccctagtaaaattcccattaaaatcacactcagataccattttgaaaccaaaacaatgccaaaaataagaataccgattgaagagaacatggatcaattaaaaactgttagatgttcctgctgaaactgg

SEQ ID NO: 148847 - DNA, 254 bp, Homo sapiens
ctccacccgactggggtgacgacatggggtgggggtcccagtggagaagtatattttacgatgttaatatatatgctttatcagtaaaccgggagaggtggcgcgtgcctgtaatctcagcactttgggagactgaggcaggaggattgcctaagttcaggagttggagaccagcctgggcaacatggtgagatcccatctctacaaaaaatccaaaataatttagccgggtggagccaccccgtcggtggagc

SEQ ID NO: 148848 - DNA, 716 bp, Homo sapiens
tgagtagagacaggatcttactatgctgctcaggctgatctcaaactcctgggctcaagcaatcctctcgctttggcctcccaatgtgctgggattacaggcatgccccaccgcacccagcctgtggctgcgctttcaatgccccagtccaactgggcacaaaccctttgtcttatctccctttagctcagatgtggcagctggaatttctcaaaatctggaaatcttaagggaggacccagaaaataagagtagaagaagagtaaaaaccaggctggcttcaagagaacagagacctcctgcccacctgttttattcccagagggtcccaagaagagatttatttctcccttcttgtcccaaagggttgggccacctctgcaggcacttgctggctttccttcttagcttcctctgggctttctccagggagtgggcgctaaatcaccatccctacccaggtagcctctcctacacagcttagccctccttagttctcccttaatatgcaaggctggaaggaccccaggaaaaacctcaggtcttcagaggaggctttgtctgccacagactggaagcaatgccggcttcatgcaggtctgcagttgaggcagcaactatctaagtgttacccaccaagtccagagggctgttttctcacagaggttttaggtacatgtttctttcattggaaaactaaaattcaaatgtggtta

SEQ ID NO: 148849 - DNA, 363 bp, Homo sapiens
ctcttcacatttgtaggttattgttgaacaatgtgaatagtttgttactttctgtagaagaaaggtaaaggaacaaaaactatgactgaaactttaattacttcgtgtattactgtagtttaattgctattgagaaaactgagcacacatttataaaacctttctattttcacttaattttaaaaagcaatcacatttattgcatgaatgctgattcattttactttttctcttgaatttctaaaccaaattaataaattaaaaaattaaaaacccttaatattgtacataggaaatttccattattttgaaacttcttaaaacgacaatcttcaacactaatatgtaaaatgaaaaagactt

SEQ ID NO: 148850 - DNA, 282 bp, Homo sapiens
gaagcaggtattacacgatatgttaaaaatgtagccagtgaggctgagatgattaaagctccttacccatcatcagatttctccaattctaaggttcatgctctcctttctcaaaatattaataagcaaaccaaaacaataaatcataaaaataataagtaatagtctaatgagctagttctatatggaaagactaccaaggtaacacaagtagaacgagtaagataaagaaaattgtgggtggttgaccccatttgcttaacaaaaggtaaaaattatata

SEQ ID NO: 148851 - DNA, 308 bp, Homo sapiens
tcgaagaggggtggggcgggccgttcaaatttattacaagaaaactagcctggaacaccccaccactatctccacctggttacggagaaaaggccatcaagggtatttataccgtggcctttcctcaacggctgaggcacctgggaagaactgaacccacctcacttgccctggacagcggcgccgacgaacttcgcacgaagcccgtccactggacggctgcgcgctgccaagggaatccagatcccgagcaagcgtggggcccaaggcgagttccaatgaatcctcccccagcctcctgctcggcc

SEQ ID NO: 148852 - DNA, 212 bp, Homo sapiens
atcctttgtggtggggctgtcctgtgccacgtggggtatttagcagcagagcagcacccctggcctctacccactagatgccagtcgcaccctgtccccagttgtgacaaccaaatacctctccagacatcaccaaaggtggaaattgggggttgcgggggaagacaaatcacacccggttgagcccactgattgaaggggttcgtgtgaac

SEQ ID NO: 148853 - DNA, 426 bp, Homo sapiens
tttgaacccaggcagtctggctccagagactgcttaaccactcagctgtcctttgtcttgaggacagtcttgagttaaaactcaaaactttaggtaattttgaatttgagcttagtgactagaattttgtactttgggcacttagattttatacgcctaaagatcattctcaatctttaaagactctcctaccttcataacttgaattagcctaaatttttctcagacttttccccctataagtcaaggttcaggaaaaaaaagaccttctggattatgggatgggagatttctggggacaaaggatgagaatatagcctatataaagaacaaagttgaaatgtcttggaatctttttactgaaatctatgtgacttctttcccttccataataaaacaatgatggtgttttgttttttgtgtgtg

SEQ ID NO: 148854 - DNA, 407 bp, Homo sapiens
tcggtctcgccaacggtagccacagtttacttagtactaatcacctgccgggaaccaagccggtcatgtgattatatatttaactctgatccttaaaacacccctgctaggctggtgtgtgagctctgtcacaaatgaggaactgtcggctcagaggtggcagcgccaagattcgaacccaggcctggctctgaagccaggggcggttcttgctgccacactaccctctggatgtcaacacagggctgggcctgtgggggcctccgaaacatctgctgatcatcccaggcagggtttctcctccttggccctgtggacactggggccatcctgggctctgtgtggtgctaaatacccacagctcacgacaaccaaacacacctccacaccccacacacctccacacc

SEQ ID NO: 148855 - DNA, 406 bp, Homo sapiens
catgtgtgttcattgctgtcttcagtggcttccctttctcctctgttccctgcccttccagcttcattccaacagatcaatgaccacctgttagcacttcccagatatatttggtctccagcctcctcctcccttgttggttcctgctctgtatttctaactacttgtgcaacattttaatttgaatacacagttgtgtttggtaacacaaatttggtgacacaaacttagcgtgtttaaaactgatcttcatgcacttccaaaataccacatttttcatttatctttcttactactgttaataatttctctatttctctttttcttcacttgaaatctctaggtcacctattaaaattctatctctgtcaaggcattattgctagctccctcaagaagtgctgcc

SEQ ID NO: 148856 - DNA, 251 bp, Homo sapiens
caatatacttcataattcaatcaacaatctacgacccacagaaaaccttagttcacttatgtgcattatggtaatattttgaaaatacagaaaaatgtaaggaagaaaactgaaataatccacaatcccacaaagacaatcagtgtcaatatttttgtgtataatttacaagttctttttgtggttttacatatataatatatgaattatacacatatatgtaataaaattggaattaaaatttatacagt

SEQ ID NO: 148857 - DNA, 324 bp, Homo sapiens
ccactttgataaagaggtttaaaggtgaaggggtccggtacaaagccaaattgatcgggattgatgaagtttccgcagctcggggagacaagttatgtcaagattccatgatgaaactcaagagttcacttatgtgcattatggtaatattttgaaaatacagaaaaatgtaaggaagaaaactgaaataatccacaatcccacaaagacaatcagtgtcaatatttttgtgtataatttacaagttctttttgtggttttacatatataatatatgaattatacacatatatgtaataaaattggaattaaaatttatacagt

SEQ ID NO: 148858 - DNA, 252 bp, Homo sapiens
acaaccgacgatagataggcaccaagagtgcacccgccccccgggcctacagttcacttatgtgcattatggtaatattttgaaaatacagaaaaatgtaaggaagaaaactgaaataatccacaatcccacaaagacaatcagtgtcaatatttttgtgtataatttacaagttctttttgtggttttacatatataatatatgaattatacacatatatgtaataaaattggaattaaaatttatacagt

SEQ ID NO: 148859 - DNA, 424 bp, Homo sapiens
  misc_feature (309)..(309): n is a, c, g, or t
  misc_feature (311)..(311): n is a, c, g, or t
  misc_feature (330)..(331): n is a, c, g, or t
  misc_feature (333)..(333): n is a, c, g, or t
  misc_feature (349)..(349): n is a, c, g, or t
  misc_feature (352)..(353): n is a, c, g, or t
  misc_feature (355)..(355): n is a, c, g, or t
  misc_feature (361)..(361): n is a, c, g, or t
  misc_feature (365)..(365): n is a, c, g, or t
  misc_feature (368)..(368): n is a, c, g, or t
acaaccgacgatagataggcaccaagagtgcacccgccccccgggcctacagttcacttatgtgcattatggtaatattttgaaaatacagaaaaatgtaaggaagaaaactgaaataatccacaatcccacaaagacaatcagtgtcaatatttttgtgtataatttacaagttctttttgtggttttacatatataatatatgaattatacacatatatgtaataaaattggaattaaaatttatacagtaaaaaaaaaaaaggcctcgatgggcctagctgggcagatctgcggacctttcccttnantgacgtttaatgaaggatnntngatgactcactctctntgnntngctgcnctcntgnggtcagctgcatcaactgacttcaaagcagtcatacggggatatacagaaattcgc

SEQ ID NO: 148860 - DNA, 393 bp, Homo sapiens
  misc_feature (278)..(278): n is a, c, g, or t
  misc_feature (280)..(280): n is a, c, g, or t
  misc_feature (299)..(300): n is a, c, g, or t
  misc_feature (302)..(302): n is a, c, g, or t
  misc_feature (318)..(318): n is a, c, g, or t
  misc_feature (321)..(322): n is a, c, g, or t
  misc_feature (324)..(324): n is a, c, g, or t
  misc_feature (330)..(330): n is a, c, g, or t
  misc_feature (334)..(334): n is a, c, g, or t
  misc_feature (337)..(337): n is a, c, g, or t
acaaccgacgatagataggcaccaagagtgcacccgccccccgggcctacagttcacttatgtgcattatggtaatattttgaaaatacagaaaaatgtaaggaagaaaactgaaataatccacaatcccacaaagacaatcagtgtcaatatttttgtgtatttgtggttttacatatataatatatgaattatacacatatatgtaataaaattggaattaaaatttatacagtaaaacaaaaaaaagatgtcctgctctgcggacctttcccttnantgacgtttaatgaaggatnntngatgactcactctctntgnntngctgcnctcntgnggtcagctgcatcaactgacttcaaagcagtcatacggggatatacagaaattcgc

SEQ ID NO: 148861 - DNA, 287 bp, Homo sapiens
acaaccgacgatagataggcaccaagagtgcacccgccccccgggcctacagttcacttatgtgcattatggtaatattttgaaaatacagaaaaatgtaaggaagaaaactgaaataatccacaatcccacaaagacaatcagtgtcaatatttttgtgtataatttacaagttctttttgtggttttacatatataatatatgaattatacacatatatgtaataaaattggaattaaaatttatacagtaaaaaaagaaaataaattggcctagttggcctcat

SEQ ID NO: 148862 - DNA, 256 bp, Homo sapiens
acaaccgacgatagataggcaccaagagtgcacccgccccccgggcctacagttcacttatgtgcattatggtaatattttgaaaatacagaaaaatgtaaggaagaaaactgaaataatccacaatcccacaaagacaatcagtgtcaatatttttgtgtatttgtggttttacatatataatatatgaattatacacatatatgtaataaaattggaattaaaatttatacagtttcctgtcttgggacttttt

SEQ ID NO: 148863 - DNA, 196 bp, Homo sapiens
gggtagacagctggatagatagatgaactgatgggtggatggacacactgatggacagacacatgaatggatgggtggacaagtgaatggctggtggataaatgggtgaataggtcgacagattgatagacagctgaacagatggacagatgcacacactgatggacagacagatgggtggatgcacggatggatg

SEQ ID NO: 148864 - DNA, 495 bp, Homo sapiens
cacctgcttttaaacaaagaaaatcatccttgttctgcctcttttaccaagattgagtgaggattctgtgagagcagtgtatatggaacctattagaacacgtgtaaaggaagattttattaataatggctctccatgctccaagactattttctgtgtgaactaggctctggtctggtctgaatacaggccactgttcaggctgtcagtctttatctacctggcagcagtattgcctttcttacctgacttatgatcctgcaggtgggtttatgaagtggtacccaagtgcagagccctgtgaaggggcaaagatagcccccaaaatcaagtagtcacaagtaatccatcaggaaggtgattgagttctgactcatttatctcctgggaaagccctaaaagcacatgcaaggggccctagctacacttacagtggtgatttctctgtctctgatagccccaagtgccctcctaagtaccctcaaatatcttgga

SEQ ID NO: 148865 - DNA, 377 bp, Homo sapiens
ccaggagattatattatttcaaacattacagaaacattatacctggtaagctgcaggtacctccgaatccaaagtgtttcttgaacgctttttcattcgagctgaacccttttctgaggggctgatcatctcagacattgccccaaaaagaagactcttgggagaccgaatactttggactggagaattttctctttggtctgcaagtcaaaaacagcaacaatatttaattctttctcaattcctgttcttccaatactattaaaacagccagccacgcatggtggctcacgcctgtaatcccagcactttgggaggccgagacaggtggatggtctgaggtcaggagttcgagaccagcctggccaacatagcga

SEQ ID NO: 148866 - DNA, 813 bp, Homo sapiens
gaaaaaatgatggcaactctctacagtccattccagaaaatagaagaagagggagtgcttcctaactcattctatgaggccagcattacctaataccaaaaccggacaaaaatattacaaaaaacgaaaactacagatcaatatctttcattaatataggtgtaaaaatcctcaataaaacattagcaaattgaatccaacgatacacgaaaagaattatagatcacagctaagagggatttattctggatatacaaggctgattcaatatttgaaagtcaactaacgtagttaattacatcaacaggctgaagaagaaaaatcataaaactagatacagaagaaacatttgataaagtccaatacccatttatgataaaaattctcatcacactagaaatagagaggaacttcttcagcttgataaatacttatacagaaaacgtacagctaacattatggtgagaaactagatgttttccccctaagactgggaccaaggcaaagatgtcttcacttaccactcatatttaacatcgtactggaagtcctacgtaaagcaaaaatataagaaaaggagatgaaaggtatacagattgggaaggaagtttctgttcaccaaataacatgattgtctatgtataaaatcccaaagaatcaacaatgacaaaaaacaacattcctggaactaagcaattatagtaaggtttcagagtgcaagataaatacacaaaagtcaagtgcttgcctatataccagcaatgaacaattggaatttgaattaaaaatacaataccatttacactagcacca

SEQ ID NO: 148867 - DNA, 352 bp, Homo sapiens
ctgctttttttttttctgttaaaacttgctgcctgtgacagcatctgtgttgccatagcaatacatctttgaaagtggtgacatcatactctgttgccatggagataagattgctctcacaaacaatggattccatcaccaccatgttggagtttgagaaggaggtaagaagttctgttgcccagatgcttgccattcccaaagcagggtttgctgggattcaaatgcagtggttagagggcagctttgtctatttcaacttcagtccctttctgccctccctggttcccaccaggccatttctatcacttgttctgtctttctcagcacatctatttatttgtcccaatgg

SEQ ID NO: 148868 - DNA, 330 bp, Homo sapiens
gccaagggtggcacaggcaggtaagactgttgcatatgcagaccagggcgtgtggccaggatgggggtagccaggatgggggtagccaggatgggactcagccctaagcctttggtcttctccctctcagccagtctcatctgtactcatagcttcaaggaccaaagacctccagattttctctcccctgaggtccattcccctatccacacctgcccctgcctgactcatggccctctgatgtcccaactaatgaccttcccccacaaacactccctcatgggggatggtaccaccacctgccacctgccagacctgggaggcacctgg

SEQ ID NO: 148869 - DNA, 249 bp, Homo sapiens
attaattttggtgccctaaatattggcatgtaaatatataacccctggaagaaaaaaacaaaacaaaacaaagcagaacattaaggctttttaaagataggtaaatcattttcttttcaaatgaaattcagtttgactgcatgaaatatgaacagtaattaaatgcacagtctgtgggccttccatactttaaagcgctttctttaaaaaaaaaagagtactcacctcagacaggccaattacccaaga

SEQ ID NO: 148870 - DNA, 398 bp, Homo sapiens
cccagaaacactaccacagacacattcagaatcattcttgaccaaatttctggccaccccatggcccagtcaaggagacacatattatacagttagccttcacagatcctaatggtgctgccatttactgaggagtagctctgtgcctggcaggtttccaagtgtggctcctggaactcatgttgtcctcagcacagctctgaggtgggtactgttaccaccttcacgtttgaggaggcacagagtaggcagcttaacctcttgtataaaatagggatccttgaggtttagacccggcagcattgttttctgaccctctttaagttactgttcttcattttttttctgttttactaatttcatttactgttaaatggggttttaaattatgaaaataa

SEQ ID NO: 148871 - DNA, 324 bp, Homo sapiens
tacaaatcaaaggtttgtggtaacccctctcatgcagcaagtctatcaacgccaatttcccaaaagcatgttctggcttcgtgtctctgtatcaccattttttagcaataaagcatttttaaatgaaggtatgtagacttttcagacagaatgctattgtacacttaataggctacgatgtagtgtaaacataagtttcatacgcactgggaaaccaaaaaatttgtgtgactcactttatttcgatatttgctttattgtggtagtctggaatggaacctgcaatatctctgaaatatgcctgtatcatagaacagccgcata

SEQ ID NO: 148872 - DNA, 409 bp, Homo sapiens
ccagacactgggaaccataaccaaataggaatactttcaactaagttttcagtttagagattttcagtcctcacaggtagtataaaatctgactgcaaatctttgagtatgggcgtctgcttaggcaatcacatgggaggcttctttcccctctccaaccagatccaagacagtaagaggcaagtctctgcatgcaggacatcttggacatcttttttctactcatgcactgaagacttgcaccctccagggtcccagttccatctgggacagtctccagtaggaccttccactatgcttaggtactacttgtctcttgtccctccactttcctctaatcctacaagaaaccctcagaaccaccaccaccttcagggcttcctctgccttatgaaatgatgcttttttt

SEQ ID NO: 148873 - DNA, 380 bp, Homo sapiens
acaatgggtgaaaaaagaacagagaaagagataagaggccaatcatattcattcccccgagacaaggctgactctgaagctgactttagaaagagaaggggagaagattgatctccaattcaaatgcagagttggaattagcacacaggactgggaattccaattacagaactgaggctgtgttttgtgacttcaagttatgcaagatattacctaacagaggacgaaaacattgtggggcctctttgagttttcactgcaggggagaagaaaacactgagagacaaaaatgaagtcatgttctgctcattctaagagttatgcttgattaaaacacagtgaatcaggaaccaggaggagctgtaatggccctggggtga

SEQ ID NO: 148874 - DNA, 160 bp, Homo sapiens
aaaagaaagaaggaaaataaaagaaaggaaaccgcttttccttctagaacactgttttcaaaaaaattgtttttcaaagcagcttccctttcctcttcccaccatcctgatgtgagcaaagcagagaggaaatgaggcccagggaggggaaggaacttgg

SEQ ID NO: 148875 - DNA, 228 bp, Homo sapiens
gtatagtttaggtcaatagcatgtgtagacagatacgggtttgagtatttgataaatgagtatcgatgatctctctctctctctcttgctctctctctcttgctctcttgctctctctctcttgctctctctcttgctctctctctctctctctttttctttctctctttctttcgtgacagagtctcactctgtcacccagactggagtgcagtggcacaatctcgg

SEQ ID NO: 148876 - DNA, 402 bp, Homo sapiens
gccatcatccacttctcacagtggtagtgattttttaaagaatggatccagggccagctggcaaggcctcggtaggatgaggatgctatgttttgggtgagaagtgtaacttgaacagccatcctgaaattttgtcacgagaaccttaaaactttgatcacttgttccatgtacacgaatctacatgaaggaagtatcaggtgaatgtaaggattgggaacgcccatcacctgtattcgtggcagcctgagtggttttctggaacaggtcagattgggtcactcccttactgtctgccacacacactgcagtctaagcggcttcccagggctccagcaccttcgtgatgggccctgggcacctctccaagctccccctgctcctcccctccacccaggccac

SEQ ID NO: 148877 - DNA, 277 bp, Homo sapiens
tcctaggggcctggacttggagtgtggacctctggtgtttcctctcctatcggcacctgacttctgcaaccttgggctggtcccatggcttttctgggccaccatttccccagcaaagtcagtagcaaggtaaactggatgaccttgaaaatccttctaactgggagggtctctgattctgcatcagtattttctttgccctgggtcccttctctgtgcaggcaggtggagttatgacagctactagaagcacagaggtacctataaacacatgggt

SEQ ID NO: 148878 - DNA, 245 bp, Homo sapiens
gctgtctgccattgtccaaagaccattaatttgttcctactttctctaatttgtttcaacttctctgatttgtttcttcccttattaaaaatttcccttgtgatgtgttacatcacacaacctctcttgaccagacagttctagtactttaaattgtctgtacaggaaagcctctatcacatggccaagtatttaaaaatatagaaataacctttcttcagagatgttaaacagacctgcaagtt

SEQ ID NO: 148879 - DNA, 306 bp, Homo sapiens
tgtctcaaaaaacaagaagaagcacaaaatcaagttactagagactccccaggagaaatggctacttgactgttttttccttctagtctctgcacattgcagtgttccttggatgtcctcatttctaaacaggatgttccaccggcaggttcccaccaaaaagtgcagaattcttcttttcaaggaatgcccccaggcagtttgagttccgcagaaacttctgctctgcagatgaattcactgattgaagccttatctaggagttcctccacctaacttctctccctcttttctccaatacaaatt

SEQ ID NO: 148880 - DNA, 526 bp, Homo sapiens
tataatgtgcatccatactgtgtgacaggccagaaatggctttggattaagtagagccccaggactgagtctcaactctgccactaatttactccataatctggggtgagtcactttccttccaagtcttgttgtcctcatctgtaaagcggacatcatgatacctgttctccctgtcctcattctgtcatttgcgtattcatttcataatggatatgtgaaagtactttgtgatgaaaccgcctgaggaaagttagctgtcgatataattaaggttacctttttttgagtgcctactgttgagtgctcagtacttttctttcattcttatttgaactttacccaaaacctttacaatatatatcattgccccactttgtggatgaggaagctgaggcctagggtggcgggcccctccattggctgagacaggatttgtgtgtgtgtgtgcagtgtgtgtgtgtgtgcgcatgtgtatgggtatggtgtgaatacatcgcaagactgtcaagtctcccctgagaag

SEQ ID NO: 148881 - DNA, 367 bp, Homo sapiens
  misc_feature (340)..(340): n is a, c, g, or t
  misc_feature (358)..(358): n is a, c, g, or t
ctcgccattattacgagatccagtaaataccatttccaaagccagtttatgcagaactggtcatgtgggatctcactcgtccctttctgccagctctgtccaattcagccttcaaagcctgccgggtgcctttatctgatgtgttggtggtggttgtatggaagaatgtggaggtgctaaagaagtatttgtctgcattcaattatgcttcatagcaaccgttggcataatttatatttttgcctgcacattctgagagagccatttggcaaacaacaataataaatttacatttggatggtgtatttcactcagagaacctccactatatccttgattntgatctacgatatcctgnggatcctct

SEQ ID NO: 148882 - DNA, 493 bp, Homo sapiens
ctcgccattattacgagatccagtaaataccatttccaaagccagtttatgcagaactggtcatgtgggatctcactcgtccctttctgccagctctgtccaattcagccttcaaagcctgccgggtgcctttatctgatgtgttggtggtggttgtatggaagaatgtggaggtgctaaagaagtatttgtctgcattcaattatgcttcatagcaaccgttggcataatttatatttttgcctgcacattctgagagagccatttggcaaacaacaataataaatttacatttggatggtgtatttcactcagagaactttcatatgtattatctcatttggggctcacaacaattctttaaccagggtatgtattactaataataattaacaatagccagcatttacagtgtttatatgtcaactgctgttcattattgcctccttttgacagagaccaacatagagagtttttgacagagaaagtgact

SEQ ID NO: 148883 - DNA, 571 bp, Homo sapiens
tcccgattaaatttgttgccgcagtagggcctgttccccccaagtattgtacttagagctgcagtgcgtttctaatgtaacccccgttccagtgatatggacaggagacggaaatactgggtagaaaagggcagttccctggcaaagcctcaccctcaagcctggatacctgctgtcttaaacgaaaacgaaaacaggcatttctgtgttcatgctccaaaagttatcttttggcctgccacaccccctatcctgcacccatatgaatcccgaaccccagactccagaagcagaccagcaagcccgcagaccagcagaaggatggcagaacgatgtggcagagaaagggagaagaggaggaacatctgaatgccaaaatgagttcagctgggggcagtcagagaggagtccagccactgggcagccagaatccaggggaggatcacctttccacttcatccccttcctctgcctccccatccatcctgctgaaagccacctccaccactcaataaaaccagatgcggccgaaaattttttgcggcgcgccgaataacgcgcgggagccgag

SEQ ID NO: 148884 - DNA, 664 bp, Homo sapiens
cagggcaaagccaagaagtgattttcccccctccctgccacgggaactgtgacctaattctcattcctaatcacagaatcaaaggagaaatttatttcaatgagccaatctgaaagagctatttgccaaatggctttctttccaatacttaatgaaaagatgcattttgtactactttcaaaaagtgatatggacaggagacggaaatactgggtagaaaagggcagttccctggcaaagcctcaccctcaagcctggatacctgctgtcttaaacgaaaacgaaaacaggcatttctgtgttcatgctccaaaagttatcttttggcctgccacaccccctatcctgcacccatatgaatcccgaaccccagactccagaagcagaccagcaagcccgcagaccagcagaaggatggcagaacgatgtggcagagaaagggagaagaggaggaacatctgaatgccaaaatgagttcagctgggggcagtcagagaggagtccagccactgggcagccagaatccaggggaggatcacctttccacttcatccccttcctctgcctccccatccatcctgctgaaagccacctccaccactcaataaaaccagatgcggccgaaaattttttgcggcgcgccgaataacgcgcgggagccgag

SEQ ID NO: 148885 - DNA, 635 bp, Homo sapiens
actccagtttcttcagctttggccctcttgggccttcgaacacagactgaagactgcgctgtcggcttcacgactttggaggttttggaactccaactggcttccttgttcttcagcttgcagacggcctactgtgggacgtcaccttgagatcgttgatatggacaggagacggaaatactgggtagaaaagggcagttccctggcaaagcctcaccctcaagcctggatacctgctgtcttaaacgaaaacgaaaacaggcatttctgtgttcatgctccaaaagttatcttttggcctgccacaccccctatcctgcacccatatgaatcccgaaccccagactccagaagcagaccagcaagcccgcagaccagcagaaggatggcagaacgatgtggcagagaaagggagaagaggaggaacatctgaatgccaaaatgagttcagctgggggcagtcagagaggagtccagccactgggcagccagaatccaggggaggatcacctttccacttcatccccttcctctgcctccccatccatcctgctgaaagccacctccaccactcaataaaaccagatgcggccgaaaattttttgcggcgcgccgaataacgcgcgggagccgag

SEQ ID NO: 148886 - DNA, 925 bp, Homo sapiens
tgaataggaaagccctttctgtagtttctgctttctggtcttaatccaactactaacaacaacaatagcaaaaagaatctcttgggtagtattttttggctactgtggtgaaggaaaccagaagtgggaggttagtggtggcagtagggtttgtttagtcattgctgggtgtcttggtgcctggatgtatttttcactatgttgtatattaatcaatttacttattaaaatgtaaatctgctatagtacctctctcaaagtagcaattcatttccatttggtgaagcaaacttaaaagttgccacataaaaatatcttcagatctatgactattaactggagagacttgaaacttatttttgggactcatttgaactagccagtgacccctgcttgtctaacattttgactatataaaggagaaaatagtgtgagaaaaaggcaaaagcaatatagacattcttttgtgtttctttggtgacaaatacattcatatattaaatggtaggtgtaatggaaacgtgtgcgagtttctttcagtaaaacctttttgagtgatttcatttactgtggaggctaataagtgaagttttgggggtttcacctgttacacaattttcttttctaactttatgatagcttttgttattgcatgtgaattaaaagactatagagtgaacggtgtctcaaagaataaggataaaattaaaggacagaacaaagcagcaagacgcaaagacacgcgagcacaatgaaagaaaaaaactgggtgacgggacgcacccgctcgagaaaacgttctacacaacacgcgggtggggggggcggggaccaagcaggagacacacaccgggggacacagcgtgcgcccgagaggaaacgggtagcaacacgggcggagtgctaccacacaaaaacgccggag

SEQ ID NO: 148887 - DNA, 201 bp, Homo sapiens
cgagactctgtctccacccccccaaaaaaagttagcagatacttaaaaagccctcctgtcttcggtgctatgctagatctggaatgtacccaggtaaaagcttgtatgtgctttcaaggagttaatcatcgagtaaaacctcctcagaatataagtcagactgatgtggcattaaaatgcaatacttcaagtgctcctggt

SEQ ID NO: 148888 - DNA, 145 bp, Homo sapiens
ccagcccagcagaagccttggtgaacactgcttcatccctcacccactttacatgttcgcagcactttgtggcgtacatatctcatttacacacatgatctcgttcaatctctttaatgagttggatatcacaaaccccatctca

SEQ ID NO: 148889 - DNA, 334 bp, Homo sapiens
caaactgggctagcctaaggtcctagattctgtctactggttactaaatcctgaacatctcattagtgagtcacaatctaatccatttttttaaaaaatttagttttaaaagagctttaccaaaatgtatttgattcacatgtactcaggaaaaagaatgttgaaacctaggttgcatatttggtgaagaataatgtaagttaacgattcccaagttacaaataacaaaaacatcattaagaattgcaggaccaggcatagtggctcacgcctgtaatcccagcactttgggaggctgaggtgggcagatcacctgaggtcaggagttcaagac

SEQ ID NO: 148890 - DNA, 228 bp, Homo sapiens
agaggacccggatcgtgcggttctgtgctcggtggtctgtgctgggattacaggtgtgagccaccgcacccagcttagaataccaactctgatcttatgccagttccttctaaagcttctactcctagatgtgaaatttcataaatcttaagtttgacagttggaaatagaggtcatttgttgattaagagactgacctttgtctatgaatcaaaacattaatcacag

SEQ ID NO: 148891 - DNA, 660 bp, Homo sapiens
atttttggtagaagaatcagaaacattactaacctccctgttggatattaaaaactcaagaggaaggtttttactattttctgtcagtacaagttgaacttgattgtgtcactggaaaccctagaggtttgtgtatcagtagacaatgataatatgaagttccattgggtgatgatagtcctctggttatgcaggagaatgccttgcttcttaggggctgcacactgaagtctttaatggcaaagggtcattttgtctgcaactgactctcaaatggtttgtccagaaaatgtatagacatacacacatggaaagcaaatgtggcaaagtattagcaactgttgattccagatgaaagttatacaggtgttcattataccatctgaaaatgcttcctagccatcctaaggcttaaaggaaaaaaagaaaatgtttaaaatcaaaagtcgggggcaggaaaagaataacaattaaacttcaggctcatgcctgtaatcccagcactttgggaggccaaggagagagggttgcttgagctcaggagtttgagaccagcctgggcaacatggtgaaaccccatctctacaaaaaatacaaaaatgagccaggcatggtggcactcacctgtagttctagctactcaggaggctgaggtgggag

SEQ ID NO: 148892 - DNA, 172 bp, Homo sapiens
aagatttcagctcacaagtcagttttagccattggtctgtgccctgaggacaactgggaagtttccaacgggagaaggggaatctaaaagcccttacagaggtcaagcctgcagtgagctaagattacccccactgcactccagcctgggcaacagagagaaaccctatctc

SEQ ID NO: 148893 - DNA, 273 bp, Homo sapiens
gtatgatggacctgagcgccgtatgatggacctgaccgctgtatgatggacctgaccgccgtatgatggacctgaccgccgtatgatggacctgaccgccgtatgatggacctgaccgctgtatgatggacctgaccgccgtatgatggacctgaccgctgtatgatggagcccatgctgacctttaggtaagaggcagtggcggcggcggcggcggctcggcaggcgggttcaggcttcgggggccagagccgccatgatcctgctggaggt

SEQ ID NO: 148894 - DNA, 305 bp, Homo sapiens
ttcgtggaaagaactggcaccatcctgcaggtgcaactgcctgatgggttcttcctgcccattgtacatacaaaatcaattcatggagaccatggcattgcagtaaagagtttaattgacacaggccagccacaacatgtgggggacggagttattactcaaatctatctcactgaaggcttggaggtaagggttttttcaaagacagtttggtggggagggggccagggtttgggcagtgctgattgttggggatgaaatcacaggggtgtggaaaatggccctcctgcattgagtcagcttct

SEQ ID NO: 148895 - DNA, 297 bp, Homo sapiens
agtggcctctacaatcattttcaggtgtaaaattcctgcacactacatcctttcctaattaatgtcagttgtacattctgcattatattcccctagcacttctgggctgtggatgtatttattatcatatcgtttgagaaggagggcagtgattgacaacgattctctttacaaatcccaagtggtgtgtaatttggttttctaactgtgcatgtttgcacaatctgcttcctactccagctagattactatgagttgaaaatgctcatcagtgtggaattatatttctcaatatct

SEQ ID NO: 148896 - DNA, 258 bp, Homo sapiens
cctcccccaacccttccctctttagtcctcactgggctattgaccttgttccacacttcagtgaagtaaaaaccttcacatgatgactctagcattcccgatgaaaacttaacaaaaactcctctgcagctaatgctcccttctttcctcctggcacaatggagggcattttctctctcctagcaaagtccagtccctccccttctctgtatccaatgctcgttgaccttttaaaacacttcactctggttatcttct

SEQ ID NO: 148897 - DNA, 642 bp, Homo sapiens
aaggaaataacttgattattttatttgaatattagtcaaaagcagcaggtaacagacatatttccatttcatttactttataagattcattaattaagaagatatgattattttattgcttagtaaacagagcaaactttctggcatatatgtattttatatttctgaagcataactaattctctaatttggaagaatatgtgagtttgatacatctagcttatagtataattctaaatttctagccacaaattttccagtttttccgttcattcagtatgtcgtcactaatctttttttcatttcagatatttgggtatctaatgatatttaaaaagaaaaaaatataatatttggttagtacagtgtgtctagtttttttgaaattatatttagaccttgatagtcttaatttatttttctagataaatgcatgttactgcatttaatagtaagaaaacccattttcctgaacttactgtaaacaggtgaatatatggtgataaacagtgttcttgcatcatctatgacttttgtaaacacactttgtcttgtaatattctttaccttctttcagttaaagatgtgatctgtcagatgcttacatttgttaaacaacattgacaaaagccttagcctgtg

SEQ ID NO: 148898 - DNA, 136 bp, Homo sapiens
tacaccaaaatactgagttttcatcaagagaataaagccaatttactcctttataaagttttctacattttcttgaagttacattgatttggatcaattcttttccacatggattttataattcgtgggtcagttt

SEQ ID NO: 148899 - DNA, 357 bp, Homo sapiens
gtgcttgcaatgttaccacttcaaaaaaatttccaatagtaattaaatgatttgcatttgtttttaaaaactgtaaaatattccaaccttccagcgataaccagtgtatacattttggtcgatttccttccagtcttttttctacatatgtcggtgggaatgcagtaattggaaaagaatacaaatattcatcattttttatatcctgcgtttaaaaaagtattacttctggccagttgcagcagctcatgccagtaatcctagcactttgggaactgaggtgggaggatcacttgagtttgagatcagcctgggcagcacagtgagagcctgactctacataaaatttttaaatta

SEQ ID NO: 148900 - DNA, 420 bp, Homo sapiens
tctcaatgcaaagagcatttaccatctgagaagttctactcatttactattgttagcttagaatctcatctgttaaaatggtatagaaatttgttttcttcctggttatatgtacacctacataatagccttgattttgcctcttggctcacaagcctgcaatacttactatctctggctctttacagaaaatgtttgctgaactctacagaaaacaatcccccatgctttatagaaaaagacacccaggaatctcttttactaattttcttttgttggacgtttttctggccaccaataaggtaaattccctttcttggcttgtaatgattagtctctggttggttgtcatttgcaatggcacaatacatactgagacctcaaagcagaaaaatcatagaagaaaacctaggaaatatc

SEQ ID NO: 148901 - DNA, 258 bp, Homo sapiens
tctagctcctgcatcaatgtactcccttctggattccacacagaagttcacataagaaacacattctgaaaatatttcttcatcttcatctcttcacaatagctcagcttctaatccacttttatgtgtgacattttgtacctgagttcttcagtgaaattttacattgatctcaatattacaatttccctgaaggtttaccgctttcatcttcttgaaggaagaatatatggtcacaaaataaacttgttaataaag

SEQ ID NO: 148902 - DNA, 450 bp, Homo sapiens
  misc_feature (10)..(10): n is a, c, g, or t
catacctggnaccttctgaacagtctggctgtgtctcccaggctggagtgcaatggtgcgatctcggctcactgcaacctccgcctcccgggtatttcaggacagccaggagggggcgcacatccgccgagaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattggtgagtaaaaagctcctgtccacggccctgagtgccaaggagtgagtctttagagtagtcagcagaggaagaaattcatctagaaaaataaagcccccaaatctcactgtttggactacaccctaatatcattgtcaacgtccaagacacagtggctgctaat

SEQ ID NO: 148903 - DNA, 395 bp, Homo sapiens
  misc_feature (10)..(10): n is a, c, g, or t
catacctggnaccttctgaacagtctggctgtgtctcccaggctggagtgcaatggtgcgatctcggctcactgcaacctccgcctcccgggtatttcaggacagccaggagggggcgcacatccgccgagaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattggtgatgattattccccaccttctaagagacaaagaccaacgagccaccacagccaccagtcccagaacctgccaatgctggggaacggaaaatgagggagttcaactc

SEQ ID NO: 148904 - DNA, 1249 bp, Homo sapiens
gatcaggagtattggagctattaagttgaactttaaatgaaccatttatgttaaaattttaaggattataataaaaggaagagttacagtaaatgtaaatgacctgtatttaccatgtaagacaggttctcagattggattgaacataatctgggtgattatttttactaagaaatacaaataaaacacactcacaaaaggtcgaatataaaaggatgggaaaagtacttgccaggcaaatataaaccaaaagaaaaccaagatagcttatattagacatagtagtctttaatggataaagaagagtttatataatgagaaaagattcagtacccaggaagatatctaaacttgtgtgcacacaggctcaaaatatataaagcacaaatgaaagaattacggacagaaagaagcaaattcactattcgtgttccattttaacatgtgttttagtgactataaatcaggtaaactgagtttataaaaatattgaggatttgaaacaaaactactaatttaataacaagcataattaacagaaagaagcaaattcactatttgtgttccattttaacatgtattttagtgattataaatcaggtaaactgagtttataaaaatattgaggatttgaaacacaaaaccactaatagcaagcatgtaatctgacaaaacattaagtcataatggcagttaaaatatttagaaatgataattaagtgatacatattaaaacttgcaggatacacttttaagtgtaactccatggctaaatgtacatttcaaggagtaataaaaacatgagaataaacaaattatacaaggaagaaagtagtgaataaatgaaattagtgaaatagaaaacacagtgacattccatcaaaaccctaagttagtaatttgaaaaatgttttaaataagcaaatgcttggaaagctagatcacaaaaaaggaaatggtgtctatgtacagttttagaatgaaatgagaaacaatggacatgaaaaagatcaaaagacaattccatgaggaatattttatgctaacatatttgaaattagaataaattcctagaaaatataacctggcaaatttgtcttgagagaaaatcaagacaaatagcctataaccaatacatttagttggttttaaaaactctgcctataagacaaaactcttcttttcaaacaacaatagcaacgataatagcagcaaaaataattacagcagcagaactcaaaccaacaac

SEQ ID NO: 148905 - DNA, 538 bp, Homo sapiens
ctatccctttattatcttgttttgttttttcatcactacataaatcctttacatgggtatttggcttatcactctatcaaaatgtaaactcaatgacgagaggcactcgactttgcatgtcagaattcctgtcatgaaacccctggaaagatttatgtatcagcgtcttaataatggtactgcaactttttctaataagttaatttttcattgcaacatttttatataaagccatacagttttgagtgtaaaaacctcaattaatgactttcaagcaaggcaggctactggtactttacaaacaactgtaaatgaaaacattgttttaaatttgggtctgtcttctaagtggtttgtattataaactattggtgatcagaatcatcctcctaagttgtgcttctgcagtacaagcatttaacaccaaagcaaatgaacatcatccttggaacagaggaaatgaatgagaagagaaaaaaaatgaataaatgctgattcagattttttgcttgcttctgtctcctgctctgtttttcat

SEQ ID NO: 148906 - DNA, 1208 bp, Homo sapiens
ggaacattgtaaaaatactgcttctgttcaggcaaaaaggcaaacatgctttaaaaaaaatttgtatttatttatatattttgaaatttcagtagcttttggggtacaggtggtttttggttacatggatgaattgtatagtggtgaagtctgagcttttagtgcccctgtcacctgagaagtgtacattgtacccaatgtgtacacaatgtgttttttgtctcttgttccctctctgccttctgattccctgtagtccattatatcactctgtgtgcctttgtgtacctatagttttgtttccacttataaatgagaacacacagtatttggtttcccattcctgagttacttcacttagaataatggcctccagctccatccaagttgctgcaaaagacattatttcattctttttatcgctgagtagtattccatggtgtatatataccatgttttctttatccactcatcagtcagtggacagttagattggttccatatcttaagcatgctatttttaatcctcattatagtaggtgtgttatattagtggaataagacaagacatacaatataagaggattggaagaaactgaactgaaatatgattgtgcagaaaacacaaaatggtgtacagacaaatttatagaaaatataagaacattctagaaggttgtgagacataaggtacaaaaaccttctagcataatttcaaaaaattttcatttgtagctttaacaaagatgtaaggtacttagaaatttaaccttaatgtgtatcacctttatgttgaaaattgttataattgactgaaaagcataatagaagacttacatatgttgagagatttactgtttatggaaggggagacttagtatcataatgatgtcaatcttctgcatactgatcaataattcaatcaaaaatagaaaccgaggccaggctcactagctctctctcattatcccagcactttgggaagccgaggcaggggaatcacttgagctcaggagtttgagaccagcctgaacaacatggcaaaaccctgtctctagaaaaattagctgggcaagtgacgcatgtctgtagtcccagtgacttgggaggctgaggtgggaggatcgcttgcagggaggtcaaggctgcagtgagctgtgatcacaccacggcactccagcctgggtgaccaagtgagactctgtctc

SEQ ID NO: 148907 - DNA, 405 bp, Homo sapiens
ttctaggcctgagctcagggcacacccatgaacagggaggtgagaagtggagaagggaagaggttcagttttggatatgttaggattgaggtgcctggcagacatttttgggagatcctgggcaaatccttggatatccaagtctgacagtccaaggagagactagggcagaagacgcactttgagtggtcctcatgaaggcatttagagctgaggcactgggtgatatggatccctggtgaaggtgtagatggagaagtggagggtccagggactcgttcttgagtcaccccagacccttgatctggcaaaaatgagactgacccagcaaggagggaaagacaggacgactaggtggtagataaacctggaagtgaagtgaagaaaaaagtgtaagatgtgatc

SEQ ID NO: 148908 - DNA, 485 bp, Homo sapiens
taagtatttcagctctaagttaatctcttcaccacctggaaaatgggggccatgaagatctctccctcacaagttgtgaggatcaaatgagatgacgatgcaaatctggcacatagtatatgcccagtgaatatcagcagctaccgaatgataataattgtatttttattactttttgtattatcataagtgtcacaataagctatataaagcatgctaataagaacactgaggaaaagcaataaatcttcctggagtagctcattccgaacagacaaaagtttcaggggagagagggagataatgctgagtaatgggtcttcaatctctatgagaaaaaaaaataacctaagcattgttcaagagaagatgccatgttcatttaaatgactatttcatcttaagaaagcagtctgagctactaatcaaaccagaaccctagccatgctgatgatgatcattaatgtcatcatccataaattcat

SEQ ID NO: 148909 - DNA, 421 bp, Homo sapiens
aaaacaatttatggtggctaacccactctccaagagatgtttacaattccttttaggaagaacaccaacgcttctactacgatgggctggtcgctggactagttttaggatataaaaacaggaagagaagaactacataagaaagtaaaagaggttctggttcaaggagtggctaaggaccagcttgaatcctccacaaaagtgcacccaaaacagcactgagaaaccaaatcaccagctgggaagacagaggagagataaacctggcctgcagtggggctgcaagtagaattccactgtctcattagacatcgagaagtcaggaagcccagtgccaccaacttgggagagctgcaggcttcaaccacaggacagtagatcctgagggtgacaaggagaacagtccatgtgcaactgatca

SEQ ID NO: 148910 - DNA, 396 bp, Homo sapiens
agaactgtgagaagtgtatttctgtagtttatcactacttggtttatggtgttttgttacagcagctcaaatgaactgagactctgcccttgtgccctttcttaggttgtctctctgttaggaatgacatccttgcagctacaaatctacctaaatttcaaggtgtcttgaaatcttcagtgaagttatttatacagaaacttcttaggctagaaaatctgcacctatgttggggcaaacgttactttgtatctcttctagctatttacacagattgttaagagtttctcctaggctgtgaggcccttagagtagggtaagagtctgactcaaattccacacactccatagctcttggctacagactccttatagacgccattctatagttgtttg

SEQ ID NO: 148911 - DNA, 247 bp, Homo sapiens
ccatctgtgccacacacagacgtaggtacatggagacagatgcacacacaggtctgtgcacacacatacatacgcatgcacaggcacctgtgtacacacacgcagatacacccacagcataccatctgtgacacacacagacgtaggtacatggagacagatgcacacacatgtctgtgcacacacatacatacgcatgcacaggcacgtgtgtacacacatgcagatacacccacagcatgccatc

SEQ ID NO: 148912 - DNA, 438 bp, Homo sapiens
taagtgtgagattgtttatattttgtaaaatgtcttaagatacaatgaaatggagaatccctgagtgtttttttgatttcctaaactctgatccacaattatagatgtttctgaaggttcaaaaatattgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaa

SEQ ID NO: 148913 - DNA, 126 bp, Homo sapiens
cagaaagaaagaaaggagggagagaaggagggagggagggaaaaagtactttctttcagaaactaaactaaatttcattttttacagtttagattttttttccagatttggtcagaatgagatttc

SEQ ID NO: 148914 - DNA, 272 bp, Homo sapiens
gtgtgtagtacgtaccaagtgtaaggcatcatcctgtactttgacaattggaaaccttctctccccaacttctaccaattggaagttaatttcagcactgaaaccacctcccatatttaacaagagcatcacagcacaacaaatataaacagtgatgacagtgaacatttatccgttgcttccccaatatgatttctcccttctgtcttcctaataacccccatttccattcttaactagggcagaaccaagacacaccgacagttaagctg

SEQ ID NO: 148915 - DNA, 1394 bp, Homo sapiens
  misc_feature (1)..(1): n is a, c, g, or t
  misc_feature (15)..(15): n is a, c, g, or t
ntttgtttgtaactncggatccacagggttctgtactcatctgctcttcatcccactgctgtgtgctattgtctttgtgatcttcatgattggattttgcttcttcaaggaagatataaaagagcccaagtaattctggaaaccagcattttacccttgacctcctgcttttcatcctactggtcctcgccagaagtcgctggttgcctggtataagaaaacaatcataattatctcaatattacttggacctggcctccctgctaatcaggtttgtactgctgagatttcaaaggagaacagaaatctactaagaagaaataaattggttctcaggctataaatagttctaggaagctgcccagggacaaaaatttgcctgctggtgaaataaaagaccatgtaaactgtagatttatttggagagtatagttccatgaatttaactggtctagactctgggcctctggaaggcagagaccatgctctcagccttgcctttagtaccttgtctgtaacaggctatcagatatgttgattgtgtcaaagataagcaaattctgaaatgagtaatttttttcattctctatcctctctgaattcacttagtgcctttcagaatgtgtctgagtggaaagggatttgcacaggatatgtccaaacaggttattgtaactttggaggtaaactcttgtctatcattccatgcacttcattattatttatatccatttctttctttctttctttatttatttaagtaattggtcacgaaatagacttgcatgctgaatgctgaaatgtggtgtttgacacttgtaaattattccagattatatatgagactataatagataaaagtgatttagataataaagtgatctgtaattgaagtaaatgagagctgggtgctgtggctaatgccttgtactcccagcactttggaaggctgaggcagtaggatcgcttgggtccaggagtttgagactagcgtggcaacatagctagaccctgtctctacaaaaagtaaaaaattaaccaagtgtggtgatgcgcacctgtagtctcagctacacaggaggctgaggtgggaggatcacttgagctccagatgttgaggctgaagtgagccataatcatcctactgcactccagcctgggtgacagaggaagaccatgtctcaaaaaaaaaaaaaaaaaaaagagaagtaaatgaaaacttagagaaatagtagttgcaacttccaaaccaaagcttgtaattctggtcactatgacttggaaatattttccagaacaactgtgactcttgccgttgctctataaaatactggcaaggtccaaaagggaattttcccccactgtgtataatattattagacagatggtattgt

SEQ ID NO: 148916 - DNA, 1461 bp, Homo sapiens
gcttctctggctgaaggaggaggattaaaggtatcaagaggaagggttgagggccacctgccagcccctactcattggtccttagtggctcagggttctgtactcatctgctcttcatcccactgctgtgtgctattgtctttgtgatcttcatgattggattttgcttcttcaaggaagatataaaagagcccaagtaattctggaaaccagcattttacccttgacctcctgcttttcatcctactggtcctcgccagaagtcgctggttgcctggtataagaaaacaatcataattatctcaatattacttggacctggcctccctgctaatcaggtttgtactgctgagatttcaaaggagaacagaaatctactaagaagaaataaattggttctcaggctataaatagttctaggaagctgcccagggacaaaaatttgcctgctggtgaaataaaagaccatgtaaactgtagatttatttggagagtatagttccatgaatttaactggtctagactctgggcctctggaaggcagagaccatgctctcagccttgcctttagtaccttgtctgtaacaggctatcagatatgttgattgtgtcaaagataagcaaattctgaaatgagtaatttttttcattctctatcctctctgaattcacttagtgcctttcagaatgtgtctgagtggaaagggatttgcacaggatatgtccaaacaggttattgtaactttggaggtaaactcttgtctatcattccatgcacttcattattatttatatccatttctttctttctttctttatttatttaagtaattggtcacgaaatagacttgcatgctgaatgctgaaatgtggtgtttgacacttgtaaattattccagattatatatgagactataatagataaaagtgatttagataataaagtgatctgtaattgaagtaaatgagagctgggtgctgtggctaatgccttgtactcccagcactttggaaggctgaggcagtaggatcgcttgggtccaggagtttgagactagcgtggcaacatagctagaccctgtctctacaaaaagtaaaaaattaaccaagtgtggtgatgcgcacctgtagtctcagctacacaggaggctgaggtgggaggatcacttgagctccagatgttgaggctgaagtgagccataatcatcctactgcactccagcctgggtgacagaggaagaccatgtctcaaaaaaaaaaaaaaaaaaaagagaagtaaatgaaaacttagagaaatagtagttgcaacttccaaaccaaagcttgtaattctggtcactatgacttggaaatattttccagaacaactgtgactcttgccgttgctctataaaatactggcaaggtccaaaagggaattttcccccactgtgtataatattattagacagatggtattgt

SEQ ID NO: 148917 - DNA, 398 bp, Homo sapiens
caaaatcatttgattttctgcagaaaattccttgataaaaaaaagatcctggggtttatgtagggcattaccccatttagtgaaaaactcacccatttctttcctccataaatgtgtcatttttagatcaactaagtaccaaggaagctattctctgatataatgaagagaaaagaatcttgaacctggtaagagtggtctcaagccaaaacagataatttctacagaatacaataaatgctctttggctctgtgtagtgatattgcctcccagacattttaagacttaaaacctaaagaatgggtttattttaaattaataaatgtagatgcggccgaaaccgcgtggaggtccacctcaggcttttcccaccccaccaaaaaatactaaacagaaa

SEQ ID NO: 148918 - DNA, 542 bp, Homo sapiens
cttttaaggaactccggatccacagggttctgtactcatctgctcttcatcccactgctgtgtgctattgtctttgtgatcttcatgattggattttgcttcttcaaggaagatataaaagagcccaagtaattctggaaaccagcattttacccttgacctcctgcttttcatcctactggtcctcgccagaagtcgctggttgcctggtataagaaaacaatcataattatctcaatattacttggacctggcctccctgctaatcagatcaactaagtaccaaggaagctattctctgatataatgaagagaaaagaatcttgaacctggtaagagtggtctcaagccaaaacagataatttctacagaatacaataaatgctctttggctctgtgtagtgatattgcctcccagacattttaagacttaaaacctaaagaatgggtttattttaaattaataaatgtagatgcggccgaaaccgcgtggaggtccacctcaggcttttcccaccccaccaaaaaatactaaacagaaa

SEQ ID NO: 148919 - DNA, 228 bp, Homo sapiens
gtgtgggtgatgaacaaggagaagtgcttgagagcccgggaaaggcacatctgcctacaaggtgaatcgggctgaatcacaggggcactggagccacccccagatgaagacatctattttcaatgaatgtagtaaagcttttcctaacttcagaagccagcaggtggactaagggctgggagggcccgagggcctgcccagcacattgactctggagactacgcattg

SEQ ID NO: 148920 - DNA, 152 bp, Homo sapiens
cttcaacactaagggagaaatactttttcagacaactggaatctgggggaatttgttgccagtagatcttccttgaaagaaatgttaaaagaagttcttcagagaaaaggaaaatgatacaggtcagaaactcagatctaagaaaagaaagg

SEQ ID NO: 148921 - DNA, 356 bp, Homo sapiens
tttcagttaagtctcccctgatcattttaactagggtatacactcagtcatggctttaatatctgccatcaaccacattgctccatcatggcatctgctacactttggtgtcatcagtctttgattagacagttcaatgaaagcagaaaccacagtaatttttgtcaccactaaatgcctagtgcttggcatgatgctgggcaaaggataccctaatttgctgaataaagccttagtttagttgcttaatacagtgtgtctccctattaaacacagtacttaaaattcgtatttccaaataagcattaatacacaaatgcctttgctagatgatcaggaacaaactgctgatcttc

SEQ ID NO: 148922 - DNA, 295 bp, Homo sapiens
ggtaaatggatgggtggacggatgggtggatggtaggatgccggggatagcaagaagagggtgtatgggagacacatgtttaggaaataaaagttgggagctggtgacccctcctctgtgcagcacccaccacaactccaggcacctctgcccttggcctgctctggttttctccatctgacacacttgactccatctgatgctctgcagtgtccactgtttacaggtttctgtgctggagtggcagctctgggtggcagcagagattctgtccactcattcatttctgcatccc

SEQ ID NO: 148923 - DNA, 390 bp, Homo sapiens
aaagatattaagcgcaatggactgaaacacatcaaatgtgttcaaacacacaagctgatgacgacaatgctgatgatgacaacaataattataactaccttggtcacttttaggtgatgacagtaagtgactgatagacctagaccattctgcaactcctaatgaattaatgaaccaaggcaatgatcatcaatggctgataatgttatgggatccttggggtgttgcttcgccagccagaaacctctgtggccagtggcacctttacctgagttttgctcgggcccagcgggcccacttggcttggcaggctgcgctcggctgacactaccggcctggattccatgcctgccaagggcgagttgggagaggtgacgggtgtgtgagtga

SEQ ID NO: 148924 - DNA, 494 bp, Homo sapiens
gatccatagtgacatgaaatgaggtggaacgctggatcactcctccctgttgctccctttagtaggtcttccaagttcactgcattattaccagctaattaagaacagacctgtcactcgcaggagaaccatctgtttagtgagatgcaaaagtcatcctttcggttgcaatttaaaggtttcacctgttggagtcattccaggtggttctattattaatcacttgatcatgtcatgtttaggactgttcagaatccccacaaagagaaaaagatcatgttgtttaggggttctctgggattctaaagggagctagtctatgacagagggctaggatatttctcataatacactgctcaacactttggaccccacacttcccatcatggaagtatctattctcattgatgatagtggaaatcaccttttatttttaaagattagcttttattttattttagattcaggggatacacatgcaggtttgtaacatg

SEQ ID NO: 148925 - DNA, 228 bp, Homo sapiens
gcggccgcctactactactactgctcgaattcaagcttctaacgatgtacggggacatgtttcagtaacttatcttgcttatgagactttaaccattagtcaagggcacactttcaacatacacctctttatgtgcccttttctatgcttctacttctgaccaccccaagtgcctccctctttctgactgatctctcagtctcataagatgtgaaacgaaaaaaaaaa

SEQ ID NO: 148926 - DNA, 405 bp, Homo sapiens
ccaccccaataacatatcgtgctcactgctatctttgaggcaacccttgaattttactcagcctggagcgctcttcacatgtcttgtccagagccagttcggactcattcttcagccgtgcatcagtcagtgggggctagcttaaactgtggtgacaaacaacctccaaatttcagtggctcaaaaatcttcttcctcatttatttacatctcatgactggtcaggtgagaggtagctctgtgctgtgtcatcctaacacaggaatccagaaggaaggagggaccatcaataagatccccattgctatagaaaagagaaaaaagcatgcggaatagaacgctgtttcttggagatttctcctgaaaaagtcacgttatttcttctcacctccattggcaaaaaaa

SEQ ID NO: 148927 - DNA, 474 bp, Homo sapiens
ttcaataaacataatctgttttctttcaaaataacatggttatctaattcccttcattagcagctagcaaaagaggccctgggcttcccgtgagctaattcactgggtccctgaggtcgttgcgggctttccctctcactcttgcaacagacacaatctcacttctttaatgtaaagtatggtttttctgtcgaaatgtgcttcctgttttctttatcgtaacttacaggcatgattgcctgggtcttctctcattattcccagtccactgcctcttcatatttagtggtacttctgtcttactggtccctggaaatttatctcagatcatttccttttgggtctatctcttctttaagagaaataattttaaagtcaaagctccataatacagagatctgttctctttcccaccatctgttttctgaacctcccctcctggttcaagcctctgtaggataatttgaacacaaa

SEQ ID NO: 148928 - DNA, 267 bp, Homo sapiens
agcacagggagagagcagtgactttgccaaggaggcctcagcgtccttagctgcagacgggcgacagctgccccgtagccctgggcttcatcttcgtgtggcttgagagctcagatgtgacaaggcatggaaaagcactttgaaagccacaccgaggcattgcgctcctgttgccatctccagttattatctaatcacactgttattaccaggtcattagagagggagcacctgcttcacctgacactgagcacagatggccccagg

SEQ ID NO: 148929 - DNA, 601 bp, Homo sapiens
cattttacagatgctctaatggagtctcagataaagagagctgggaggaagtagagtttagtgtcaaagccaggtctgaccccgtgtctgtgtgggtccatcaatgtatatgcacctggtagatgcacatgaaactatttcagcctcctgcagaaacatcttaggtagaaataagtgagcttttcagtttagtgtttgccaaggttggcggacattcctttgtgattttgtcaaaaaagttaagggaaccgatgtgggaaattgaatgccagctattcgtaaagggtaagcattaggtgtataacttgaacaccatatattatttgtgcaaattgagtgttctggggcactgttcttgcatagtgagtgctctcaggcatggcacttggaaagtcagacatactcttccctcccaagggactcatagttaaatgggggtattacaattatgatacaccattgaacaaagcacattgcttagagaggtttatgtcttgtcctgtgtttggacggaggaagagacgccatcatgggggtggggagtttcaggaaggacttctttgtaggagacaggcatctggatggagaggtaggatggaga

SEQ ID NO: 148930 - DNA, 854 bp, Homo sapiens
aaatatgcatctccatttattttagaagcaaaaagaaccaaagcaattatggatacaaagcaattaatattctacctgtatgccatcctattcaaggattcaatattggccaacatcaaaaattgaaataaagattgcaaactgtaaggtaattttttaaatgttagaaaagaaacctatgaggcaggagaatagggtttagaggcagggaacctaaggccaattcatactgattttctagaactaaatcaaaaggaaaactcaactttccacacccaagtaacaaaaggatcacagactacttcctctgcaaaaccctccaccctcttcccagggcagaggcaaaatggaaagtacctctgattggtcccctcccacgaccaatcagactggtcacagtctttatttgcataggagtgtaactttgtaacttcacttcagcatctaattggtccccttcagcagccaatcagactgactgcaggccaaatcttcttctgtaactacactttcagcctctgattggtcactttctgcaaccaatcagaatggttgtgggcctctacttcatttacacagagtgtaaaccaagtaagcaacatgaaacctctagagtgtatttaaactccagaaaattctataactggagctcttgatccacttgctcaagcccgctcctactctgtggagtgtacttttgtttcaataaatctgtgtttttctttcattgctttctgcattttatccagttctttcttcaaaatgccaaggacctggacaccctccaccggtaacacctagactctgattctttcttcaataattagacttcatcaatgtttgatacatcgaaa

SEQ ID NO: 148931 - DNA, 382 bp, Homo sapiens
ctatcatcaaagtatgaaggtcagagctcttttgtcctttttaatagtttgttttcttaaaagtggttgagtgtgaattttctcttgcatgggaaaaggatcattgttttcactggcatcagtgaatgcgctcacacatgactgtttaaatatgtcttcattcgttagtcagtaggatcgcatcctgctggaagacagattgtgtaacctcagaggcttccagggaaactccagtcccagggagagagtgggacagtggcatgctctatagagaaagcaccccttgttctctctctctgcctccccaaccccgccccactgatctccctcctggtgcaggagggactgttggagcagaagaaaacatccagctcacctgtca

SEQ ID NO: 148932 - DNA, 439 bp, Homo sapiens
agcttttgtcaccatcacaaacttctgcagccttggccactgaggcaatcacaggcatcactgatgaggatgatagctgaagaaactgcaactgcataaagatcacatcactgaatctacccagaactacagccaatgcatgatacccacttgacaacctaggacctctctacaagaaaaagtctttctctatgaaagataattcataaaattttaaaaagtaactcttctactagatgcacagatattaatgtaggaacccaaaaaccataaaaagcaaggaaatatgacaccttcagaggattatgtctctaatcaaagaccctgaagtgaaagatatttataaaatgcctgaaaagaaattcaaaataatgctcttaaggaaactcagtgaaatacaagataatacaggtagacaattcaataaaatatggaagac

SEQ ID NO: 148933 - DNA, 433 bp, Homo sapiens
cacaaggtcacagtgaggaaaattcccagccagggcttatggagggttcagaccaggaagccaactcctgtgggaaaagaggaaggaacatagcacctgaactctgcccagagagtgcccgatggttttactgctaatcggtagtagaatgggtagctttgatgtcatcagcatttggcttgagaggtcaaaatgagagcactggagcaaccagcgtgctgagctagcaaggagaaggaggaggtttcctgacctgggggattgtgcatgaggcctcggtccatgggttgtcagggactgtcactggggcacaaggactgtttggccttgagcatcagttatgttatgtaaattacgcttaatgaaagtgcggccttggtccataaaaacttaacaatgcatttgtcttcatttgatcattccccagcagcca

SEQ ID NO: 148934 - DNA, 376 bp, Homo sapiens
tagggttaccaactcaacctgattttcttcaaattatactggttttatttttatttttggccaggaaagggaacttttgtatatactgcttttagaacagaaagttccatatccaggggaacccctcagtcctgggtaaatagggacagctagtcaccctgcttggtcatggcataccccgcttctgctcatgtttcattggctagaacttgtcaactggtcacacagactgcaagggatgctgggaaatgtcatctacttgtgtgcacaggaaacagtcccagattcacaaagagctccctgcatagacagttggtgaatgtttcttatagctataaacagtgaagctgagaagcctaaaaactggtttacaaaa

SEQ ID NO: 148935 - DNA, 351 bp, Homo sapiens
catgggagatgttggtgaccctgaggggtttgtggccctgtgggggcccaagacctgcaggcgagacagtagttggggaatgtagctctgtatcgctgtagaacttggccctgctcccccttatatggcctggcttgtgcaaatggttttgcctggtctgtggagtggggaagagtgccgggaacagtcccgagacacctgctggtgtctcctgtgtgccaggcaccctgccgaagctgtgtctgtgctcaccctgagccctccccgtagcccctgagccccatcgtggaaggagacaggcacagcgggggtggctcacactggcaggtttcaggttctcggagtctgatt

SEQ ID NO: 148936 - DNA, 391 bp, Homo sapiens
gtgatggaggggtgggagggccctacagatttttaaaaatgttaaattctggtttccttttaagtcaagtttaatgggaaaggacggcaaggctaaccagtgtctcgctgcacaactggggactggcaggtcctggcgtttcttcctggctttgccataaagtcagggcagcagttacttttggagggaggtaaaagcagctgtgatgtggtggggcacataaaagggtgggggatctcccaggtgactggcatgttctagtttggtttttttgtttgttttttgtttttgagatggagtctcgctctgtcacccaggctagagtgcagtggcacaatctcagctcactgcaacctccgcctccagggttcaagtgattctcctgcctcag

SEQ ID NO: 148937 - DNA, 594 bp, Homo sapiens
aggggactatgataaaattataagctgacttcttatcagaaataatagaggccaggaggcattagaatgacatattcaaagtgcttaaagaacaacaatgacaaaaagattaactgagatttctatacccagccaagctgtctctcaaaatgagtttccaataaacaaaagttgagatagtttgttgcaccagtgaaaacaagaccttcaggctgaaaagtaatcagtcataaaggaaagaacaaaaagggccagatattatacattattgccaatatataagtagatatttatagctatctcttaattttcaattttttaaaagatctatggctatgtaaagccacatttataacattatatggttaagtttataacacacattgatgtattaggttggtgcaaaagtaattgtgttttttgccattacttttatgcaaaagttttggcaattacttttaatggcaaaaactgcaattacctttgcaccaatctaacattatatatgaaaatgataacacaaaggacgagggcattaaatgaaactatattgttacaagcttcctatatatcaccaaaaatgtcaatatttaa

SEQ ID NO: 148938 - DNA, 356 bp, Homo sapiens
aaagaaagagaaagaaggaagggaaaggaaagaaaaggaaaggagaaaagaaaagaaaaaagatgagactgcgtaaagactcatgtgttctatactcatctgagatgaagctgccccaaagatcaaattcagaaataaaagacatgcaacgtgcttactacatttggggtgagaaaaatactaacatttgaataattttaactttatatttaaaaccttcctcttctcttcattcggggaaagggtttcccgttaaccccaatactttaaaagagggctatatcagtgtaaatgagattaatgagccgtgtggcaattccacgtatctatccccttccctccctgcttacctctgt

SEQ ID NO: 148939 - DNA, 481 bp, Homo sapiens
ggaggcactgaaccccagtggggagaccagaagtgccaaggcaagcactgtctagctgacattttagccctgggaaggctatgtggggtcctttgggtggaaggaagacagatttggcactccctctcactagtttctccagagggggttccatcagctcactgctgaccacctggcccgtccccaccccaccccaggtaaagcagataagtgaatagcacggccttgcttagcttccaggcacgtatttgcagggccagtccatctaagagcagaccattcaatacaatgctgccctggtgaccgcgtgcccaggtcttgtgagctgagttcctggctgattgctagttacctctggattaataagacacctcgttttgggtccaatctttgatgctgagaatcttcgtagggagcatgaagtctgtttttctcaagtggacatagtactcaaatatctcactacgatgactgtcaatct

SEQ ID NO: 148940 - DNA, 187 bp, Homo sapiens
gcattcatagggataaaagggctatgatataatagtaaagggaacagctgaccaggaacatatgacaaatctgtacttccagatatgtgtaccaggagaattgtatataatacagcatttatgatattagcacttgagtgttcactctgctatggtttccagtaacctattccactgggaatttggg

SEQ ID NO: 148941 - DNA, 793 bp, Homo sapiens
gtagcaggaagatttgcatcccagtgaaagcacaggccctgccggcgtgggagacagccctgtgctgaagcccgaagggcagtgaggagttccccggctttgggtgggctgtggggagtcagatcccacactagaactacaaagccacaggcagggagggctttggtgtctgccttggagttgagggagttgctgcagacctttccttgctagaggcaggctggggacaggacagggttgggggtagtgccaggtaagagggtccagccgtggccctgggctcccacgcctgcctaggcactgccccccaggctcagggtcagtgaagacgtctcaaactccccaagtcaaaagggagtgctcaggtgtctcctgccactgctgctgccaacccagcaccaccctggcatctggcgtcagggacacagctcctgacccagcagcccacggaaggagaggaagaatggggaagaagttgaagctccaggagatgactcagccccagacacctggccagagtggcactgcacgtggctgtgctgggctggccctgcctctgcaccagcaagttcctgatctcagggttccgccagtttgggcaacgtacaggaagcatggctggggaggcttcaggaaacttaccatcttggtggaagcggaagcgggcaggtcttacatggccggaggaaggggtggggcggtgccacgcacttccagacaaccagatcttgagaagtcttatcatgggaacagcaccaaagggggaagttgcccccaggatccaatcacttcc

SEQ ID NO: 148942 - DNA, 185 bp, Homo sapiens
tcaccttgaagtaaatttgcatttgtagttccttttaggtgccatgcttatagttttagaagctactactgtacaattaagtagcaagttataattatgcatcagttaacgacagggataccttctgagaagtgcattattaggcggttttgtcattgtatgaacatggtggagtgcatgtatac

SEQ ID NO: 148943 - DNA, 350 bp, Homo sapiens
gggcgcatcatctggtgtttggtacctggtaggtgctcattagatattgaatgaatgaataaataaaagccggatgccctggctcatgcctgtaatcccagcagtttgggaggctgaggtgggcagatcacttgaggtcaggagttagagatcagcctggccaacatggtgaaaccctgtctctaccaaaaatacaaaaattagccgggcatggtggcccatgcctatagtcccagctacttgggaagctgaggcaggagaattgcttgaactcaggaggcggaggttgcagtgagccaagatcatgctgctgcgctccagcctaagcaacagagcaagactctgtctca

SEQ ID NO: 148944 - DNA, 282 bp, Homo sapiens
taagaccagggcaaggtacccaggccactaggggcttccagtgggagtccactgaccccaggaatgccgcctgtctggaccaccttctccaccaagcaaatgggcctcatacaatcttcttgcccgaatcctgacctccaggacccaggacaatccttgaggccactgttccaccagctgggcacccaatactaccaactccaagactattgcacctgccccatttgtgcaggggaaaggggctgtctctttaacaagccccaagcccatctcctgggcctc

SEQ ID NO: 148945 - DNA, 581 bp, Homo sapiens
acacgcagtttgggagccacagtgctagctgttacacaggtgtagtatcataccagtcttgtgcatcccccaagatgcattgggcaatgcagtcctcatagtaggtggccaacaaatattttatgagcatcttaatccttatttcctgatgggccacaaacgccacaagttcaggagtgttctgagttccctggtccagcaataattcaaataaaatccattttaacatcttctggggatgctgtaaaggatatatctgtactgagtggaggttggcttagatgaccttttaattcccttccagggctaatgctctttaattcaatagcagcaacgcgcaacataaagaacaatatgaacacagttgtatggcagtggtgaggatgtaatgtctcaaacccccatgccaaaatattaaaaatttgaattctaacatgtagaatttggttggagtaaggaggtggagacataaaactgctgtttagttaatatgatattaatgtattaattgatgaaccttcttagttgccacaaaaattgatcatatcgagtaggacaccaagaaaaccacagtaaatgcc

SEQ ID NO: 148946 - DNA, 1036 bp, Homo sapiens
gcgcggccacaagagggggcgattcaccgccgccccccgtgggacctgggtcctctacgcgggaccgcaggggccccgagtcgcgggttgggcaaggtcgcccgctccgggtcgctcggaagggtcatttcacggactggtcgtctggggccagtgcgtcttgccccgcacggaagacccctcgcttcgaggacacgaaagcttttaaagtgaggattggctcgccgcgcctcccgcagaggggaacgccgcccggacccgcgctcctggggcgggggcctcgtatgctggcgttgccggagcgtctgcggcgctgaaggctgccgagacccagccacatcccccacaagccagcagcccggcagaaaattacataaaatgcagcgcttcgccgagggggtgcgagtcgggggagcagcgcgcagctgcggctgacggctcggccggatccatccaagcatggacaggaaaacgggactgtggggagagggtggtgcagacgggccgcagaccctccttaggaagagaagccggaaactagggagtcatgtgcagttagaatcctcttggaagactagtaggatgtgaggttggagaggtggacgacgaccagaaaattcccttgtcttgccaggcttttgacctaactatgagtttcctccgcgcatccagcctgccctgctctggcccctaaagtacagcagtaacactcagtggtgtccctgccttcctggaatgcgcgttaacaattctgattcttactcatggcaataacctacacaccacatagacgttaaatgtggttcgggtcagactctagggcaggactcactgcctgcaccttgtcttggctccactgcactccagcctgggcgacaaggcgagactccgtctccaaaaaaaaaaagctatttgtgaggtaacaatctaaatatgtttgagctagtgcaacagtaagttaactccttacatctgttaattcagcaagcactaacaagtgatggagattaaaaaaaaaaaaggaatgagccacagc

SEQ ID NO: 148947 - DNA, 1007 bp, Homo sapiens
gcgcggccacaagagggggcgattcaccgccgccccccgtgggacctgggtcctctacgcgggaccgcaggggccccgagtcgcgggttgggcaaggtcgcccgctccgggtcgctcggaagggtcatttcacggactggtcgtctggggccagtgcgtcttgccccgcacggaagacccctcgcttcgaggacacgaaagcttttaaagtgaggattggctcgccgcgcctcccgcagaggggaacgccgcccggacccgcgctcctggggcgggggcctcgtatgctggcgttgccggagcgtctgcggcgctgaaggctgccgagacccagccacatcccccacaagccagcagcccggcagaaaattacataaaatgcagcgcttcgccgagggggtgcgagtcgggggagcagcgcgcagctgcggctgacggctcggccggatccatccaagcatggacaggaaaacgggactgtggggagagggtggtgcagacgggccgcagaccctccttaggaagagaagccggaaactagggagtcatgtgcagttagaatcctcttggaagactagtaggatgtgaggttggagaggtggacgacgaccagaaaattcccttgtcttgccaggcttttgacctaactatgagtttcctccgcgcatccagcctgccctgctctggcccctaaagtacagcagtaacactcagtggtgtccctgccttcctggaatgcgcgttaacaattctgattcttactcatggcaataacctacacaccacatagacgttaaatgtggttcgggtcagactctagggcaggactcactgcctgcaccttgtcttggctccaccagcttgaccttgagcaagtcacaacctgtgggtctcagtgttccttactagtaaaccgtaggtaattcctcactagtaaacagataatatttgtgcctgtctcaaagttgtgaggatttaatgaatttgtgttcctggtatacagtaaa

SEQ ID NO: 148948 - DNA, 881 bp, Homo sapiens
tctgatggacagaggaggtgtgggcgctccgagaccatgcctctgcctaagaagggacccagatctgctctgggtttgccaaagccagggcccctctgctttgctccccctccgcattcccgggcagccaggatggacggctgggcttcagagcactcatgcagcagtggctcagggccacctgtccccagggaactggaagaagcgttcagggccctgaaccaaacggctgctgaaggggtccctgtggggagagcccccagccctgcacagaggcaaggacacaggttcggggcgggcactgcccgctatgtgttcccgaggcccctgggaggccctcaccctccctgcctccttccccttcccacagagtgaagtccgaggccatcatcgcccgccgtgaacccaaagaagaggcggaggatgtaagcagctatctctgtacagaatcggtacatccactcttcactcttcacatgcggggcgtccaccattcacttttcacaggcggggcggccaccgttcaccattcacacacagggtgaccaccattcaccattcacaggcagagcggccaccattcaccattcacaggcggggcggccaccattcaccattcacaggcggggcggccaccattcaccattcccaggcggggcggccactgttcccacacattcacacgccgggtgaccactgttcatacgcattcacacgtggggcagccatcattcccacacattcacacgctgggcggccaccattcaccattcaccattcacacacagtatatcctactattcacactcggggcatggggatgcggggtgcctcccggggactcaccggcgcttctgtctctgtacagaatcagtatatcc

SEQ ID NO: 148949 - DNA, 8281 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcacccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148950 - DNA, 7244 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148951 - DNA, 5617 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148952 - DNA, 8184 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggcccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148953 - DNA, 8334 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagagtgagtggcctgcacccctgcaggggcagtggtgctgccagaggtgtacgtgggttcacggggtggctctgcagggccaccttggagggtgccttgctgcccctacgctgaccgctctcctcttctcccatgctcctcccatgtccccagctgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggcccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148954 - DNA, 7935 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgctcccagggagcaacagagaggccaccaagcagaggcccgtggggctgaggatggaggggaggggtgacgattctcctcaggctttggccctgcaagcaaacccacatatctgctctgtatgtaataaatgtcttaacgtcgta

SEQ ID NO: 148955 - DNA, 3826 bp, Homo sapiens
ccacgcgtccgcggacgcgtgggaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148956 - DNA, 3348 bp, Homo sapiens
cagctcggtcccggtccaggttgtgctggtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148957 - DNA, 2606 bp, Homo sapiens
tcgagctggtaccgacgctctctctgtggggtccctaggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148958 - DNA, 2588 bp, Homo sapiens
  misc_feature (46)..(46): n is a, c, g, or t
tgaggtgactccaggattaagtttacagcgtcaggcagtcagcgtnagggcgacgtgccccacgtagggccccggggaggggaagaggctcctgctggccagcagctctcccgcatcttccatacggaagtccacgaggccctacgtggggcccatctcccctgtaccacctatgactcaggcttgaacaggcgcaaagcaggcgctggctgggaggtctgaggggactgcaggtggccctggagctgtggcaggtttggggctccccacttcctctcctctccccagccctgttgatgggcagccatgactccacagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148959 - DNA, 2011 bp, Homo sapiens
tcacaggagcctctcccatcctccacctgtatgcgggctcagcgcctctgggttctctccctgcagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148960 - DNA, 2180 bp, Homo sapiens
ctgctccgcccctctctgggatgggtggctaccttattcaaggtcaaggttacaagctataaagagtccatggtacatttaaaaatgtacactttttaaataactgaggtaaacctcctccaagcttggaatataatccaggagcaacattgtgtagacgaaagagcactggtctagaaggcaagaaatttgggctctactcttggttctaccaatgggacagccaggaaaacctgggcttctgctccgcccctctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148961 - DNA, 4939 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggggaggggtgacgattctcctcaggctttggccctgcaagcaaacccacatatctgctctgtatgtaataaatgtcttaacgtcgta

SEQ ID NO: 148962 - DNA, 187 bp, Homo sapiens
cagtgtgggcattgaatggccacggtgggaggtgttggaagagtctgcagacgcagccactccgggctgcccactgactctgctctctctcccgacctgtggatcccaacagcccaacccagggcatcgtgaacaaagctttcggcatcaacaccgactccctgtaccatgagctgtcgacggcagg

SEQ ID NO: 148963 - DNA, 9169 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148964 - DNA, 6456 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccagtgttttaaccaaacagttgtggctactcatggtgaggaatgaccgctaagagtttgggttctttcagtgcatttggaggtcactgctacacgttgatgtttaggaggttgagaggtttgcctttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148965 - DNA, 9438 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagaggcgacgtgccccacgtagggccccggggaggggaagaggctcctgctggccagcagctctcccgcatcttccatacggaagtccacgaggccctacgtggggcccatctcccctgtaccacctatgactcaggcttgaacaggcgcaaagcaggcgctggctgggaggtctgaggggactgcaggtggccctggagctgtggcaggtttggggctccccacttcctctcctctccccagccctgttgatgggcagccatgactccacagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148966 - DNA, 9191 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagtgaaacctccgcaccttctgtgttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148967 - DNA, 5639 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagtgaaacctccgcaccttctgtgttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148968 - DNA, 9250 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgtagaagttggagcagacttgtgctaactccaggtagttagtatcataattgaattgaattgtaggacacccagttggtgtttc

SEQ ID NO: 148969 - DNA, 4282 bp, Homo sapiens
  misc_feature (1)..(1): n is a, c, g, or t
nttttcccgggatgggccgacctcctaggggagttctcaggttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148970 - DNA, 5694 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148971 - DNA, 5630 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggtacatccactcttcactcttcacatgcggggcgtccaccattcacttttcacaggcggggcggccaccgttcaccattcacacacagggtgaccaccattcaccattcacaggcagagcggccaccattcaccattcacaggcggggcggccaccattcaccattcacaggcggggcggccaccattcaccattcccaggcggggcggccactgttcccacacattcacacgccgggtgaccactgttcatacgcattcacacgtggggcagccatcattcccacacattcacacgctgggcggccaccattcaccattcaccattcacacacagtatatcctactattcacactcggggcatggggatgcggggtgcctcccggggactcaccggcgcttctgtctctgtacagaatcagtatatcc

SEQ ID NO: 148972 - DNA, 2574 bp, Homo sapiens
gcagaggggccagaaccaccagaggagagccagggctaggagcaggaacaggatcagcagggcgatggccaggatggaaccgtcagaacagtgtgtggtggtgatgatgacagaactggagataaaagagaggccatcgttcatgctgacctggagtgcagctttcatgccaacttcttttaagataggcgctggctgggaggtctgaggggactgcaggtggccctggagctgtggcaggtttggggctccccacttcctctcctctccccagccctgttgatgggcagccatgactccacagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148973 - DNA, 1939 bp, Homo sapiens
ccccgtactagtacgacagtccccgactagcccgacagccccgactagccctgacagccccgactagccctgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148974 - DNA, 4978 bp, Homo sapiens
ggcggcggagccctgatggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggaaagcgcaagccttcccccgcaccgctgtgcctgcacaatgctggggctttctgctgttggttttgtttgtaatgaaag

SEQ ID NO: 148975 - DNA, 687 bp, Homo sapiens
tgtcatgtgacatcttagaggatcccgctgctcatgggcgaaagtgagaccttgccacatcgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 148976 - DNA, 322 bp, Homo sapiens
tgcctttcctagtactaacatgctgagaaagcttaagtagttatcagatggttacttgataaatgtgcaagtcaaatacagctttatacacggaagaatcacatctgttctttgttctactggtgcccagcacatagtagataactcagtaaatattgttgaatgaatgggtgaatccaggcccttgtgggtcctccttactgcagcatatatctctaggaactataaagtcatctcctcaaattcagcatctctctggagaatgctagactctaactctttaaaattatctttttcaggggtggcactgtgctgtggtggg

SEQ ID NO: 148977 - DNA, 718 bp, Homo sapiens
tttacatcttgttaagttcccctgcccaccctcttccccccgcttctggctttgcctttgtttgaatatctaattctctgcttaacaggatcaagaagaggactgtaagagcaggaaaatttcacattttcagaaaacactctctatttatgcatgactgctgatggcatattgaatagaacagagtaccacccacccaatatctgttgttactttcaaaagacaaaaaccttacatataaccacacacagagcatgcagtcctgaagtttcaaaatcactcgattccctctccctgctccaattactggcataatatttataaacagtatacaaaatatgttttgatgacacttgtttttaagagttggaaaacattttcccactttaggaaagctccatgatatatagcttaactctagaattagtgtcattaagtgttaatattctaacaaaacatgtaagtttaccttcctctattggcattacataaaatttaaatgtaaagagtacaaactgcctgaaaaaaatgatatctagtagaaaagacattaaatgaggctgattctgatctgaacattctttgattacgagtacaaaaagtatcaaatattctaagaaatactaaatgacatagagactatatcttgtactcaagtatcacagagtaagaggacgaaaaactaaaactgaggactatactgcttacaaggataagg

SEQ ID NO: 148978 - DNA, 832 bp, Homo sapiens
tcaaatcaagtgcattttattttctgtgtgtaggtccgctaaggagtttcatgttagggcccatgaatgtatacattggcagtatgtgcacaaacacactgtggttcttgatttctggaagaattcaagtacagagttccaaaatctcctttatcactcgacatacagaaccctcttgtcttgagtttgggagttaattttgctctttgtccatattgtccacaatcttttgtgtagccttttgtaaatgtaagcaaatactgattatttactttgtgctaggcttataatcctttgcatccaagaataggattgctgacatagtctgcttataaatctctttttctgtgtggtactgtgtctgaaatgaccatatatgaactgaagcccaggtcattctacttatccgaattttccagcctatcattaaaaaggatatgctcttctctgccattctcctgaagagttcaggaatcaaaaagacactaaattggaattaacaatcaaatatttggaaatttttaaattagaaagttaactgtatcattttaaactcaaaatttaaaaaataatttgatttgatccctacgtcattggatccctggagatattcatgttcagatattcttgttcagatattcttaatgtgttgttttcctgccttttgtccccatcggttttaatttttattgtttggtttcttctgataaatggactctttgaattgagctgtatagaacacaattttatgtctatgctttacaactgttctacaagtcttcattatgtgacgttttctccatctgttactattaatgaacaaaatatctat

SEQ ID NO: 148979 - DNA, 472 bp, Homo sapiens
tgaaagcataaagaagcaatgtaatcacaagcaggttacgtattttctagtacaaaaaataatttcttacctttaataagaatagatatcacaagtaattcctaggtattaaaacatataatgttggtctaacacctagatacttcctaagagtagtgttcacaataaaactctctgcttttcaatccccacccccttcaaattggggcagttgagatatcacttcagtagcatttgggaattcagtagcaagagggaatatttgcggactcagatgatcacagctggaagaaggactctggaaggcatccagtgtagtttctattccgaccaccctggacacagcacccagcctttgatcacatctcctgctggcagctctctacttcccacacagtctgctggatggctctaagggatagggttcttccttttctttgagatggagtcttgctctgttgcccaggctgta

SEQ ID NO: 148980 - DNA, 436 bp, Homo sapiens
tgataagaatttttttggcatggaaatgatgtattttattgcctttaacttctaatacccccttaattacaaacataatggatgttttactggggatattgtatatgcagcagttgtttaaacctgaaatagaaatgctaagagggaaaagtattcaagtccagtgtagcccaatgctgaaagataaaattgcagcttttgacattttaccaaattattgattgtgttctctggctggctttaaaaaacttaatgcagtgagtaggttaaaaaaaaaaaaaaaaaagaagaagaagaagaaaatggctgggaaagcataaaggcaaaacagttttaaaaaagtatgagaaagcttaaggcctaactcaaatgataagcagtagattttatggcaatggtgccagacagccggggtttgtatcttgactcttcctac

SEQ ID NO: 148981 - DNA, 264 bp, Homo sapiens
ctaaaattgaatgtggtgatggttgcaaaattctgaatatactaaagaccactgtacttcaagggataaattgtatggtgtgttttatattttaataattcagttatttaaataaaataattaaacccaacaagattgaaaagagagactaagactgattcctaataaactgaatgttatactaagtaagcgatagcatgctactgaaactttctgtgccacatatttttcatttgttaagtgcaccctaatgagatagggtgg

SEQ ID NO: 148982 - DNA, 495 bp, Homo sapiens
tacaaagctgagtgattcatcgttcctgacctccaggagcacaatctaatgaagaatatggaaaaggaaaaagaggaatttcctaagggctccaataaaggcacaagcagattgggggagcagagagcttggcttgaggatgattatgtaagggctggagctaaggcagagtttctcaaacttggcactactggccttttagcttggaccattcattgttgccctgtgtatcggaggatgttcagcagcatcctcggcctcaacccattagatatgtgcactccccctaaaaactgtcgccagacattggaaacgttccctgggggcaagattgctgcctttagagaagcactgagctaaggcctttgggacatgtttgtttatttactccataacattcttgaggaacttactgcaaacaagtggtgagaataacaagagggaaggacaaagtcctcacacgaaggacctcaaagtctggcgggaactagagtg

SEQ ID NO: 148983 - DNA, 430 bp, Homo sapiens
agaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaag

SEQ ID NO: 148984 - DNA, 345 bp, Homo sapiens
ctcgatctcctgacctcatgatctgcctgcctcagcctcccaaagtgctgggattacaggcatgatgagctaccgcacccggtcccccataagtactttaaataccagctgattttaacaatgagccctagagaaactgatgaaatgcatgtatacggtgtgtacataatttgagagggttcacaaatctccatcccattcatggaccccagcttaaaaaccagcaatatagtatttaaaatccaactgcattttttttttattttattttactactgttttttttctcttttgagtgggggtctcactctatcacccaggctggagtacaatgtcacaatctca

SEQ ID NO: 148985 - DNA, 345 bp, Homo sapiens
gtcattttcgcaaattactggaagatggcagttccagctgaaaagcgcagtcttaagagctctactgaaagcctttacagaacctgtcttaattacagaacccacttaatttttgccgagtgtttctcaaactttagtgtacatcagaatcatctagaaggcttgttgaaactcacatggctgggtccaggcctataaattcttattcagcaggtctagggtgggggcctaagaactgcatttctagtaagttcccaaatgatacttatgctgctggtccaggaattacactttgaaaaccactattctagcccaaactaaaaaacaaaacacaataccgtctgt

SEQ ID NO: 148986 - DNA, 178 bp, Homo sapiens
agaatacctatcagttactgaacatggaaccagctgcctcagacttgcagcttcattgatcaccagaaccaatttggttgagccctggaaaatgtaatggtccactgcactcccttactgttctgtgggggacttgttcaaagttgtgggcctagtataaaaggatcttcttttctgg

SEQ ID NO: 148987 - DNA, 551 bp, Homo sapiens
gttacccggcaagtttacagagagggaaggagagcagaatatttctgcccagaagttgcatcaagatgaccaagttgccatgaataaatcatcacagaattttgaactggaaaacagaaacaaaagcattgaaagctaaaatgctcgcgtaatcctttcttgattctgtgtatcacccttggagaagtctgcattgtctcttgctgtaggatgactgcatgggacacacttagtgactcttctgaagaagctttctggtctgctttccttttcccatggtttttaaagagaatctagctttcttgcccctgccttctgctaaaataaatgttaaaaaaaaactggaaaaattagtgacctacagttttccagggataagactcacctatggagaagcattattccgacgacgttttttgctgaacttgaagcattatttccagagaaaggacagactaactctccaaatcgttatccagcttgacagaaatcaatgaaatccactagtggaaattcacatttcacccaacaacgtgaaaaggcaaataaat

SEQ ID NO: 148988 - DNA, 211 bp, Homo sapiens
gtgtatctgcgatccttttgctactccacaaacagacaccttccacgttactatacagctcccgccgcagctctctggaaatgggcttcaaatgcatgaagttgcagaagccgcctcgtgtgcattctcccatctcatactgacggcagcaggctcccctgaagtccgtcacaggtgacagctcggcgtggatcggctgtccgttaaacca

SEQ ID NO: 148989 - DNA, 367 bp, Homo sapiens
tcaatgcttcaacctcctgttagtaagtggcagggccaggaggggagcctggggtgcctggtcccagcccccatgttcttcacagctacgtcacactggcttccatggcacatggcaagcactaatgcacaataaggatgataataagggggagggagcagcagagcacagagagctgcacaagtttagtgattaacttggattttgtcctaaatgagaagggaagcgagcaggaagtgatagggttagagctctatttctaagacatcggatcacaggaagaccagttgctggggcagggatgctggtactggaccagggttgttatgatgcaggtggcaaagaaagttgggttcagggtctgatc

SEQ ID NO: 148990 - DNA, 166 bp, Homo sapiens
cagtcatgaccccccttcactgtgatgaaagaggctccgagcaatgaagtcactgtccaagttcacagaggcagttggtgatagaggaagacttgagttctgagcgagtgtcattcggattgagccgttactaggtgccagttgtatacatgaagcaggaattact

SEQ ID NO: 148991 - DNA, 414 bp, Homo sapiens
ctgttctttcttttattcattaattaacaccaaagcattgatggagcaatagtgtatcagggactgggctaggtatggaaaaaagtgggtgaataaggcaggaaggatccatttctcaaagggcttaggattcgctggaagcattaagtttcaggacaaatgccatactctccacaaaataacccgttcctgataccctcagcaggaagtgaggactttctcttctcaacagccatagtacagtgaggaaacgtcgattacaggatttaccataatctgatttaattacagttattgaggcatatgtcttatctctcatgctataagctccatttttgatagggactctaagaagctccctatttagtcctcacagcatgtagtgcaggatttctcatttaataagacctcaat

SEQ ID NO: 148992 - DNA, 367 bp, Homo sapiens
aggtgctgtcatctatatgatctcagtattttaaaaatcagcttccagcccatatggtggctcatgcttgtaataccagcagttgaagaggctgaaatgagaggattctttgcacccaggagttcaagagcaacctgggcaacgcagcaagacccagtctctatcaaaagttaaaaaaaaaaggtcggcatggtgatgtgcacctgttgtcctagctatttgggaggccaaggtggaaggattgcttgagcttgggaggttgaggctgcagtgagcagtgattgcaccactgcactccagcctgggcaacaaagcaagaccctatctcaaaaaatatatataataaaaataaaaatcagctctcatt

SEQ ID NO: 148993 - DNA, 126 bp, Homo sapiens
tcccaaaatacactcattggaagaacactctgtttttgaaatgttaatagttgtcatggggaaaacagaagagaaggaagaacacttctggtctatatcaggattatgctgaagtaaaagtaggag

SEQ ID NO: 148994 - DNA, 291 bp, Homo sapiens
gtgtgagggtggggttgagggaggctattccattatctcttcttaatattctaggcttttttcaacgattacacttgcatgcatttcatttaatgcaaaataaataatacctctccttcctcatggactttttttttccatcttagaaagctcttgtttctggttgccatagtaatggtgccactctgatatttgtttaagtggaacactttcatctgactgacttaaagacagatactagaagggccagaaataataattgacaacattgcctgctagctggaataaaag

SEQ ID NO: 148995 - DNA, 128 bp, Homo sapiens
tcttatcacttccccctcctaaatatacctcgatgctccagttctctccatcccctagttcatcatccaggccaccagcctctcacattctgccagtcttgctccctccaaggttctcaccactctgt

SEQ ID NO: 148996 - DNA, 381 bp, Homo sapiens
ctctggatgcaagtgtcacatctctcctgtaaactcacttctctcctgttcctcttacctttctggtcactccctttctgtggacgatttccttcaggagatcctctttctctgcttctgacaccactctcctgttggagttccccagagtttttgtctcaatatacatacactcctaaagccagctccttctcccctcctatggctgtggtttgataagctgatgactctctcaccctctcacctatcactctcctaagtttcatgttcattacaaccaactacctcctggacatctctacctagcatccctcagaagcctcgaccgcaatgtaacctaaattaaactcagtatcttctcgtggaccatcactgccacca

SEQ ID NO: 148997 - DNA, 714 bp, Homo sapiens
gctcctacccgacggggtggcgggcgcctgtaatcccagctattcaggaggctgaggcaggagaatcgcgttgaacccaggaggtgaaggttatagttagccaagatggcaccactgcactccagcctgagcaacaagagcaaaactccatctcaaacaaacaaatacttgataggtgctattggcctcaacctgcccacagggaaggagcatacatacccaggcttggcccctaaatataacaggtggtgatggggctgcccaggacccccacttccctcctccacatctcagggtcattgactctgcttggcctagataacagaagcagccaaaagctggcgagtgagaagcctagaggaatgccagagaaagcaagcctgccttgcctccaccatgaattaactcccacatgaacccacccctgaagccagactggtcactttacccagcactgtgtgtatgtgagtgtgggctgcctcacttttcctggcactgttcctcagccatatgtattatctcatttaatccttatgttaatgtcagagattatgtgacttccctgagatctcacaaccagcaaatgaaagatccagaccatgagccattccttttccttttagattctgtcatcctcccacctctcccatccagttcctttcacttctggaaacatccctgagtacccccaactcagtggtttcccctgtggtc

SEQ ID NO: 148998 - DNA, 794 bp, Homo sapiens
ggatcaatttaaaagaaaatgataacatagcaaactcctcttatatgcacataaggcattactaagtatctattttatggtgcttgacatgttacaattgcctttttttcttcttttttttttgagacggagtcttactgtattgcaccactgtactccaacctggatgacagagtgagactccagctcaaagaaaaaaaaagacattaagtctcatacagttatgaaatttcacaattccagaaagctttagtaatcaaaatatagatttaagacacttattcagtcatttcacttaattcatccatctattcatttattcattcattccatctttattgaatacctactatgtgcagtgcagttactccaatcttatccaacattggactactaattagtaagatttttgtaattctgtttttaaattattcctttacatgggacaaaattcaaaaggtatatatatacaatgaaaaggaaatcttgcacccagttccccaccactgcgcccagctcagtccacctctctttactgctaattttgtgtattggaacctgtactctatccattttgtttttaaattttctagacccggaaagcatggactggtaccaggtcacaaagatactatttgtgttgtcacaacttattctcttcctctaagatgttgggacagaatatgtgggatttctactcatcttcatctttctacctggaatatgatcttcacgaaacagacttttcttctgagatgaagaaactttgtcaaaagcagtctaattcagtccgg

SEQ ID NO: 148999 - DNA, 172 bp, Homo sapiens
cacacacacacacacacacacacacacacacacacattacagataagtatatatatggaaaaatatgtatacgcaaggaaaatactgctgttctaaatgtagtataatgattttaatatactacccaagaaatcttatgagactttaaaatcattttaagatttaataatag

SEQ ID NO: 149000 - DNA, 718 bp, Homo sapiens
gcactcagtggaaatgcaaaccccagcttcctggagcctggcactagctgtcactgctgtcccaacactggcatttgacgctactgagacgaggttgtcatcaaaatataaacgacatcattttatgtgcctattttgaaatacgagtctccccaaatgtaccagtcactgaaaacttcccgagctaaagctggcaggccacgtgaactgaaggctgaggccacatgaactgaaggctgcgcggccctgcgggagtggaggtgcggtccaagcccgcaggcagacacaccacgcctcgtcagggtctgtctcagggtggcattacacagggtattcggaaacgcctaagtcgcctgggagaaaacctgccgtgcattcctgggcctcttcacagacagaaggataattacacaggaagatggcaaacactagggttttgacatttgacaagacagactcttgggtccccaaggaatgagcgcacccgccccccaggctcacaggcagggcaggtattcacaacagccccacactgccaacatctgggcacccaccgacaacagcatggataaatgcctcgtgacggctcgtacgaaggagcagtactcagaagtacaggggagatgctcacagacagaagtgctaagtgaaaggagacagccacagcccagcacaggacaggcgagggtaacctgtggggaccaacgctggaatagaa

SEQ ID NO: 149001 - DNA, 614 bp, Homo sapiens
gcttacctattctttttatggctgcatagttctaaaggagataggaaaaaccaaagcataggaaaaatactttggtttttcctactctgacactctggagtacttcacgtttgggcaccaatacgtgtgtggggatttttcaccaccaataactaattctccagtggacaccagctgggtgtcctctaattcagttcagttctgacactttccacctggacacagcgtcagatcccacaggctaagggcttagttccacaagactgccccccttcagatgccagttgtaagccccaggttgtgatgtgtgattctgaccagctgggtataaagaggttgccatgacttcctctttgggtttgattaatttgcttgggacgtctttggggcggctcacagatctcagggaaacacctccacttactggtttattacaaaggaaacatgaagaggcagatggaagaagtgcatagggcaagacatggggagggggagaggggttcagagcttccctgccctccctaggtgcacctctatccaggtcccatacctctgtgtgttcagctatccagaagctctccaaagctagtccttttgggttcttttgcaggttt

SEQ ID NO: 149002 - DNA, 369 bp, Homo sapiens
catctgcctcttcatgtttcctttgtaataaaccagtaagtggaggtgtttccctgagatctgtgagccgccccaaagacgtcccaagcaaattaatcaaacccaaagaggaagtcatggcaacctctttatacccagctggtcagaatcacagatctcagggaaacacctccacttactggtttattacaaaggaaacatgaagaggcagatggaagaagtgcatagggcaagacatggggagggggagaggggttcagagcttccctgccctccctaggtgcacctctatccaggtcccatacctctgtgtgttcagctatccagaagctctccaaagctagtccttttgggttcttttgcaggttt

SEQ ID NO: 149003 - DNA, 525 bp, Homo sapiens
gaagtgtacagggttggggtgggtgggaaggtgaggaggaaaggccactgtttcaggtggggttggagggagatggaaaatggaccacagaggttcagagaacaggccctttgtggaaagggggagaccaaataatgctgcgttgtgaaaggtgaaacaggctgcaaacagaaggagcccacaggaagccctgctctgagcagctgaacattctggggtcctcagactccgataaaaaagcacatttagcctacagctttatgcccttcctcctacccttgtggactctgccacagacatgccctccagattgattctatccacttgtctctagtctactgctactattttagtctaaggccttctccccgctttcctgggttatggtcacagactcctatctgagttcccagcaccaggtgcccagttgttttcatctcttaacacattccacatattatagcaagagagatctttctcaaatgcaaatcagaccttgttgcatcccaatctcaacccctttag

SEQ ID NO: 149004 - DNA, 104 bp, Homo sapiens
gggtgtggaattgaagttgacttatcttggttttagttctaagaccctaaggtaggaagatctgaattatactggagagaagggcagcatggaaattttatgga

SEQ ID NO: 149005 - DNA, 196 bp, Homo sapiens
aagtgattgtatatgtattcacacgtacatttgaaaagaaactacacttgtactctttaatgattatcctaaaagaatgcttagtaccctctcttaggcatttgttaaagtaaattttgttcagattccttggaacccaaggaaaagaaggctatagttggtcaaatgatctgaatccaaagctctcatttttttg

SEQ ID NO: 149006 - DNA, 397 bp, Homo sapiens
ccaccttggcctctcaagtagctggaaccacagacacacaccacaaaaaccagctaattttttgaattttttttggagagatggagtctccccgtgtttcccaggctgatgggaaactcctgggctcaagcgaccttccttccttgacctcccaaagttctgagattacagatgtgaactgctgtgccagcctttatcctttctttttgagatggagttttgctcttgttgcccaggctggaatgcagtggtgccatcttggctcactgcaacctccacctcctgggttcaagtgattctcctgccttagcctctcgagtaactgggattataggcacgtgccaccacacccggctaatttttgtatttttagtagagacagggttttgccatgttg

SEQ ID NO: 149007 - DNA, 533 bp, Homo sapiens
ctgggatggttattatattagtccattttcacaccactataaagaaatgcctgagactgagacatatataaaggaaagaggtttaattgacttatagttctgcatggctcgggaggcctcaggaacttatagtcatggcagaagacgaaggggaagcaggcaccgtcttcacaggcagcaggaaggagagagaagtgtgagcgcaggaaaaagtgccacttttaaaaccatcagattttgtgagaattcactcactatcatgagaacagcatgggggacaccacccccatgatccaatcacctcccaacaggtgcctcccttgactcctggggattacaatttggattacaattcaagagagatttgggtggggacagagagctaaaccttatctgtagttctgcatcaactcaggctccttctgtctttctgccctgccagccttaacacatggattccagtctcaaggtagcctcatggtcccaatatggctgctacagcttcagtcatcacatgtgcattttaagcagaa

SEQ ID NO: 149008 - DNA, 313 bp, Homo sapiens
caaggtcacacagtgaggaagcagggaagctgggattggatgccaagtccttgggcttagctgagccgtatgctctctgagacattcttggtccctgtcctttagggagagatgacttcataagcagctgatgagatgcagagtgatggggctttgatggcggatgcacagagactcaaacaaggccccagggaaggggtgagcgtggtggctcccatgctttgggaggccaaggcagtaggattgcttcaatccagaagttctagaccagcctgggcaatatagcaagaccccatctctaccagaaaaaaaa

SEQ ID NO: 149009 - DNA, 574 bp, Homo sapiens
gatgccctgcaccgcgtcaggactctgcagagtccctaccagcaagaaagccctcaccagatgcacctgcctgtcttgaccttctagcctccaaagctgtggtaaataaatttctttatgaattacccagtctcaggtatttagttatagcaacagaaaacagcatgtgacaatgagttttgccaatcttcaggaaacagttactcttttgcaaattgttacaatgaatagagacatgaagggtaacaagtttatcaggattgtatgaatacattatcaaaactacataacgacagtaaagaaaaaactatgagacattctcagatatcaatgaaatggcaatgaaaaatcagtttatgatacaataaaacatatgtctatatatcttatgatgtttactcttatgtggtttgacattttaaagttttaatgtagtattctactttagtaggttaaaatctcaagaaaaaggctttcttaaaattaaacattcactcatgaatttctttaaaatgttgggcaaacaagcaatagaagggaactttcttaacctaataaaggacatttactaaaa

SEQ ID NO: 149010 - DNA, 502 bp, Homo sapiens
agttcgacggagactctcatagctatacaccatcactcagacagccaactcagagctcaagggatacccaccattccctcctcctccatcttaccaaaactcactcctcatttggtgagtgtcttgacaatccttccttctactgtcatcagtctggtcaacatcactgattacttcctgcttgtgaaatccaggaagcttatgtaactagatatctccatggcctttgtgaccactgacctttccttgaatatctcctgacatcctgtcttccctggattctgtaactccccaatctctctgtatttatttcacatctggcattctcctcgaatgaaagtacactccaacctcttctgaatgttcattgttttctccatctacacgttctcagaggcccttttcttcaaacccatgtgatttcacatggtctctaaaaactggtgactctcaaatctagatcctctccccaacctctgtatataatctagactcatacatc

SEQ ID NO: 149011 - DNA, 318 bp, Homo sapiens
ttattacaatcccgctgactagtcctgaaatcatacccactcagcttgaccccaagagccaagtatcatacaatagggaaatgttggcagagaaccatacagaatgagactctactgctgacctgtggtgcctaaaacattcacaaacgacagtagcaacccctttgtacattaatcaccactggaaaaaagcagtatctagagagttaagtttaaactatggttaggctagacactatacatttttacctttaaggaaacacactcactcaggcagttttaaaagtccagaggcttgcctgttgccccaccatcacc

SEQ ID NO: 149012 - DNA, 232 bp, Homo sapiens
tgcaatccagattcacacgcatcacaaacacttcaaacaaatttcagggaacagtatttccctctcttatctgtgatgtactctagtatttacttttcggtttaaatttttaatgctgtttcggacccacaaaagagatttatgacctactactaataggtcacaggacacattttgaagagcactcttctacagtaaaatataaaggttcctagtgacctataaagttata

SEQ ID NO: 149013 - DNA, 254 bp, Homo sapiens
tggaacttaaaatacaaattaaaattaaaagaaaaatccccattaaagtattcccgagaactattcatatttgaatgagttgtcttaggaaaataattttctatatacatacccaaaacaaaacaatattcataaaagactgacgatatacgtgatctacaattttacgagtaaaatttgtgaaaatcactatactacttacaacctaaaaaaagtcatgaaaatcatcctaagttcagagccagggggtaccg

SEQ ID NO: 149014 - DNA, 390 bp, Homo sapiens
aagctttgtcaagctaatactttaaggatcaacatcaaaattggaactttctctttctatagccacatccaattgaaagtatcttagacctcccagtggcttccctttcggggaggcctggctgtcagagcactggaaccatgcatccattttaaataacaggaaggtccccaacccatacacaacattagaaacggcattatttgctggcccctttgtgcgtggggctgtgaatcggtgctgctgcatcacatggtcaaaccaggcctcccccacacattcctgctttatggggtcatttcagcgcgctccaatcagccgcctcgtccacctgaccatctcttgattactgatctatctgctcttattttccctgggggaagggaggag

SEQ ID NO: 149015 - DNA, 345 bp, Homo sapiens
taattgttcaccaaacaccgcaatctacaaatattctgaacaaacaagcaggtggtaattaacagaggtagacactaatggctgagagccacttttagtcagcaaatttttctatgggccaacatataaaaatagtggtatttcacatgtaaacttgaattcatagattctcttaagaaaaagccacaccaaaaaaaaatggcacatttggccaatatttccccatgggaatcagcaaacaatgaagcctgggtggcagctgcctgcttcagatccaggggcacgggctcaccccaacagcactgccccactgtgtcagattgcggtgtttgaggatcctctaga

SEQ ID NO: 149016 - DNA, 317 bp, Homo sapiens
aaaacaaaatgtcagacaacaggcctctggtttggaaaaccacagctgtacctggatagtaccagtgctcagaggcaagatcaggggaaggggaaagggaggcatgggcccacactaacctctcaagacgcatgtccctcctacagggtcgccctcactcctctagcccaccccatgttctggatgcctggtagtgccatgaaagtcctggtttaacagcttttttcttggagtaacagctgcactgttttcctacagctgagaaaacactttttctcacagttaactttagccttcatcatccctcaaacttcagg

SEQ ID NO: 149017 - DNA, 379 bp, Homo sapiens
atgctgtttcacacttatctttggacttagggtattgggatgtgtcaaacagttgctcccttagtgtggaaacagacaagtaaacacagttgctacacaagttgcaggcatcatatgataaaggcaagcttagtgtgttgtggagggcatgatgggtgtgtctgttaagtgtccctgtttagagtctgtttacatacagagttgaatgtccttggcttctcatttcaatttaatatatattatattgccttggctgttaggcctttcttgcacttgtttgcctcccagccataagccagtttgaaggccatgatccatcaggtctagtgggttaatccatgtctgaccagtaagacctacctatcttgacagtcaccat

SEQ ID NO: 149018 - DNA, 339 bp, Homo sapiens
aaaaatataatacttgaaataataagctcaatgaaagagtcagatagtagaagagcttcaaatgaaccagaagaaaggaaaagaaattatccaggacatagcacagaaagacagaaaatatgaaagagacgttaaaaaagacatgaaataggccaggcacagtggcttaacctgtaatgccagccaaacttgggaggccaaagcgggcagactgcttgagctcaggagttcaagaccagcctgagcaagataatgaaactctgtctctacaaaaaaaacaccaaaattagccaggtgtggtggcgtgcacctgtagtcccagagacttggggtgctaag

SEQ ID NO: 149019 - DNA, 522 bp, Homo sapiens
aactcactgcaacctccacctcccgggttcaagtgattctcctgcctcagcttaccgagtagctgggattacaggcacctgccagcatgcccagctaattttgtatttttagtgaagacagggtttcactatgttggtcaggctggtctcgaactcctgacctcaggtgatccacccaccttggcctcccaaagtgctgggattacaggcgtgagcaagctttcctggccaaacacatgaatttaatgacacagtgaaaatgtttggaaactgtaaaatactgtacagttgtaccagctgactatgaacaggaaacagacacaaagctggactagaaagtgtatgttcattccttcactcagtaacgtttattgatgcttactatttgccaaacattgttttagaatctggacataagtggatgagaaagacatgggctttgtcttgtaaggaacttaagcgtgtacaacattaatttcagtgtgtgtgagagtagctgaagtatttaccaagtgtacagaa

SEQ ID NO: 149020 - DNA, 589 bp, Homo sapiens
aattcactttttaaaaattagatcagatgacaaggttatctatattgtctacataattttataattcatatatagcacatattttagacacagtaaacaacaacaagatggaaaataagagtggaaaagaaagtaacttgaagttacactttgtaagactgaatgcaaactaaatatttttctattatgtttatagacaacaggaaaccactgaaagctttgataagaatggaggacgatattaagaaattaatgttcttgaagaatgaatgtgatctcaaaaagcagaaacaaccccaaagtccatcaactgatgaataaaatgtggtaccctccatacaactgaatactattcagtcctaaaaagaatgaagttctcatgcatgctacaacacagaagaacactgaaaacatcgtgttacgtgaaagaagccaaacacaaaaggccatgtactgtatgactccatttataagaaatgtctaaaataggcaaatccatagagataggaagtagattagtggttgccaggagactgcgcaaagaggaaatgggaagtgactccttaatgagcatcagggttcttttgag

SEQ ID NO: 149021 - DNA, 504 bp, Homo sapiens
tccattttgtctcaactttaacttttaacagttctttataggcttttgaaacctactttggagaaggaaaaaaagtaggaataactgttcttcaaaaattttacaaaaacagtttgactcagcttcagttgttaaatttggggtatttttctatgttgaaacagtatttgaaaattctaacttatactggacagataaaatgataaaaaagacattctactcttcagaggattatcaaatgctgttgattatgctagtttctcttgaaataaactaattatgggtattttagatagtgatatatagtctgtagacttaatacataggccatatgctagtggcacataaccaacagagaaagaattccttgcattaatagaagcacaaaaaatatattacaacttccaaaataacttttttttttttttttgggaaaaagccgggccctgtggcccgggggggggtgcaagggcaaaatcagggctaagtcaggcctcgacctcg

SEQ ID NO: 149022 - DNA, 177 bp, Homo sapiens
tgacctcctggccatgaccagtcaggaggtctgaggctggccattcccagagggcacaaaaaccaggccagctcccccagccacctgcctcggttctgacctctggcccatgagtatgcagacaactccacgtttgtatttccagcccaggtttctcccctgagccccagattcaca

SEQ ID NO: 149023 - DNA, 553 bp, Homo sapiens
atgcacaggtttatttttgtgctctctgttctgttccattggtcaatgtgtcttgtttttatgccaataccatactgttttattactgtggctatgtacttttgtaatacagtttaaaatcagggtatgatgcctccagctttgttctttttgctcaagattacttttggtatttgggggctttttgtggttccatatgaattttagggtttttttctgtttctgtgaaaaatagaattggaatttatataggaattaaactgaatctgtggatcactttgggtagtatggacattttaacaatattaattttttaatccatgaacgtgagatctctctccattaatttgagtcttcaatttctttcaacaacatcttatagtttttgatgtacagatcttttacctcctcacattaacagaatgaaagataaaaatcatatggttctctcaacatgtgcagaaaaattcaatattctttcataattaaaaactcttaatagattatttgaccaaattcaacattctttcatgataacaactcataacaaatt

SEQ ID NO: 149024 - DNA, 365 bp, Homo sapiens
tctccgagatgcatacccaatacattcataccaggaggtctttccagaatgttcacagtaccacgttagagcaataccatgaacgtcacaagggcttgaagtttataaatagcgtagtttcatttttacgaaaaagcaagctgcgtgtttctaagtatggttgcatgtgatgaaactaaaaagataggagaatggtctccatgaacctcagaatagttacttctaggtgagaacacaattggataaaatagggaaggagcagataaatagattcagggttttggtactgttttgaagtcggatggtaggttcacaaatatttattttattatgctgttatactttataatgtatgcatctcggca

SEQ ID NO: 149025 - DNA, 208 bp, Homo sapiens
cctcacactaaagcctgaccaagtccaagctccagtttaagttccctctttcagaatgttcttctgctactccttgtgtgtctaaatactaaccactcttcacctctggctaaaatatctacccctccaagtagcctttctggatagcccttttcattcaacatcctttgatctcccctctgtatcaggcaatgttgctcagggttat

SEQ ID NO: 149026 - DNA, 372 bp, Homo sapiens
cttacttaaaaaatacatagggtaatagtgaccacatatattcctttatatgaaatatttaataaactaccaggaatgaggcgcaattttattgctaatttatagtggttttggtgtgtggggatgatcttggcaagaaaatcttgttatgctgcaaaagccaccaaattcaatgtctaatccttatcgtactaccatctagggcagtctccagagagcacaaaaccatcatagaagcattgtgggtgctatacatttgtaaatccttttcctacctatcaggctactaatagctgtggatgatgaaaatgtttgtatttgtaacaagtattaaatcttgttcccatttatgatgctggcatataaaaagat

SEQ ID NO: 149027 - DNA, 212 bp, Homo sapiens
ggacacaatgcagtccatagcagggagtaatcagcatatagatattatttaaagtcataggagttaaggaaaatgtatatataggaaagaggaggtagcctaatatggagcttaggcaccttgagcaagaggtcaagcagaggaggtggtgtctgtgagggagactggaaagaagcagaattgggggaagggggagaaaagagagaatgtgg

SEQ ID NO: 149028 - DNA, 339 bp, Homo sapiens
ttttctagaactctacaaagcaaattgctgcaagaaaggcagaggaaacataatatatacatatccaaaataaaatttgcggtgaaataaatgaaagcacattacagataaacttacctgatttaaaaaactaacctataaaaactcctgttgaagaacttgattgtctttagccaaattgacacattttgaagataaagcttccttctctgccgtaagatcatcaaactgcatgaataaaataatacagcttgataatgaagtaggctgagaataatctaatacaaaaccaatagcaaattttgaaatgcatttacttgcaataaaatgttatctgta

SEQ ID NO: 149029 - DNA, 374 bp, Homo sapiens
tttcagcaccatctgtaccaaaggaatggacctttgtagaagaaactgccaaagaataatctagaaaccactcatttcgagtcagtagaaaaaggtgcttagcaacaataaaacccatatatgtatctgtaactacaacacaataaaaatacaaaatgcaaataccctgggcccagaggtgtatgggccacagtagaaatagtaagacagtggaaactttaagtttagaaaacaaattattttggaccagtgtagagcagaaacatttaattagggcagtgaaccagtgtaacataattttaatgctaatgattaccaccaggcttcaaaaacaaaaaattaggctgggtgtggtggctcacacctgtaatccc

SEQ ID NO: 149030 - DNA, 364 bp, Homo sapiens
  misc_feature (352)..(352): n is a, c, g, or t
gagatcctgccccctcctttttacaaacttggaaatgcatgcagggcctgattcacatccaagctgggaaggcattacaggaccagggcaaagtgggattcttggttttatttattcattcattccaaacctgttgcagccaggcacggtgtccaagataatgttgcataagccatactacccagctccaaattccatctctacaacccactcaatacgggagagagtttaaagatctcactgatatcttgtcctgatcttcctcctctataacataagggtaataatgctgccttttccataatgattagtagaagcaatatctatacttaaaacagcgtcgtgcacatantaagaattactt

SEQ ID NO: 149031 - DNA, 488 bp, Homo sapiens
agactgtggggacgaggaagggagagagtctagagagacttgagatacaatcaacaatatttagtgagtggttgggtgtggaggtgaggaggagaaaagggtctaggatgattttcaagaatctggtttggatcaatagtcttcattcagagggaggagcagggatgttggtaaagagggtttttcctccatcctgaagaagtaggagagagataatgagtccaagttcatatctaatgactcagttggcattgaagctgtacagatgtttctagctttctgatgctcattggcctatacctagagtggagagaaggaaaattaaaggggaaaacaccagctgatttagctctgtatgtacactgtggaaagagacagaatcccatagcaacaatgcagttcttaggttgtttctggtcttaggtattgatgtcatccttgatcaccggggtcccacagtcttagcctgatccacagtcttccctgat

SEQ ID NO: 149032 - DNA, 172 bp, Homo sapiens
accacacacttgtcgatgcactcagccacagagaagtcactggtgttctaacaacctgcacattactgatccgtccccacgcatcagaaaacaacaaagctcagaacatggattactctgaatcaatactgttcaggatattatttggtcatgccaaagttgaccctgatta

SEQ ID NO: 149033 - DNA, 441 bp, Homo sapiens
tgaacccgggaggtggagctggcagtgagccgagatcgcaccactgcactctagcctgggtgacagagtgagacgccgtctcaaataaaaaagaaaaagaaaaaaaaaagccaatggcaggctctgaaaggcagcactgtggtctgagccgccgggcccctcatgatggcacactgtgtgcagactaaggccaaggcagggagtgacacactgatcccggggtgcatctctctgccaggcagctagtcatttgttccctgctgggaagtggcagtaggggctggggcactggccctcacagagttgctgagagtatggagggagataattacaggcatctgccacctgtttaatcttcacagcccagatgtagggctgtcttctgagtcttaagggttaaggggcttgcagctggttgtggatctgaggtgcccctcctga

SEQ ID NO: 149034 - DNA, 359 bp, Homo sapiens
tcaaccccttttaaataaaaaaattttcacagccactttgatattgacttaaactacatatgtattgttacttaagtatgtacaaacctaagaccagtaataaactccttattcttggagctttacacaactaaaagtagatctataaattaaatacaaacaagactatagaaatggtaaaattccagtttacaaccaaaagcaatggatgatgatgttgctttgctgaaactatattgcatcagtgtgaattttatagtgaccattaatgaagcatgtttttttgcatcgtagccatgggataactttttctacaactctttttatcagttgcctttcataaggaacaaatgtgtcat

SEQ ID NO: 149035 - DNA, 155 bp, Homo sapiens
gagaatacaaagttattctggataggagggataatgactaagcttgaagtatgttggactaaataactaatcaacttcagcactgtgctgactcaacagataaaaatcttgtcctgagattgttacatcctcaaatttctttttttttttttttc

SEQ ID NO: 149036 - DNA, 429 bp, Homo sapiens
aagccacaggttttggcctttattaatatatctattccagatctttgattcttttaaacatctgccctcccagtttcaaaagttgctttaaaaatcctactttgcttttctcttttctgccattttttccattcctgatggtatcaccccttcttatccacttgttcacttattattttctcagtcttcattcatgtgtgcatgtgtcttgccttctgtgcctacgtatgtgtctctacacttgcagaaggaagatcagagtataatatatgaagtaatgtaagggtgctatggtaccaagtaagaatatcataatgtcaaagtcactcattcaatcaccacaccaccaaacaatgagtttatttagctcattacattagtttcctagggactgccataaaaaataccacaaacttggtggcttaaaac

SEQ ID NO: 149037 - DNA, 417 bp, Homo sapiens
ctgcggcagctgttgctattgctgtgacttctgttagacattcctaatgttgccacaatgagctcatttgggaggcagggagagaaatgtgttcaaaaacttattttgaggttttgtcatacttctatctctctgggaatagactcccatccatgcctctgaggctttaacatatacattttctcacaccttctcaggacgatagccaaagtaagaaacagcccatcgtgcatatttgttaggcgtgtgtgtatatgtacagagttggtatcttggcttgattgcgaatgtagctgatttattcagacaagtgatggtgtgaccctccaaactggtggagcggctctgctaaaggctctctgcttcagggctgaggcggatcctgggacagagcctgaccctccttcccagtgttcc

SEQ ID NO: 149038 - DNA, 805 bp, Homo sapiens
ctagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccggcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctattctgaagggctgggtacccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccact

SEQ ID NO: 149039 - DNA, 778 bp, Homo sapiens
ccccagaactgcttaatctttcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgg

SEQ ID NO: 149040 - DNA, 388 bp, Homo sapiens
catgtggcgtaatggcaaaacgccttagtcctgttcaagtgggtatgtcgtaccccacttaaaacccaaaccagaaaccagaaacgttcactaagggacacacattctatttttacttagcaaggcttatttttccaagtttatccatagtaaaaataccttcttaatgaacgtgttcgaagttttctaaatgcctacctctcagaggcatgctcagttgcttgactttacccgtaacactgagcagcatgaggcaatgggccagggtcaggcctaagcagcagcattttccctccctccttctctggctactcctctgctcactgttcctcggttattctcacccagaaggctccacatgcagcaatgatcttttatctgtttttca

SEQ ID NO: 149041 - DNA, 355 bp, Homo sapiens
ctccacccgacggggtggggtttcaccatgttggccaggatggtcttgatctcctgatctcatgatctgcccaccttggcctcccaaagtgctgggattacaggtgtgagccactgcgcccgaccccaggggacaggtttagtcagattccagggtggtcctcatggaggggacgcacaggcaggagggcagggagagaaagcacagaaagcagacctgctaggagaggaccaggatagggaggggcagggacaaggacatgggacttctgggagcaggtggccgggggtcaacgtccaggaggatttcctgaaccagttagaggactatgacccccctttcacctatctatgca

SEQ ID NO: 149042 - DNA, 460 bp, Homo sapiens
tccgcctcccaggttcacgccattctcctgcctcagcttcctgagtagctgggattacaggcgcccaccaccacgcccggctaattttttgtatttttagtagagatggggtttcaccgtattagccgggatggtctcgatctcctgaccttgtgatccgcccaccctggcctcccaaagtgctgggattacaggtgtgagccaccatgcccggccctttcagtatctttctacgtgtaaacacacatacacacattattttgtataaatataagatcacaaatttgtaatatcatttcatatttagtgttcatgaagaaagactgacaagtaaacccagatagtagcttaatgctagctgattatatttatggtttgattattttttaaaatttctgaataaatatatttgtattgttttaggtatgcttacacttatccaacgaaatagccttcactg

SEQ ID NO: 149043 - DNA, 778 bp, Homo sapiens
aaaatatcttggcgctcatggttgaataagcaaggttcttacaaatctgtgtctgcaaatgagacaaagggcgacaggagcaccagatgctaccacacacaccggggctgttgcaactcacaaaaaaatcaaacaggccacgtttgggatgttactatcaaagagtggaattgttcagaagtcacggaaacaatacttatgttatacttttcaagaaggcagactggagccaccttgagaatgacatcaacatttggcgaaagggaaaccttaatgacgatgacttaaaaccgcatgatttcttcaggaccccttcgtttctggacagaggcccccagctcagtgctcaaacatgaggggcaacagcagcagccacaggttctgggacagctgcccccagcccattccctgcaccgtaaccaggtgaggcacaacactgctggctccatcttgcccacgggggaaggagctgacttccctctgcagcagcacacaggggtgccactgttcccctttctgagccctgcagagagcaagcaagcctggccccctgcagaagcacggtgagggatttttccatgatgagatgcagggtgcaggccagcacactcaagggagtcactcactggccagtttcctgagctgcaaagggcaagcacggagttttgctaagtgagcatgtgctgtttttagacacccatgttcaccggggaacttgtaatatttccaggcctcggctgcatggaggagcccaggcttgaatgcagagagaatggtc

SEQ ID NO: 149044 - DNA, 306 bp, Homo sapiens
cacttcatagctttttgcatgtccctacctgcacatttgaacatctgaagacccctaaaagaacagtgtactgagcatgccttatatgaaaaaccttttagggactacgaagtccccctgtttcctagaagaaggcaagtgcctcttttcccttgatggtgacctgaacagcactccatttgattgggatgtgatgaatcaggaagacttgtgggtaggcataagattgttctcttggattcccacaggggatcccctccatactctccgttatcttaaaatttgggttatctatattattgatca

SEQ ID NO: 149045 - DNA, 214 bp, Homo sapiens
caaaatattgggattacaggcgtgagccactgctcccggccttgcctgtcagttttctaggagctgagacagagaccaggcccaccaggtctctgcctgtggggcccttacctttccagtcagggagggaagaggaactaggaggaagaaaataaatccagccagactcagtggcttatgcttgtaatcccagcacttcgggaggctgagacat

SEQ ID NO: 149046 - DNA, 323 bp, Homo sapiens
cacaaacgtttgtctgagaataagaacattcaccccattcacttaatttctcatcatcagtcatgtcattatattttcaaggacctcacagtgctggaaagtggtgtagttataaataagcataaaaacagatgggtgatcccagtcctctaaatataatcggggatgccaaatcttttcaaagagaattcatatatacaacttaaaggccaaggagcccaattcaatcaaaatttgagccaggatatgctaagttcaatcagcttgaatatgggcaaagtgtaagacctagccagcacttcagatatatacagagaaccaca

SEQ ID NO: 149047 - DNA, 485 bp, Homo sapiens
  misc_feature (1)..(1): n is a, c, g, or t
  misc_feature (8)..(8): n is a, c, g, or t
  misc_feature (10)..(10): n is a, c, g, or t
ntccggcngnagagctccaccgctgaggccaacgaggccagtcctttattttgggttaaatgaagttgtcaggtggtggttgttagggggaggatgctcattgaaaatgctgtgtaaatggcatgctttttacaagcagcaatggttcttttgtccaacctgccaccactggcaggggaccgccctgtatgtaagtccttttaataaatcctatgtctctttggctggctccatgtctcttcttcagcctctcgaacatagtgtcatccctactgaagtcaatagggattcagcacaacagcaaatcagactgatgttcgaagattggagtttgtggtaccaatgggctttcagtgccttttcaatccagttgctggattccactggcacgaggaattcatctgtggttgaagggaggggtggttttggagggagtatgcaaagatgagaaatggtttcccctcctgcagacctgagagatggat

SEQ ID NO: 149048 - DNA, 172 bp, Homo sapiens
cgcatacaagcacgcataagcacgcaagcagacacactgatagtatcctagaaaacatgaatttgattgcaaggttattctcagtgtacctgggaaacatttttgccatctgcaagtcgggcaaggtattacaagagttggctgattttctgtggtttaacctgtcattgtt

SEQ ID NO: 149049 - DNA, 351 bp, Homo sapiens
aacagcctcggggagagcaggcaggctggccctgggaccctgggggggatcatggaagagcaaggtccaggcttccttgccggctctgccgcttctcggcttgtggctgtgttcagatgacttaggtgctcagcctcagtttcctcttgtgttcaataggcacagccacaaccaccttgcaggcctgtcttgaagcttcgaggagtctgaagtttgcatgtggcccagcagttggcacttagtcacaatagctgttgattggtttcagtgctgaatttctaattagggaaatcgtttcccctgggtttgctaggcttggtggcaaagtcagagccaagggttttacagacg

SEQ ID NO: 149050 - DNA, 462 bp, Homo sapiens
aagttgttctgggttggagtttttaaggggatcatggagagcaaggcaaggtggggggggggtgaaatcatcgggatgtggaaactgtattcttgggtgggtcagctcctaagggatccctcagaccagctgagtcagccattccctcagaatgcaggacctgaaggaatatctcataggaaaaacttaacgtttcatgatgttcaaggtgttatcaatagagcagttaaggggaactgtgatctagggtctatgtgattccaagacagtaggcagcaaacaactctgaggaaggggttggagcccaggctggcctcatgattagcgccgagtgtgctgcaagctgggtttattttcctttctcccctctctttcttccctgacgaattttatttaaaaaaagtttatagggatggtttcaacaccatgctgtgggcaagagaagagagataccttgttctc

SEQ ID NO: 149051 - DNA, 312 bp, Homo sapiens
agtaataactaattagaaaatgtaacagaaggctgggtgcagtggctcacggctgtaatcccagcactttgggaggccgaggtaggtagattgcttgagcccaggagttcaagaccagcctaagcaacatggcaaaaccccatctctataaaaaataaaaaaaaaataaaaaaaaaaatcagccgggcatggtggaccatgcctgtaatcccagctactcaggaagctgaggtgggacaaccacttgagcctgggcttatagaggctgcagcaagctaagaagccaagatcttgccattgtactccagcctg

SEQ ID NO: 149052 - DNA, 496 bp, Homo sapiens
tacaaatttagtcccgactgaaacgtgccaaatatgaccattcacgaaaagaaagagtaattaacacttttaaaagaactacgaaggattttacatagtgtaattcaacaatttcgtgtcacatctgctgcagagatcacaaacactgtcactatgccatctccttcctcgaacctccacaccgcctcctgcagctttattcttggcttttcaaaggtttaatccactcggggctgctaaaggaggaatcaaggaagcataatttgtgaactcaagctgagaaaagggcaggaatatggggttgagtcacgtcgttccgccattttctaagcggaggaggaagacatgttggaacaaaaacacaacaaaagagcagccatttcccaagccagctccaatagcaactcgaactgacactgccgggtcgcttcggcaccttcaaatccacttcactggacaaacctaagtacatcagaagtgccgccgtaaaaaaggc

SEQ ID NO: 149053 - DNA, 321 bp, Homo sapiens
aaacaaacaaacaaaaaaaacccaccttgaaagtgaggactttgctgtccacacagtgcccactccccctccccaggctgcccctatccacctctaaaaagaaattttctagctgtagccctccctaaggaccccatcagatcttatgggaataggataacttctcacttttcttcctattatgcttatttgcaatgttgcccaaaaatgattgtgtaagtattagtgacatagttgtgacaagaagccaagccaggaatgagggccatacccctagggactgtcttcctgggtccaaaggaaagaccaagtttgctgaaa

SEQ ID NO: 149054 - DNA, 425 bp, Homo sapiens
ctccaaactagatcctttccttactccatcaaaacacacttttccccttgtaaagagttctttcttgatctttttgccacttattaaacggtacaatgttttactttgcccagctgtgaccatttcctccttacccaatggtaccacagcttcccagatctgtggagtttaaaagtgaatgcaatcactttgaaactgtcttcttgaagttcattcataaggactcatatctaaccaaacataaaagctcacctctaccttcattttatttaacatttgacagtgttctttcccttctttttaatttcttcttgcctctgcttccaatagattgtttaaatttcctcttagtcccattttaatgactctactctcccttttactccttactgttatgctcttaaatctcatttcctcagaaaaaa

SEQ ID NO: 149055 - DNA, 561 bp, Homo sapiens
tctagaggctttattgttttatctttcatgtttacatctatgatctacctaacactgatttctcgatatgatttgtgataaaagtttcatttttttcccttatggagagttcagttctcccagtaccttttctgaaaaggccatcttttctctttgtcatgtgtcataaattaagtgactactgatgtgcagtttgtttgaagactgttccctccaatcagcctatttgtctatctttttggcaacactgcattgtcttaatcactgcagcttttataaagtctggatatttggtaggatatgtccttcagctttgtttttcttcaagaatgctttgattaaggcccggcgtggtggcttacgcctgtaatcccagcactttgggaggccgaggcgggtggatcatgaggtcaggagatcaagaccatcctgcccaacatggtgaaaccccatctctactaaaaatacaaaaattagctgggcgtggtggtgtgcgcctatagtcccaggtactcgggaggctgaggccgaagaatcgcttgaacctgggaggcagaggtt

SEQ ID NO: 149056 - DNA, 325 bp, Homo sapiens
gcagtcatcataagcccccattttagtccttttgggctgctgtaacagaacaccatagaccagaaaggcaaaacagcaggaatgtgtttctcacacttttggagctggaaagtttgagctggagatgggggagacagttgcctcctccccagctctctagtgagggccgcctctcagctccttctcactgtggcctcctccccagctctctagtgagggccgcctctcagctccttctcactgtggcctcctccccagctctctagtgagggccccctctcagctccttctcactgtggcctcctccccagctctctagtgaggg

SEQ ID NO: 149057 - DNA, 167 bp, Homo sapiens
aaatctatgtggataagcaaaaattacccaaaatctttattaaaaaataaagttggaggaaacacactacatgattttaagtcttactgtataaagctacagtaatcagatcagtgagctatctgcaaaaggacagaaatataaacacatgaaacagaaaaacagtc

SEQ ID NO: 149058 - DNA, 199 bp, Homo sapiens
ggcaggagcacattgcctcattaagtggtgtcaagttgagtttagctggcccatctgccacagaaggaagtcttgcattgggtagaatgtagggcaggtagggcaggatgtagtctttctggggatgttatgctatttctatacctggtagaccccatctaatttttattctgccttatgatcagatagtgtatctcgg

SEQ ID NO: 149059 - DNA, 396 bp, Homo sapiens
ctgcggcaaacaatacactgaccaaaaagctcaaaagaaaaggctgagtagttagatgtccataaggagttcattttttaaaaaattatttttatttttatttttttcagtcagtgtctccctctgtcatccagactggagtgcagtggtgcagtcttggctcactgcaatctctgcctcccaggtctcagtgtttctcctgcctcagcttcctgaatagctgggactacatgtgcacaccaccatgcctggctaattttttgtattttcagtagagatggggtttcaccatgttggacaggctggtctcaaactcctaatctcaagtgatccacctgcctctgccttccaaagtgctgggatcacaggggtgagccactgcacctggctagatgt

SEQ ID NO: 149060 - DNA, 824 bp, Homo sapiens
tcagaatgaaggctagggctccagcctggaccctgaagtaagctagaggttagaagctaaagaagaaagaaggagattgagtccttgatgaacgtgaagccaccgtactaatctggactgcctacctctgcactactctatgagagagaaagtatgtgcattatttaaaccagttgttttgattttctattaacaaagtcagaaacatctctgtaaaaagccagactgaatattttaagctctatgggtcatatggtctccagtgcaaacactcaactgtgctactgtagtgtgaaagcagccacagacaatgtataaaccaaggagcgtggtcactttccaatgaaagtttattcacaaatttgtgaataactttgttattacacctttgtggaaaggtagcagacagatctggcctgtggctgtagcttgccaatgtttgttctataatacgctgccaaacctaaccctaacctatatggataatattcttcaatccctctagttctaacccctgcccttcacctgctgtcttagatgctctcccaaaaggctaaaagtttggctttcagaacaccatgtagtttttcagacacttcacaacttcaaattctaaaactcaattaaaacttcttctttggaccccatgagagtcgtagagatgggaactagatgacatttgaatcaagcatttttcttggaggccaagggctgacatcagcagcaccagggaacccacatgatagccccccaggagtctagagagtgctggcttgaataagtggtcatcctttcaattaacattcgttgggccttatttatta

SEQ ID NO: 149061 - DNA, 490 bp, Homo sapiens
gcttgggaactacactgggacacagcagagcctcttggcagaaatcaggcagcccatggagcttcagctgcatgactctttgaattcacaaaaggatacctttaacagtacttctcaaaaaatgtatataaggcatgtctcaagtccctatatgtttctagggataaaaaaattcatttcaaactgatggcaacctccccattctattccccagctttctatccttcttcctgcttaatttttcttcttagcacttgcctctgtctgacatattgtatgtcttacttatttattcatttgacattttaattagacactagcagtattgttttctttgaatacatttaaaggtcctagatttatttctttttgatgctcatcttctaactcattccctcctatcaatctcagactgctgtaaataaatgattttttgccttttttttttttttttactattagttatcatatttatttttcttaaacaagc

SEQ ID NO: 149062 - DNA, 498 bp, Homo sapiens
agctcggattccaggaccagtcttaagaataaattgactgggcacagtggctcacgcctgtaatcttaacactttgggaacccaagacgggaagatcacttgaggtcagtttgagaccagcctggccaacatggtgaaaccctgtctctactaaaaaacaaaaacgttaggctgggtgtggtggctcacacctataatcccagcgctttgggaggccgaggtgggtggatcacttgaagtcaggagttcgaggccaacctggccaacatggcaaaaccttgtctctactaaaaatacaaaaattgcgcctgccaccatacccagctaatttttaaatttttttagagacggggctttgccacattgcccaggctggtctcgaactcttgggctcaaagaattcacctgcctcagtctctgaaagggttagggttacaattgtgagccactgcgtctggccggcaatatcttctataaatatcaaggccttcaatggaa

SEQ ID NO: 149063 - DNA, 191 bp, Homo sapiens
cttggcagatagaagttcagacttcacattgaaaggatccagggaggttatggaacatgtagaaggatgcagaggaagcttctcttagatgggaagtcatgcagtggccccagaggggctcctcagatgaaatgggcctcagctgggagtgctgggagaggggccagctccaggggaggactcgaaaatgt

SEQ ID NO: 149064 - DNA, 557 bp, Homo sapiens
cccattagctgttcttgagtatccctgtcatccaggactgcaacacagagtattaaaagtacgagccatgatccgagtagaccatctgtttatgagactagttaatttcacatcactttcttgagcgtaaaaacaacccccgggaatgacagaatatgcctctctcataatcataatcgtttttcattgcttgttaaaacgattctttaacttttaaagggactctattgatattaattaatcagctctcgtgctataaacatttcaagcactaaagtgcaagttattcttctctgccaggcatttctctacatcttttcttttacatatatcttgctagaagaggctagcacagcattagcagaagagcatagaaaggtctcttattcctaccattgtttaccagtagggttgcctgatggaagggcttataatcatggttgcaattttgtcatggcctcacgaaatggcatcattttcaaggatgtacatcaatgatagtgtgcatcttataaagataattattactaagaacatcactttaacctggatcatct

SEQ ID NO: 149065 - DNA, 203 bp, Homo sapiens
aaacttttctccccactatgacttactgactcccttattcatttaagaagcacctgtagtgcatctagtggatgccaagactgcagttgggagcagctgtaggaggaaatgtgttcctgtactcaggagcttagagtctggtagaatctagtcagcttcgggcattggcaaactcctgcctgggcctgcaagccaagagtaaa

SEQ ID NO: 149066 - DNA, 209 bp, Homo sapiens
ctaaaaccaactgttatgatgacacacaaaagtgcatattatatagttctagacaatagctagacctgggccgtaaatttgattctgagcttccagggacaaagccatagggaaatctgaacaatgatgaaatttactttccctttgataaaaataaaagagctcattttttttttttttttgagacagagtcttgctctgtcgcccag

SEQ ID NO: 149067 - DNA, 411 bp, Homo sapiens
tatagggcacagcacgagaagaacttccaaaagaaattttaagaaaaaaaacagcttttctcatattaagaacaaaaagcatgatactttaagtcagcaaatgatgctcatacttcggtttattttatgacaagttagggtcaaaagagaaaaggtgggaaatgaaaagtggaggagaaaaacaagaaacagtgaaataaaggaaaaaggcagcacttaaagtagagaagttcaaaggaggcaaaagagagcagaaacgttccatggtgaaagctgagctgtgttcttcacatttagcattctgttgagcagtggatagccaagaaattttcatgtattcaaagctctctgaaatttaaattagcagtcttgaaccagtcctgcttttattttttcgttggtttttttctg

SEQ ID NO: 149068 - DNA, 195 bp, Homo sapiens
tagagcccgcacctgctgccaattcccttggcctggggctaaagccaggacagagcatgatgggcagccgggatacccggatgggcacagggccattttctagcagtgggcacacagctgagaaggcctcctttggggccacgggaggaccaccagctcacctgctgacccccagcccactgagtggcccaggag

SEQ ID NO: 149069 - DNA, 434 bp, Homo sapiens
tgtttttgtatgtctgagaacatagaccacccagtattcagggtgaatgcctgtttttgctggagggtagaggaggttgggttgggagaaactagaggtcagtcacacaggtgctgcatgcttctatgactggccccagtaaaaactctggacaccaaggctctggcatgcttccctggtggggaagcatgtatcatcacacattgttgctgggagaattaagcacatccctgtgcaactccactgggaggggatccctagaatcctgtgcctgatttctcctggacttggctccatatgccttctccttttgctaatttttatttgtatcctttcactgtaataaaccataagtgtgagtatgaaagcattttttgtttgtttttgagatggagtctagctctgtcgcccaggctggagagtgcagtggtgcg

SEQ ID NO: 149070 - DNA, 285 bp, Homo sapiens
ctgttgctgaaatagaaacctacttatctctaggagggccacaggtattaagtcatcctttagtctcgtcttttctaggctagacgccaatgcctattttccatccttttaatatcagcctgactataacaactcttcaaacgggaaaccaaaatgggacataataaaagctgaccaaggcctggctgaagtcccagtgcttcctgccacgttcctgttaacacatcctaacatcattttcacattgataatagcatctcttagagagatcattcattcagtttt

SEQ ID NO: 149071 - DNA, 427 bp, Homo sapiens
tctcaaaaaataataataataaattaaataaagtacagagagaaaaaaattcatcaactagaattataaactacataacattatccctgcaaagaaataaagtagaagtaaaagactctctgacaaaccaaaattaagagaattagttgccagtagacatgccttgaaagaagcattaaaagaagttctctggagggaaggaaaagaatataggtcagaatttggatcaacacaaacaaaggagaagcatcaaagaaggagtaagtgaaggtaaataaaaacttttatttttcttattcttaaatgacctaagatgtagtttgttcaaaataataatagcaacaatatattcaattatgtatgcttatgtctgcttataccttagcaaaatgaatgacagcaatgatacaaggaacgagaggcaagg

SEQ ID NO: 149072 - DNA, 568 bp, Homo sapiens
ctcggcctcccaaagtgctgggattacaagcgtgagccactgtgcccagcctcacaaaaagttttttaaaagggaagataaaaccataaatgtaatgaaagaaaaagcaaataaatatttctcagcttggaataagaaagacattcctcggcacagtatgaaactgagaagccttgaagaaagaatgagataactgaatacacagaaaaataagaggtgtgtatggcaagagactatcataaagttaaagacaaaaatacaattccatgacaactgttggaaaaaccattcaaaatgtgtgctgtggcaatggcaggttagtaaactcatctttggactgaaagttaaatacagatgctcctcaagttatgatggggttacatcccaataaacccatcataagttgaaaaatagttaagtcaaagcaatgaatacacctaacctactaaaaacatcataggttagcctagcctaccttaaacgtgcccaggacactcacattagcctacacttgggcagaatcatccaacacaaagcctatgtcataataaagcactgagtgtctcat

SEQ ID NO: 149073 - DNA, 253 bp, Homo sapiens
gctcctggtcagcagcaaaggtttaatggatcgagattacggggaccaaagacgccgtgtaattaagccagttatttctctggctgggaacatctactcctcacagccgcaattgacttcgtcacttgtggttaccccgttcgcgttacctcgggcctaaacagcccatacgtcatctttttgagggagtctctcccttggaggcaaagttttaggagaaagatccctctgggagttgtagagtcggcgtggc

SEQ ID NO: 149074 - DNA, 252 bp, Homo sapiens
aagaggatcccgacgccatactcggatgatccccattataatattgaaatctctacagtggaggtgaggaacactgccacttctgttcctttaaatgtctgctacatctcagatgatcgttgggagtgattcatcttcatataattttagggctagaaggaacctcaatacgtcctagtctgtgcttaaattcccccattgcttcccttcttccacctgatgctccagcctctactcaaacacttgtagtcc

SEQ ID NO: 149075 - DNA, 375 bp, Homo sapiens
tatggtggcgcatgactgtagtctcagctacttggtaggctgaggtaaaaggatcacctgagcccgggaagtagaggcacagtgagccatcattgtgtgccactggactctagcatagggaaggggactgagaccgtctcaaaaaaattaaatagaaagtcttctttttttaaaattctgcaattcatgagaaactgcactcacacatagtgtgtgacattagatatctgataacacgttccttaatacaaaaacctcagaagttaccatgattatccaaaactactggtaccctgcccaggaccttttaggcaaagtccttgctatctcctaagctttgaaacctaggaaaggtaaatatacccaatataacga

SEQ ID NO: 149076 - DNA, 328 bp, Homo sapiens
tgcactgaagaacgcccctctttaactgtatcccttgcacttctgaggaccacccctgttcactccctgaagtcagaaataaaacacagaaattaaacagcaatagaagccaccactgacttgttaagatcccataatggccatgattgctaccttagagttagagtctttaccaaggatagaccaggatacaaataatataggaaatcagctaatttttttcatcattttcttttgggcgtagagaccagatgtgatatgaaaacagaaatacatatcaaggaaagctgacagtttgcggtttcaccacctatctgtgccccatggc

SEQ ID NO: 149077 - DNA, 677 bp, Homo sapiens
gatgtagcaatgactaaaatacaaagttcctgtccccatggaacttagactcttaacgggggaaggcaatcagatatataacctggagtgaggataagtaatctgtgaagaaaaacagggaagacagagtggtagatagtgctacttgacatgaccaggttggtcctccttgataaggttccattttattagagactttaatggagcaaggaagagaactatgtgaatatctaggggaagcacataccagacatgaggaataaactacaaaggccctttggtagagcatccttagtctgtttccaaaaaagcatagtatagaggcctatatggctggaacaaagtggaccaaggtggggagagtagtggattaggtcaaagacagctggagcaagattgtgtagattagccaaacaactctgaagacaaggaaattttagatttctttgggccaggaggaggtaatcttcagcgccagacagatgcagtgcttgcggccagctttcaaaaaggttgaaactgggaggggcatgtctgatcactagtactacttggacaggccaatgtgaagaagcttgtggatatggtaaatgaatactcatttatgctcacctaatgtaccttcgtatgctgcagaggctggaaaactaaaaacttcatgtcttagatttccttga

SEQ ID NO: 149078 - DNA, 757 bp, Homo sapiens
aagaattggagctattcctattaatacagtaagttgataatgttaggatgaaaaccatctttgaatgttagttgatttaagaaggaaaatatagtcataaaggtttctaatcatttataacttgaaaaaaagtacaaataatatgatgagaacttgaatccacagtaatatggggctttggaattttgtccttgacacttgtaaatttaggtggagaaatgagggttatgataacccccaggtcccaaggtcctgagtgcctaatatcagaatatttcaaaggtttaataattatcatgaaggttgagactgagatacaagggttgtgataatttcaaggtacagtcagttctgttttaatgcttgtcttgaaagcgtgagtttattccaacataaagaataatctgtacataacaggaactttgtgtttgcttaggtataatttcacctgagagaaatgctagatgaggagaaaactgttgagcagagcagcataggagagagcatacatgtgtgcaattctcaaatatctaccagcgatcttggctcatgtttgagttataaaccacactcaaccacatctgctgttataactttccacccaattttaaaaacccctcttccatcacttgataataattcacaagctaaaccctgccaatacccacttccacaagcaaactgcaggtctttttaaagacaacgtaccatgtttattgtactgtttatgtatattttaaccacctaaaatgtataa

SEQ ID NO: 149079 - DNA, 384 bp, Homo sapiens
aatttttgtcattttagtagagacagggtttcaccatgttggccaggctggtctcaaactcttgacctcaggtgatccacccgcctcggcctcccaaaatgctgggattaaaagtgtgagccaccgctcccagccgttattttcttttagcaaatgaatattgtcatccttaagggcctattggctacagccacttctgataccaaatggtgaaggttcagtacaagaaatagaagccagcagaaaaggaatttgatacaggcaaataggtagtaaaaatcattcggtacactgaaaaatgacctctatttgggcctccaggaaaatctctctgaacacccagaagtaactccataaaggagcgaccactcctgtaacagtcag

SEQ ID NO: 149080 - DNA, 499 bp, Homo sapiens
aaagaaatacgaaccacaataagagaaagccaacagaaccagcagataatttgcatcctgtgaacttggagatggcagtcttaatagacttggccgtaagtatgttaaaaatattcctagagagaaatactaagacaagaataaacagtatgaaaaagaaccaaataaaactctagagatcaaaaaaatacagtgattgaaagtaaggtcagagaatggattaagaaatagaccagatacagatgagaagagactcactattaacttttggagacgttaattgtagagtgcagaaagataaagaaatgtaacatcagaaagacaagttagagaaaatgatttaaagtgcatctccttagttaagattagtacaaaataggaacaggctttgattttagagattacctgacttgcttggtatgtggcaaagtaatgcgaaaatgctttgaaaaaaaaaaatccccagaataaaccgcacttgtgaactactgaacgtatc

SEQ ID NO: 149081 - DNA, 126 bp, Homo sapiens
gatgctatgttcttcctattgcattgcatcagaggacaggtaatttctggttttctcttttttgtgatatgattgattcaggtgttatatcaacctaatggacccattaaacagttccctatcact

SEQ ID NO: 149082 - DNA, 397 bp, Homo sapiens
gttctaggagtttggggaaaaccttttaggagttcactgagggatgggaaattcaggaaaggcttctcagaatcagttttatataagaagaggaaaaagaagatgtacacagggtgcttttgagaacaggagtagataagtttggctgaagtgaaagtttagtacaggcatgcctctgagatattgaaaggttcaattccacattactgcaacaaaccaagtcacatgatgtttttggtttcccagtacacaaaaaaattatgtttacactatactataggctattaagtgtgcaacagaatgtcttaaaaagcaatgtacatatcttaattaaaaacactttattgctaaaacaggctaatgatcacctaagcctacagcaggttgtaatctttgt

SEQ ID NO: 149083 - DNA, 659 bp, Homo sapiens
gttttgttttgttttttccctatctacttttagggcctagcactgagcaggcctagaaaatttgatttattatttgatggataactggagatcacctataagagcaaagcagaatatagtggaatgaggattaatgcttcatcgccccaaattttctagctagttttgttcccatcctcctccttcttccttagcaatagctcttagcagtagggctaacttctactgtaaggaaggaatatggttcatgaaaaggaaagtactttgacccacagtctctctccctgtcaggaagaaccatctgcttttttttcttccacccacccacacaatgtgctttggagccaggcttcttaaaacccccaactcagcattcttggttccttaacttagtttttcacatccctgaattctcagaaggtcttgaaaagatctagcccagtccaaggtcattttgataacaaattctgttcattctgtagatattggcgaccccttgtgcatctagctctgtgtgcccttatctcttgctctccaaggactcaccatctggaagggattgaaacatgtaaaccaggggctacaaattgatggcctaggggttttggcctagttcctttttgtatgttttgaaaaaacctaaattacaaagtatttga

SEQ ID NO: 149084 - DNA, 634 bp, Homo sapiens
caggagtcttcaagtgttcaaagcacaccttttaaatctaaacaggcaaagaaacaagttgcctccttcagtagtgaccattcactgcaacagctgtcagccacttccaaaactgcagcttttgccagtgacttgccagccatcacacatgaaaatgtcaagttctccaccacaatacaaagtaatacctcatactccaaaagccagagatccagaaactccgtgcaaaatagagcagagccacagacctgagagaagcctactcatgactcttagattccatgagaaagactgaagaccccaaaaaagggtgggcatggcccctttttccgtgtactcaaggggtctcaggagtgccagaagtctcctatgtgttcaagatggcaaaagggagaaggagcagaagtggaaggaaatggaagagttaagtattagaggggccagtttgggagattttaagctttctaaaaggccaatgaagttttacatttttctcaaccaaaataatgccaacaaggtaggaagcaaacagtggcctccaacatttttttaaaaggggtttcagtcgactgaaaaatattatcaggaataagatcgaaaagagaaaaagcagaagggccttttttagttctca

SEQ ID NO: 149085 - DNA, 805 bp, Homo sapiens
agataatttgactttctctctttctattgaatactgtttatttcttcctctggcctgattttcctggacaagttttccgaatgggagttgtaatgcgagtggtgagagagagcatacttttcttgtgccggttttcagggggaatgtttccagcttttgcacattcagtatgatattggctgtgggtttgttgtatatggctcttcttattttgaggtatgtttcttcagttcctagtttattgagaattttaaacgtgaaggaatgttgaattttattgggtgctttttctgcatctattgaggtaatcatgtggtttttttatttagttttctttatgtgatgagtcacatttgttgatttgcatatgttgaatcaaccttgcatcctggggacaaagccaattccattgtggtggatgcactttttaatgtgctgctgggtttggtttgccagtattttattgaggatgtttgcacagtgttcatcaaagacattggcatgatgtgttgttgttgtgttgtgttgttgtatctatgttaggttttggtatcaggatgatgctggcctgatagaatgagttagacagaacttctttgtcttcaattttttttggatagttttaggagaaaatgtactatctcctctttacctcaagtcaaattcagcttgcttggtaggctagttcttactgcctcaatttcagaacacattattgatctattcagggttcagtcttgtggagagtcttattttgcaaggaaattgtccatttcttctagattttctggtttatgagcataga

SEQ ID NO: 149086 - DNA, 515 bp, Homo sapiens
gtccccgtgctttgtcatggttgttctctgggggtggggagaggcaggcacttggctccctgaggtctgagctctgccaggagggagaccagccacacccctttctaaaaacagggcttccccataaaaccgtcctgcagtctgggatttatgggatggcatgttggatttgcggctcaggaatctacaagtagcaaccataaatctcacacccttgctcttgcttgtagggtgaggggaggggagctcattaaaagcctccgggaaggaggccccccatttctgcaagacaaaagagattcagccctgagtcacacctgctctccctaaggttcagtgaggagcaaggagccaccagcctgtgcctggggtggggaggacagtggggctgggagctggaggaagggtgaggccagaggcagctgactggagcaggaatgttgggcccagcagtgcaggcgatggggaccagctgttctccaaccgcaggacaagagcctgaaaggaagttgctg

SEQ ID NO: 149087 - DNA, 454 bp, Homo sapiens
gtccccgtgctttgtcatggttgttctctgggggtggggagaggcaggcacttggctccctgaggtctgagctctgccaggagggagaccagccacacccctttctaaaaacagggcttccccataaaaccgtcctgcagtctgggatttatgggatggcatgttggatttgcggctcaggaatctacaagtagcaaccataaatctcacacccttgctcttgcttgtagggtgaggggaggggagctcattaaaagcctccgggaaggaggccccccatttctgcaagatgatagaaatcctatgaggaactacagtggtggggagaggtgattctacatggtggtgacggggtcttcttcacagacacatctcttttggggcatcatcttgggacagggtctgtgtcagagacacatggggggggatcatccccctggggatcgcgggccgg

SEQ ID NO: 149088 - DNA, 316 bp, Homo sapiens
ccagacctacaggaggtataataagagagtgttcatggctgattttcttatgttcttttgggttcctcagggaacaggaacctggagagtagggctctgaggatgcgactttttccctcagggatcggtactgagatatggaagccgagctgtgggtgggggtgagccctgggtggcggagctgctggcgcttctttgttgcttggcctttctcgataacttttcatattcgcctttcttttctgtttctgttgacttctccctacccagacctccctcctcttttctacccaaatatctgtcccctcctctcatt

SEQ ID NO: 149089 - DNA, 346 bp, Homo sapiens
ttccaggtgacaggaaggaaataaggaagccaagcagtgtagtggtgagaagaagcacaggttcacccatgtgtgtggaccgctgcttcttcatacccaggaacccagccagtcctggagatgcacagatgagcaaaccatggccagacactcactcccatgttgcttagcgtctaacgaggaaagcagatatttaaacaaaattgcccacaggatataaaagtagtgccgtggtcagagccgcagtaaggaggtgaggcttctagatgcttataacatggtcagcttgggtcaggcagggacacagatatatgaacttttttatttttttttaaatttttttgag

SEQ ID NO: 149090 - DNA, 408 bp, Homo sapiens
attaggagggcaaacacagctgttcaggcagactacaactgttcaagatagaatttgggctgaattccatgctaagacatgcctagtctcaggataagggcaaatgtttaagaatttaattgtttctcatcagaaagaagttacctctttggagaactgtttcgtcctcctgtattaacacgaaacaacattctctacctcaaaaatactttatataagactttggtgttttcaaagtctctcaagtatcacttctcactgatctgcaatgcccttggcttgataagcaagctgataggtaactttttgttgccaggtgcccatacagaataccgtcatgcgttatttaatgacattctgagaaatgtgttaaacatcagagtgtttacacaaacctacatggtatgg

SEQ ID NO: 149091 - DNA, 414 bp, Homo sapiens
agcgattctcctgcctcagcttctcaagtagctgggattacaggcatgcaccaccatgcccagctaatttcgtatttttagtagagatgggtttctccatgttggtcaggctgctctggaactcccgaccccagctgatctgcctgcctcggcctcccaaagtcctgggattacaggcgtgagccaccgtgccctgcctctagtttatttatttttattccatgtgctcagtcttgcgagcacgtggtctgttttcttgggcctggccccctcagtgcactgtcttaataccctagcccccagtccctctgatcatatccccagacacccctactgaatcccaggtctctaccaagggaaaggcagggaggaggcattgaccaaggagaagagggggaagggacagggaaggtc

SEQ ID NO: 149092 - DNA, 349 bp, Homo sapiens
tttggctccttcctgaaactgtgaactccacaactgaagagtcagggctagcttcatgagcatgctactgtacagttaaacacggttccacattcagaagggccccatgcttggcttaatgctctgctattttcatcttgaaatccttaatacttttcacaatttcattttgcaaaccacatagtcagtcctgggttggggccatgtccatttctgttggatctccagcacatggtgtgtgctcaaggagcattgtgtaaaggaatgtttcagtgacaaaagatgatctcttttcatgagggcatgaagcataaaatctctaatacctaatatcgagtcaggatgtttc

SEQ ID NO: 149093 - DNA, 216 bp, Homo sapiens
caaaagtattacaaaccgaaaccatttgagtcttagcattatatatcattgttcaagatactggcacatactacatgttgccatgaatatcagctgcccctgtctccaacacacacatgcgtgcacacgcacacacacacacaccttgtaaaatactatcagatttagaataaacactgtaagatatttttaatctccctattctataattttaag

SEQ ID NO: 149094 - DNA, 137 bp, Homo sapiens
ggcagcctctaggagtggagtcattgtgcaggaggagactgtttcacccagcctgcagcccaggttggcaggtcagaagctgtacagacagtgggttggtgcagtcacctacacctggtaaatctcccagctctttt

SEQ ID NO: 149095 - DNA, 254 bp, Homo sapiens
gatggctggaactgtggcagccatttggggaccatgagggaataagatgccaagaaaagtgtaggaagatgggaagaacctgggtggatctatgcatccaggacttggaaaacttcctgtaaagggccatatggtaaatatttcaggtgttgcaagtcatatgcagtctctgtcataccttctttgtgttttgagtggtttttggtttattttacgatttttttttttttatggagtctcgcactgttgcccag

SEQ ID NO: 149096 - DNA, 287 bp, Homo sapiens
catgtggggtggggtgggagtaccattcaatctaatcattactgtttttaattttaaaatatagcttgttccaacaactatcttcaaaattacaactggtggtttataatatttcaggaaatgcatggtacagaacaaaccttggtagtaaaataaatgtggaaacagctgccatcgggtcactttaaagttttctcatttgcttattcattcacatatatttacaaagcacctgctgtgtcgcaggcactctgcttaggtgctggaggcagagtagtgcacagtac

SEQ ID NO: 149097 - DNA, 277 bp, Homo sapiens
atgctctcttggcttattctttccatatatactgtggttatgttctccagcagcacactaaggctatctgtgttatttttttttctagagagtttcttgaggaaagattaaaaagaaaatgatttaatgatatatcctttttcttcccactaaaatcatgttagctaaaaatcctgactttgtttttggtagaccaagctatctctatatattattagaacaattcagtctctaaccatgacttattttaaattaaaaaaatggataacctttgcaa

SEQ ID NO: 149098 - DNA, 247 bp, Homo sapiens
aaacacttagtatgtgcatagattttttttttcaagccagttggaataagtttacagtccacaggacactggctctgcattctctcaagtctttcccagtcttaatactatcatcttatgttcatttgaaagattttcagaaccagggtgaaaaggaaatcagtaagaaaggagtgaaaaaagaaaacgatggattcaagagaaaattcgaaggtaagaactcagcaagaaggtggctatagggagg

SEQ ID NO: 149099 - DNA, 349 bp, Homo sapiens
agccactcacacatcagctcctgcctacacgtgagccatactgacatctttcagctcacctcccaccttcagctgctgtgtctaggccttcgcagcgctgtgccttgtgcctgacacagtattcactatcttccccagcatctcaattccctctccattcttgctttagctggaaggtcccttctgacagcctgccgctaaaaagatgggtgttttaacttcctatggctgctgtaacaaatcactgcagccataggaaactaatgtgtggcttaaaacaacacaaatttggctgggcacagtggctcacgcctgtaatcccagcactttgggaggctgaggcaggcag

SEQ ID NO: 149100 - DNA, 333 bp, Homo sapiens
ccgggaagattattcccaagtaagtggcgatcctcgctgaggattcgatactggtgcccatggggttccgatgacaacctcgtgagacctgggtgcctactagcatactgtcgataaatatgaatgttttctagaaattggaaatttccagttaatgtgcacagtagaatgtgttagactatgtatggagctgaggacacaaattgacttgtgacatcctgggatattcacatgataatgaaaccagagtcttcaaagtggatgatgatttattgtgaacaaaacacagttaatcaaattcaattttaggttagggtgtgttaggctggcaga

SEQ ID NO: 149101 - DNA, 368 bp, Homo sapiens
gtcatccgggccatggtctgcagtccaggttctgccccctctcctgggcatgtggccccaggctggccctgaccagcttcctgtgagccccccatgtccatgcaggggacccttctgcaggcaggggctccagctgaacagaaggcagaatccccgtgagctggccaagaaagcatccactcaggagctcttcgtcatagcctccataaattctccagggaaacaagtcttcgccagctttggagagtcaggaggggaggaaaagagcgagcagggaagctccctctctaatagaaatgtgctcgtctgtgccttccgctgtccagttcacacactcccagacgtctctctggatcctcccagtcccc

SEQ ID NO: 149102 - DNA, 433 bp, Homo sapiens
ccctgagcccatttcctcacctgtcaaccaacaataacaatagtctttgtcacagaaagggcttaacaacaaagaggtgtcaatgaacatcagccacgactagagagtgggccatgggtcagggggacattcacccctcactcccaccccagggtactgtcaatcacttacagacatttttcttatttcctgtacttttttctcatacttttcctattcgataaacaggaagtatggaatcagtaagatgagtttcattcttttcagtagaccctttagtgccttaaaaaagtctgtagttaaagagcatcttcaagagaggtcctagaccatatggacacaaccaacatttgcagtcactattttggggggtctgaagggggcagaccagggcagctaatggcaagccccgtagaaggtgcagaaattttcc

SEQ ID NO: 149103 - DNA, 752 bp, Homo sapiens
aatatggtattatattgtacgtgctatttgtaacctgctttttttcagttaatgatttccatctttcatgtcaataaaatgttatcctttgtctatattcaaattgccccaattatagtgagatatatttgtagtatttttgtttttataaggggcatgtatgtgtgtttagtaggtgtgttcttaaatcacaatttttatgatggtaattatttataattagctctgagtataacacctaagataaacaaccagatagagtccaaagtggtgactttctaaaaattgtggggctttttacatttagtaatatctatttttagtatgttaagaacttatcagcttagtaatctgacctattactatttatcttcaaatcttaatttcatgtgttattttcttcaaaatatttcttatagcataataagcattctcaattttgagaatgggtctatttgtttcgtgtacctggtacatttcatttcttgcacacacagagagagcactgcttcattcctgaactcattactgaactacatgggttagcataagattgataaacatcagcagcaatagagaatgttttaaaatttctgtactattactggtatgtgtaattgggttgttggtgtgcacttacaaggtacagatatgaaactaatccagggaattgttatttatttctgaaagaagtgggaaatctcatagggatttcttcatttcaaagaagagcttttagagtcttaaaaaaa

SEQ ID NO: 149104 - DNA, 453 bp, Homo sapiens
agtgcagggctcctggccccctggatttgctcctagaatgtaatgtaaaatgtaagtagccacatttattagtctgtttctcaggaaaggtcagagaagtagtggaccccagggaagggacaggcttcggagaggaaattgggaggacaaatggaaagtcccttcacccacccacctctccagacacatcagtgggcagtgagacctctttgcctatacatccctgagtctctgcacctagcaccagctctgtgcctgtgaccaagccatagctccatccttgttcgctgagctgaactgagcctatcactgccttatagagtgtctgttttttataaatgactttatacgaaataccttctttgtatgtggatgctttgggcagtgtgtccagacatttcagaagaaaaaaaaatctaaaatgtcatctatttccctctttaccccgcagca

SEQ ID NO: 149105 - DNA, 488 bp, Homo sapiens
gtagtcagagggtggaggggaggcagagatggttaatgggtacaaaaatatagttagaataagatctagtatttgatagcataacaatgtagttacagtcaataataacttactatacattttaaaataacaaagagtataattggattgtctgtaacataaggaagggatacaggcttgaggtgatggacaccctatttactctaatatgattattagacattgtatgcctgtatcaaaaatatctcatgtaccccataagtatatatactacgtacccacaaaaattaaaaattaaaagtaaaaataaattttaaaaaattcattcataactaaacaaagataatatgagagtaactatcaagtatccaataagtgaacaaaatacactcttagttaaaactactacaaataatacaaccttccacagcggtcttgttctggcaggcaagctataaagactagagaagaacagagggaaaaaaaaa

SEQ ID NO: 149106 - DNA, 957 bp, Homo sapiens
gcatgcctctgtgtgtgtgtgtgtgtatgaatgtgtgtgtgtgtgtgtgtgtgtgtctccctcatgcacatgtgtttcctaacatgtgtgtttcccaacactgcaacaggcagtcatagtctgcagcctcctggcctgacaccacgccaacccaacagctgaagaccaaggccttcaatcagtaggatgtgaattttgacctggagaccatgcggacataggcccaaggtggctcgcctaccagtcaactcccctggtgtgagtacacactcctcctcacgggacatctgatgtcctgagcagacactgtctctagccgccctctcaggtgaggcgtacctggtggaaaaccaatcacaacctgtgctggagggcgcctttgcaatggccagcacatcagcctgaaacttggcgtcaaggccagaggtggtcttcccaatctagccaaaggacctcaagacacagccttcctcccctccactcagtccatgtgcctgcactatgccctctcgacacacaaacggaatggctgcttttccaatgggacgtcccccctaccgatgtcccaaggaccaggcggatgggatacactgcctttcattttccttgcattggacacacccacagggctatcctgtactgacctctgaggcaacatcccattatgcagccaacttgactgcactactacccgccgcaatgcctcaaagtcaacactacctgaacaccaccactgggtctacatgcatgcagctagtgagtgagctgcgagctcagaaccacccatcctttccaacattcctaagccatctgcatgcccttcaacatggcatggctgtcctggctgcgctgagacttcaaaccggttaagggagccaaaacagttcatcacccctagggtgtagtggactccaacacttaaatattgccaacatgcagaggtgtgaggcatcccaa

SEQ ID NO: 149107 - DNA, 773 bp, Homo sapiens
ctacaatggtcatagctgactcttgaggataaaactcctcccacctgaactgccatcagttcaactcccctggtgtgagtacacactcctcctcacgggacatctgatgtcctgagcagacactgtctctagccgccctctcaggtgaggcgtacctggtggaaaaccaatcacaacctgtgctggagggcgcctttgcaatggccagcacatcagcctgaaacttggcgtcaaggccagaggtggtcttcccaatctagccaaaggacctcaagacacagccttcctcccctccactcagtccatgtgcctgcactatgccctctcgacacacaaacggaatggctgcttttccaatgggacgtcccccctaccgatgtcccaaggaccaggcggatgggatacactgcctttcattttccttgcattggacacacccacagggctatcctgtactgacctctgaggcaacatcccattatgcagccaacttgactgcactactacccgccgcaatgcctcaaagtcaacactacctgaacaccaccactgggtctacatgcatgcagctagtgagtgagctgcgagctcagaaccacccatcctttccaacattcctaagccatctgcatgcccttcaacatggcatggctgtcctggctgcgctgagacttcaaaccggttaagggagccaaaacagttcatcacccctagggtgtagtggactccaacacttaaatattgccaacatgcagaggtgtgaggcatcccaa

SEQ ID NO: 149108 - DNA, 317 bp, Homo sapiens
tacagactgaagacactggggaaggagcatccgtgtgtgtgtgacagctgtgaaataatctgttctggaacaagaagctccaaaatatcacagcctgggatgactttgtgtgctttccatagagcatttggctacatatcaaagccgttattagtgggctgttccctggctcagggcaggtgtctgcctcagccatgtacataatggacataaggagctcaactcttctgtctcctgctgcctgatcccagatgaggaaaaggattatgaggaggtgccacatgatggtgaaatttgctttcttctcattgtaagtt

SEQ ID NO: 149109 - DNA, 335 bp, Homo sapiens
tactttttaacattttgaaaaaaggtctcttctttcttaccacatggcattgcttcttggaatttttctctccattgagtcagattgctgggttttcaattcttgtaaagataaaagttacctttcctcagttacagtgagctcatgaccagggggctcctgagagggcttttggtgaatttaccacaatccagagtgtgatcctgagatttgactccaagaccaccaagaatggattcatttgtcagagctgactcatgagtctggagcttcaagctagaatgccaatttattaacattctgttaatgaattaacagtgctgttatttctcagg

SEQ ID NO: 149110 - DNA, 388 bp, Homo sapiens
cgccattgcactccagcctgggcggcagagcgagactccgtctcggaaaggtttcaaaaaaaaaggaaaggtttctctgggcacggtgcaaggccgacaggagaagggcccctgtgcctgcgcagggcagaccagttaacacactgcaactgcccaggcaggaagcgagaggggcctgaactcaagggtgagcgcaggaggtggaaagtacatgcaccggggtgctactgagccagcaggatccacggggcggactggtggacgcgggcagccgggtccaggttgagcatgaccccgggctttcaactcgtgcgggcccgccccgagcgctctccggcttcttcccagccctctccttgccgcccctccccgatcttcccacccaacg

SEQ ID NO: 149111 - DNA, 496 bp, Homo sapiens
tttattcatttaactatagaaaaaagaaaagaattctaggtttcaacatgacccttttccaattctataaaccaggtcaccctaccaatgtctggcatttctggaatatttataaataaccatagtataaaaactctacctcccacatcctctgaaaacatagctggctacaaattccccaggaatattatgtgggacatgtggtttccatgcctttaaaaggggtatttgtaggctatcctgaggaatatttcagccaggtctttctcctgtctttttcagcctagcaaactttgccccttagtcctgctctgggaggccttaaaaaagtgatacatttgaaacaaatagatcccttatagaatcctcagtaggtggcaatggcagaaataaagatccaaaaattcaattcaattctgagcaggaatctggatgtagctggtattaacaagagtggtttttggaattcataaaaatatacgctggaatggaattg

SEQ ID NO: 149112 - DNA, 490 bp, Homo sapiens
acattaaaaaggcaactgaaaaatttcttgcaacaagtaacaaatgacgataatatccctaaacctatgggacacaacaaaagcagtactaagagggaatttatagttataagtgcctacatcaagagaggaaaaatcttaaattaacaatctaatgatgtatcttaaagaactagaaaagcaagagcaaaccaaatccaaaattagtaggagaaataaagatcagagaaaaaataaaactgaaatgaaaaaaatacaaaagatcaatgaaacaaaaagttgtttttttgaaaagttaaaacaaaatggacaaacctttaggtagacttagaaaatgagagagaagatccaaataaaatcagaaatgaaaaaggagacactacaactgatagtgcagaaattcaaaggatcagtaacagttactacgagcaactattaatatatgcctataaattggaaaatttagaatgagcaaatttctagatacata

SEQ ID NO: 149113 - DNA, 191 bp, Homo sapiens
tcttctataactttgcttacatttaatttaaattttacttacagtgttaccactttttttttttcctgcacatttacctttgctgaccaactcattttttttgctcatacttttgttgtaagctgtcaccaacttccatcactgggaaataaggagggacacaactacatgccttggtatttaagggtaaa

SEQ ID NO: 149114 - DNA, 363 bp, Homo sapiens
acaagatccttgtccacaaggagatggtaatccaatcctgaatccaacactggaatgattgaaaagagaactcttaaaagaactcaatccacaagagtcaagaagagggaaaggaagaaaaggagagaagaaaaaaacagattaatcccagtgagtggcaagggaaggactagggctggtaatttcaaggttcaatttcaacagacaaggtgaaaagaaaaagaattgcagacaaaggaagaaacatgaacgcagacctaaagagacatacttggcacatatgctggaaataacatatgcttgcaggcaactggcaccgcacctggctttggaaaggcacctgataagtaactgctatcgctg

SEQ ID NO: 149115 - DNA, 537 bp, Homo sapiens
aggatggtctcgatctcctgacctcgtgatccacctgcctcggcctcccaaagtgctgggattacaggcatgagccaccgcgcccggcccccacccacagatttgatgagagatccttgttcatctgcttcaccagcgtggtgtgagctatttgtttcacgctagacattggtggtcgaaatcatttaatctcatagtaaagggtgtaaatttactttgtactcacgtggaaaggtacacttcacagtttagtttgggggaaacgtgaagttaaatgttttaatactaactaggcttgttcactgaactgtgtaatgtgggtaaaatactttgtaaaggaccttatactcgactgtatgcctcccagtgtatttcccctaaagcagtgctcttattggtctaaatctgttcagacttgctttcattacttggtttgttaaaatttattatttaactcagtctctgaactgggtgtgagatcccttggtttccaaaacccttgccacctttaaagaatagaaatcggcccccaccaca

SEQ ID NO: 149116 - DNA, 457 bp, Homo sapiens
ggtcttttgtggttccatacgaactttagcattatttattctattatttgaaaaaagtcattggtattgtgataaggattgcattgagtttgtagatcactttgggtagaatggacattttaacaatattaattccttcaattcatgaacatgatacgtctttccatttctttgtgtcttcttaaatttcttttagtattgttttatacttttaaatatacaaatattttatctctttagctaaatttatttccaagtttttttaaatagttgttgtaagtgacattttttgcttgatttctttttcagatagtttgttgttagcatatagaaacacacctgatatttgcatgtttattttgtatcctgcaactttactgaatttgtttattctaacagtttttggtggaatttttagagttctgtctatataagatcatatatatttttcaaacaa

SEQ ID NO: 149117 - DNA, 404 bp, Homo sapiens
acaattaaaaaaggggcaagctacgtgatccctgaaatataaataaggaattatttgattccaccccgacccctagctattccttgtgttcacacacttctgggcctcccgggtagcctaagcccagaagcgggaaagcaagaaagccacgcaagcttgcaatccctggccaggttggaagcaggaaacatgagagctcacagaagctgcctggagattcgtctggggctgcagccctgttcccagttttggaggcctgttcaaattgaacttccaagccccgggccaaactctcccggtggtgtgctcctgccgacacgcgctctgtgtgtctggcaagctgtgtggtcagaagaatgtgcttcccacgcactgggctccaactatgcattagggctcagctt

SEQ ID NO: 149118 - DNA, 254 bp, Homo sapiens
ctggtcatttaacatttttagtagaataggtaacaaagatgaggggcagagaatggaggcagttggtaaaaaagggtggtgttaggatgaggtaaaagggttatgagaacttttggtcaggtacaaagatggaggaagagaaaaacatatcctcaaaaaaaaaaaaataacctcccacttgtcaccattaggtactgtttcatcaagactgaatcatgagtccagcccgagtccagcccacaatccatcttagt

SEQ ID NO: 149119 - DNA, 440 bp, Homo sapiens
taagtgaagaaaaagactcagatttaagtgatgcaacctgtccaggaaacctaaaaacactacataagggtttgggaaataagcatctttgataattttttaaagtagcttccttttataattttcctttgagaaattcataggaaaaagaggtattcagacagcagaattggacatcctaggtccccagccaaaaggctattaagccctcaaaaacttctcattaaggctctaagtagtgagattcagatggcatgacaaaaagtgaggggtatggggtaaggaatgaagaagaacatagtagagaaaattctgttggagagtggtctcaaatgtcatataaactaaacaaaattttttaaatccttagatcttatgtaatcaaattatacccaagatctcacaataaattgcagagaaggtgctagaatccaaatgtg

SEQ ID NO: 149120 - DNA, 303 bp, Homo sapiens
gaattgttttgccttttgtgataagaaaagttctgtgattcttgggtttaagtggaggactacaggacattgaacttggcgactttattttttggaccagatttgggatactgaaccctttactgccctaataaactcttaactctagaaaagagtaataagtcatgtcttacaagtatacctgtaggccattttagctacagttttaagaaatgttctcatattaatttatatgagacactggtatagtccgtagtcttcccattaagcaccattacctggatatgccaccttaatggaatt

SEQ ID NO: 149121 - DNA, 407 bp, Homo sapiens
tttttgcaataaaatttgtttagcctaagtgcaagccagatactcagaatgaggcagtttgactgataaagatactgaattttaaaaggacagctggaaaggctgggcgatcaatatgaccttgactactcacaagccaaataacttatggaaataatgtaaagaccctgtgaactttcttgcctgacagaagggttttaaataatattttaagaaaatcaaaagcaaacatcccctggaccttctttacagattagatctgaaatgaaagaccctgagttacacaattaactattgattttgctgatccatatttaattctcatagcaatcgcattgtgtttacacagccatgcagggcagacatacttctcttggagcaaagcacctttcacttctacattaatt

SEQ ID NO: 149122 - DNA, 185 bp, Homo sapiens
acatcattactattatggtggcattattaacagagttcttcctgtattagaagatcatgcatttccccaccttagggacttaactcatcaatttggtgaaagttctaaatcgtgacctgactagcctagactgaagcagcagagttactaatctctcctcataataagtgcagaatctcgaacca

SEQ ID NO: 149123 - DNA, 571 bp, Homo sapiens
tttgttctcatagcaatctaatgaggtagaattcattagacccattttacagggggagaaacatgaaggtcagaggagtaatgtgtcaaaggctgcaattccagaaagaggcaaatctgggattcaagtcctggtcccatttgatgttaatgtccaggcactcaaacatgaccctggcctgcctcaccagcgtgtatgaggaaggttcatgctttatcaggccatgaaagagattgagaaacacatatcagaaaggcaggaggagacacggaagagaggagtatggaggcaacaaaggagagatcttaagtaggaggaagtgcttttctgtattccaagctgcgaagatagaaggacaagaccaatgcaaaaactgattaatctttttcaagacaggcatttcagaagcataatggggggtgaaatgcgtgttcctagctcagtgctcctgacttggtggtagtggagtgacaaaaccattcatttatttattcccaatactgggagtcatggaacagccttcataaggtggcatccaagcagcacaatgtccctcctgttcctgagcatt

SEQ ID NO: 149124 - DNA, 131 bp, Homo sapiens
aagagatgtgatgagaccgtctacttataaacagttgctccagctactggatacagaacagacagtgatggaagcacgagatcagctaagaggctaataaaaagagagtggtgacttggatcggggtgtag

SEQ ID NO: 149125 - DNA, 388 bp, Homo sapiens
gagcaggaagctgccctagatttgggcagtaaccagtagaacttgatactgacgccagagcgtaaaaataaacacctcctacagttctgtcttaatccattggcatcagagttgctattattaacccataggcctcacaggcagctgtgatggtcagacaacagcctggacaaaacctatcctgccaacttgggatcacactctctccccttcacctactggaatatgatctggggccccaggagaagcaccatcagtctaggagcatgccctacaacaggtaacactggcggtggattagtatctttggttttggagagccttgaggctcccagggccagcctaccagcctagagtatgatggccacagacaggatgactgattcag

SEQ ID NO: 149126 - DNA, 518 bp, Homo sapiens
agatgaatcaaccagagtttaagcttcctcattatgtgtctgaatttggaaagaagtggacagaagacatcagaggaaaataaagaaaacccctcaagaattacaactcccatataatgctgtgagatctcaacaagtctaggagcttttttggatcctgaaatgaagttcatagatgatagagtacatctataattttaaagtcaacatgttgtcctagttgaatagaaaaaataaaagtaatatataataaactaatattttcaatgatatgtaactgtttgaccatgactacactagaagtagttaaatgatgctggcactcgtatatagaactcatgaatgtgagaactatatgtgcagattgatataggtgtgttattcggcaacgcaaatgctacgggttgtggtatttccatcagtgacataattttccaaacactgaacagtttttctgcaccaaagtacttgcatccctggaaaattgagcctgttaaaatcttgccaaagaaaaaaaa

SEQ ID NO: 149127 - DNA, 475 bp, Homo sapiens
aagatggcaagggggcgcatgtgtgatgtttcgggtgtgtggtttgctcatcatctgccccacagtgatagtttcatggaggcgggagctctctgaccttaggacttgtcagatgagcaaatgcggcttcctttctggtcagattccagacccagggagatgtgggtgacaagaaaagatgaccaatggctcagacataatgcacccacaccacagagggtgatggtaaaaaaacgcgtctctgccctgctgcctcgttgctatgaaaacccaacaatacccacttgggtttgcccacataatgcatacaaaatagctgttggggtcaagcacaccaattcggaagtgacagaaacaatactcctgtattgtgtgacctgatattgctcagtgatatgtatctcaacacccagtgccacctggtgaaatttcagtcaagaaaatgacacagttcctttcatacccccagctctct

SEQ ID NO: 149128 - DNA, 425 bp, Homo sapiens
acattttctccctgtgagcacgttgcaagggaaaccaaaccctcaccagcttgggcctgggatctgggtgtgtgactccttagtgtggcgttgttagcggtggcagcctccctggacaaggctcagatggctctgccaacattggccttggggtctgcttttctctttgccaccctcagattggcaggttctttatttggacatgttaatactttgtcattttcccagagagtgctcctgttcttgaaccatctggccccttcagtgcaactctgtaggactgtgctctgctccgtgggggttggtgtcactgtttaactgctggaggatgttcttaccacaatcgttttcacctgcatggtgggtgcccccctgccttcctctactgccttgaataggcttgtatcttgaaaagttcacgttct

SEQ ID NO: 149129 - DNA, 227 bp, Homo sapiens
gcagttacaacaatgctggttgtgaaataaaattatcaaaggatattctcctactttaaatttaagactgatccttggggtcttaagtacaggatgagtcactgggttcaacgtgtgggcacacatgtaggagagaagtgctggcatttctccaagtacagagatagtggctgctgtccagttatagtcaggtttccaagggcagccactatctctgtacttggaga

SEQ ID NO: 149130 - DNA, 196 bp, Homo sapiens
tggttgggggcaggtgtgtagaattgggtatcacacacacagaaggctaaattatccatcaccctcaccatggacaatttaggcttcattctatttagaatttttattaagccctttttatgattctgtctgaagacagggctgtgataagcatgagaaaatcttttgtcaaaattgctaactctgtatgttaaag

SEQ ID NO: 149131 - DNA, 151 bp, Homo sapiens
agaataagtccaatgaagttctgtggttaatgactggtttctctcacccaagctcagcagtcagagtcttcccctggaatgagaaggtaacatctcagcatgatcctcttctttctacagcatgggtctggctgatctctgtctctcgttg

SEQ ID NO: 149132 - DNA, 447 bp, Homo sapiens
ataagtaaatggcagggcacagggtggccatggggcagccacaggccccagaggccaggaggggagcccttggctaggtcctagatgtccccctggggtgctgctctggggtgagcctcataggcctataggtgggggataggctggtgggcatggtcacaatggggcctccaagtgaacaccatggtccagccagtgtcccagctgggtgacctgcaggctgggctgcccccacttaataagcccattttcctccctgaggtcaaagccatttgtttctgttcccattgttgagggagcagggccctcccctccctagccctgtgggtggggaggaggtctgtgggagaactcctggagtcggcctggcatgggcattgggaaacttggggcatcggcaggagcagcttcaaatgaggacgtcaacgaggcatcagtgcggggcag

SEQ ID NO: 149133 - DNA, 344 bp, Homo sapiens
cagcattccccgtgatcctggttttggaaaaattaaatggaacacttttgtccatttctgtacctagaaaatcagactgggaggaaacccacaaaacagtaccagtggctatctccggggaggtaggactacagacaacttatttttcctattgaattttttctataatttacacattttccatgaggaattatttaactaccagaagagttatttttaaaaagtctatcccctccgattagacacattgtgctaacagtctgtagaatcactgagacctgcaaatgttcccatcgcgttaagaaataaaagctaagaagtgatcaaatgcaaagcagggagaa

SEQ ID NO: 149134 - DNA, 311 bp, Homo sapiens
gaaatggggagaggaatcaattagacatgagaactattaggaacatggtaaacatctttaatgatagttgtagtcaggaagaataattaccattatgtcatttaaatagacaataaaatgatttttgtcaattttatgtactaataaactcaataatataaggttaaagagagatacactttatttcctccgtgagtacaagattataattttaatccactagtttgtctttctgtggttgtcaaaagtgcccacaaagaagacatacagatcacaaataaccacatgaaatgatgctcaacatctttagt

SEQ ID NO: 149135 - DNA, 798 bp, Homo sapiens
gtgatccgcctgcctcggcctcccaaagtgtggggattacaggcgtgagccactgcacctggcgtccatttcttaattcacatggatttcgaaaattactgagaggctaagaaactaaagttttccttgagaatgttcatataaattcaatgaactggtttatgttaattgttatcttactatgtatgagagaagtgtaatggaaagagcctgcagataatgctttttggacatttaatttagtcacatttatttcattgctgccattttattttgctttttcaaattttatttgtagagtaaaatgcaacaactgatgttttcttttttctgttttagatctttgctaattacacatttatgcttttgtaggaaaacattcatgggttctaattagcctttctgaacgttttcccttctttagtgagggtgaaaggttctatgtcttcttgccacccccagccccagtcatcatcatcatcagagtcttggtttgagtaggaggtgacttggtcttgagattctgttggctctcgacaaaattggcaaagacaagcatggcccaggttattttgctgagggaaagagatagaagggtgagtgagtgagtgtgtttgtgtgcgggtgcatgtgtgtaatttataaataggatcaattgcctactttaataagtatatagaaataaaatagtaaaacaaatatgcccaagtatgaactcttcagtgatgcttgtcttgtaccgtcgtctttttttctgaggttgttggtgataagtgatactgcagttagtgattattg

SEQ ID NO: 149136 - DNA, 471 bp, Homo sapiens
tggtgaccctccccagtgcctctcctggccctgaaggtgccactccagtgcccaccagcctttctgaacgttttcccttctttagtgagggtgaaaggttctatgtcttcttgccacccccagccccagtcatcatcatcatcagagtcttggtttgagtaggaggtgacttggtcttgagattctgttggctctcgacaaaattggcaaagacaagcatggcccaggttattttgctgagggaaagagatagaagggtgagtgagtgagtgtgtatggtcgggcttgaagggccttacatatttactgtgttatctcattatcctctaaacagactgatcagtactattatttttctttattctgcagatgagtaaactgagtaagtgggacacttgggaatcaaggtcaggcccctatggctccaaagcaaaacattcatatgatacataaagtgttagtctaaaggta

SEQ ID NO: 149137 - DNA, 475 bp, Homo sapiens
ctgggtgcgtgatgatacgtaccagcacagagccgcagcggctgtcaccttgcaagggacagtgtggggcttgccgatcttgttcccccagtagcctctgcgcacggggacgatggagagcttggccaggatgatggccccacggatggcggtggccacctccttggagcacttaacacccagaccgacgtggccattcaacgcctccgcggaggtgtgccatggccgacggtgtcctggcagggctggagaagggattgtctcatgtgtccttctgcaggcaccaggttgtccccctggtctctaacccccagccagctgtctagtccagtgtttcttttctggattcaggaagtaagtggggtgtgtgtgtgtgtgtgtggggtgtgtgtgtatgtggtgtgtgtggtatatgtgtgtggtgtgcatgtctgtgtgtggtgtgcatgtctggtgtgtgtgtgtgttgtgtgtg

SEQ ID NO: 149138 - DNA, 345 bp, Homo sapiens
gtgactctagaggctccccttataaccccacgatcacccactctatcaatgaggttttatatggcctcccatgaacaacgagaggtgtgccatggccgacggtgtcctggcagggctggagaagggattgtctcatgtgtccttctgcaggcaccaggttgtccccctggtctctaacccccagccagctgtctagtccagtgtttcttttctggattcaggaagtaagtggggtgtgtgtgtgtgtgtgtggggtgtgtgtgtatgtggtgtgtgtggtatatgtgtgtggtgtgcatgtctgtgtgtggtgtgcatgtctggtgtgtgtgtgtgttgtgtgtg

SEQ ID NO: 149139 - DNA, 184 bp, Homo sapiens
tgctgggattacaggtgtgagccaccgtgcccaaccacagagaatctttttaagcatgaaacttttgaatgttattgtagcctaatgcccctggaacagtagtaaaacagggccatcttatatgttgtttctgaataaactggcaaacaaatagaagaaaaggaagaggaggaagcagctgagg

SEQ ID NO: 149140 - DNA, 261 bp, Homo sapiens
ctcagttcctgagttccttctttgtgaaatgtggtcactggatagtatctactttctagtgacctggcatgtcagcctgaaaccttacaaactttcagtagaatgttagtatcactaattgaaactcttaacatgttttgacgccaagaataacagcagaaaatttttaaaaagtaattcagaggatgaattaaaagctcaaacatttcaggaatcctgtaatacatacattatgcttctttcaaggtagtagtaaatgag

SEQ ID NO: 149141 - DNA, 310 bp, Homo sapiens
ctgcccggctgagtttattgggttttaaatggtctgacaactgtatctgtggcttaaactgacaaaggtagatgaagccatggcaaggcaaaagactaggggaaagaaaactggacttttaaaacaagcactggctgggcgcggtggctcacacctgtaatcccagcactttggtgggctgaggtaggcggatcacttgaggtcaggagttcgagaccagcccggccaacacagtgaaaccccgtctctactaaaaatacaaaaattagctgggcttggtggcacacacctgtaatcccagctactcggg

SEQ ID NO: 149142 - DNA, 217 bp, Homo sapiens
tgcaatccaactacctatacaagtcagtattatgcaaaatagaccccacaggattgagaggggactaaagaagagagtctgttgggagcaggtctgaaaaacacagctgaacacacaccacaggtccaccatcgaccttgtgatcattacagggatggaacaagtcatcaagccaacaggtccccgggttattaaaatctagagaaagttggctggg

SEQ ID NO: 149143 - DNA, 448 bp, Homo sapiens
gaggagggtggatgtcgcaccaggggacatttggcaacgtttgcagattcttttgctggtcgcagcgtggggtgtatgctgtgggcatgtggtgggcagaggccagggatgctgctgagcctcctcccgtgctcagggcagcccctaaggcagaggctgcttgtggggcccaaatgtcagcagtgctgagctgaggatctctgtccaggaggcacagacgctgtcctggatgctgtccagacagcatctgctctgccctccagggggacagacagacagtggacacagcccagatgcagcctgatgagtgagcccaagggagtgcctgtcccctcgggactgtgagctccgtgggggcaggaactgggtctgtttgctcatgatccccagatgagtcccatagccagtctcatcaccatagctggtgttatttttgttctgagctctg

SEQ ID NO: 149144 - DNA, 423 bp, Homo sapiens
cagttgacatctgagtgggatgattgagtagagagaactgaaccttgagaccctctagtgtaaataggtcagaaactagcaacagagactgagaagagcagctagaccgagaagagaaaaccaggaaagtgtaatgtctgaaaaccaggtgaaaaatccatatcagggagtagaaaattgtgaaccatgtcaaataccactgatggggcaagggaatgcatggagatttcagtactgcatttagcaacagggaggtcacaggtgaccttgacaagagcagtttcaatggactagtgggggcaaaagtctgaccagagaagagaatcgggggagaagaatcagaggcagcaagtgtagacaagtcttccaaggagtttgccataaagaaggcaggaaatgggccagtagatgagtgagatgtgt

SEQ ID NO: 149145 - DNA, 179 bp, Homo sapiens
ccaggaatctatgccacagaaacctcagtagcttgaacagggctttatgtccgaggatgattataaaatttaacaattaggagcagctaaatgttgaaaaactagagaacagttaaataaattatggtgctgtcaccaggcgcagtggctcacacctgtaatcccatcactttgggagg

SEQ ID NO: 149146 - DNA, 623 bp, Homo sapiens
tgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctagg

SEQ ID NO: 149147 - DNA, 384 bp, Homo sapiens
tagaggatccccctcaacgctttatacttctcagtcagaattctgaagtcaacacgttgcctgaacctcaaactccaacacaaaaacccaagactagccaattctcttcaaatcaattcctgtaatcctcttcattccatgctttgtaaaaatgttatttgtgtagctggctgtcttcattatacaggaccttttaaaaatgtatttacttatttattttagagatagagtctcactctgtcacctagcctggctcaagcaatcctcctacctcagcctcctgagtagctaagactacaggcacacaccaccatgcctggctaatttttcaatttttactagacatggggtcttgctatgtttcccaggctggtcttgaacccc

SEQ ID NO: 149148 - DNA, 471 bp, Homo sapiens
tatcgagctcggtcccagttacaacagctccagttacaacagctccagttacacagctccatttacaacagctccagttacaacagttcatattggccaggctgatatcttggccaggctggtctcaaactcctgaccttgtgatccacccgccttgacctcccaaagtgttgatattacaggtgtgagccaccacgcctggcctattttaccttttattaagttgtaaagtctggtaaaagcccttatcataaaatattatatgcttttagatgtgggaagagggctaaatgttatctttataaagttagagatttaaaggctaagtgacctgtttattacattggaagacaggtctggacgtgggattagaattgtggagtgtccttcctgtggctggcctgagttcctttctcatgtaaggaaaaagcactgagaaaaagatgttatctggatctctgaggttattaa

SEQ ID NO: 149149 - DNA, 186 bp, Homo sapiens
agctcccatcacagtcccaggttcacaccatcacctatgggaccctcctgaggtgcacagccctgccatatgcggcctgagtgagcagctctttcctggggcacaaaaggccctcagccgtggtcactgcagcattctgcagtcagcgacacgtctgtccctccactacatttcaggtatacaggg

SEQ ID NO: 149150 - DNA, 383 bp, Homo sapiens
agcttatttttgtatttttagtagagatgggatttcaccatgttggccaggatggtctcgatctcctgacctcgtgatctgcccaccttggcctccccaagtgctgggattacaggcctgagccactgcgcctggctattatgttctttttcaaagttgttttggctcttctaggttctttttatccccatataaatttcaggatcagtacctcaatttttatttgtttttattttattttttttttgagatggagttttgctcgttacccaggctggagtacaatggtgcgatctcggctcactgtaacctccacctcccgtgttcaagtgattctcctgcctcaacctcctgagtagctgggattataggtatgcgccacc

SEQ ID NO: 149151 - DNA, 338 bp, Homo sapiens
attttgccttttgagcaaaaatattgatttattgaaaatacggcctaaaatatatgccaattatgctacttactataatagtttaacatacaacagcttgaaaatagtataattctttcttcacatgagccatgttatgatttccagtaatttgggacccactggtatgtgggattcattacaatgttcttcaaaattatttcatttattacatggactttgtttaaggaaacgaacagaaaaaaattaaatgtttgttttggagaagtttcatgctgttaacttcaaagcccctaagcctccagtggccctcttggatataagccacagatatgagc

SEQ ID NO: 149152 - DNA, 377 bp, Homo sapiens
cctggagtacaagtgtcaaatcagaatcatccttttcgcactgctttctctcttaatgaacagtaacctgatttatattgttctgcctggttaatgcatgcttcttctctgggctcctgtttacatcaaggtggaggggcactgctctacaagggtgtccatcttgggagggaaatgaagtagttcacctatatcatgatttaagttgtctgcaggaaaaatgttacgtggctctttagtccttcaagatgatcaggggacacagtattatagatctgatgtaaccttccccatttctgaaagacagttaacaaaattcagtccttcaaacgtatgtcacctactctgcaccagacactttgcatccagaggggtac

SEQ ID NO: 149153 - DNA, 409 bp, Homo sapiens
gatggatcttctccttccactgagaaacaggctcccacagatggcaggttttactgctggaccagagtcagttcttacgcctgagggctgggacttttagaactatggcaactctgggtatcttttcttactacttagctggacaaattgtttcctagcttttaaatgagggagagacaggttgatatagtataatgaacacccaacttggtttttttggtttagtttagttttgtttttttgagatggagtctcactctgtcacccagggtagagtccagtggcgcagtcttggcccgctgcaaactctgcctcccaggttcaaacgattcacctgtctcagcctcctgagtagctgggattacaggctcctgccactgcgcctggctaatttttgtatttttagtag

SEQ ID NO: 149154 - DNA, 267 bp, Homo sapiens
ccactgccttctgtcctctcctgggcaccacctggtaaggagttgccctccagtctctgcctcctcagggagctggcggtggcctcaccccaggcgttgctcacgccggccattcctgcacctgaaccccctctgcaccatgagccggccaggccacctgcctgtcactgccaggcgcccggtgcctgccccgccgcatctggagtccaccagaggcccgaggccccctgccgagtggaggagcacacactgggggggggtgtgcct

SEQ ID NO: 149155 - DNA, 390 bp, Homo sapiens
aaacaaataagatgatacctgagagtgccaaattatataggaatgaaatagtgttaatataattggaggagtaactcctgagattggatggtcagggaagctctctctgaagaaatgacaatgagctgagacctgaatgacaggagccagcttctaggggaagacagttccactgaataagaaataatttggtacaagatgaggttggagtggccacaggagtcctatagggctcggtagttcaagataagatgtttggaatttgtttaaaatttttttttctttttttctgaggcaggagaatggcttgaaccctggagccggagcttgcagtgagcccagattgcgccactgcactccagcctgggcgagagtgcaagactccgactc

SEQ ID NO: 149156 - DNA, 368 bp, Homo sapiens
ccaggtggaggaatggggttgactcaatggcaatccaaggctgacagctgtgctaatggatgacttaggcaagaaatacagtgattgactcatgaaatgaaaagcaggactggtctcacggacagctgggattcagacttcagaaagcctccatcaggacttagcttctttccagccctttgccctttctgctgtgttggccttagtcttgtgcttcacagtggcaggatggctttggcagctccatcctcatgtcctctcccctccacatcccacctctctgaagtctcagcaaaagtctcatgatttattggctttggtcaggtcaggtgtccattgctgaaaaccaattcccatggctggttctc

SEQ ID NO: 149157 - DNA, 140 bp, Homo sapiens
cacctttgctgtgtttctgggccaagggtcttgccttcatcttccttttccatccttttatccgggaggattgggagaaaatccttgttaagaaaaggtctcttggccgggtgtggtggctcacgcctgtaaacccagca

SEQ ID NO: 149158 - DNA, 182 bp, Homo sapiens
tttaccaagttgtgcaccatcactgcagtctagttttgagcatttccatcattttaggtgctttttattttttcttcttagtgattaacttttaacacaaaaaaattgttcaaactttgattcagtagttctagttgagtattattttctaagatgattgttggagatggaaacaaggattt

SEQ ID NO: 149159 - DNA, 354 bp, Homo sapiens
tggtgaaaggacacacagatcaatggaataaagaccagaaacagacccacgtacatatatgaccaactgattttcaagatagtagaaaggaaactgaatagagaaaagacagtcttttcaacaaacaatgttggaaaaactgactatccctaaaattaacaagaaatagaacataaattcaaatataaaatcaagaattatacaacttctagaagaagaaccctcagctaggcaaagacatcttatctacaacaacaaaaccatgatctagaaagaataatttgttaaatgggccctctccagaataaaaaatgtctcctcttcaaaacacactcttaaaagaatgaaaaaaca

SEQ ID NO: 149160 - DNA, 543 bp, Homo sapiens
aaagtgactaaggtgtgaagtaataagacagggaaactttcattgcatttgccctccccacactcttctatatcctgtggtccagaagaaacattaaatacacccttatacccaccaacaaacgaagaagtaaaaactgccattaagccaacttcttgaatttattttgtatgttgtaaaatccagatagctacatatagatgtgtactttttgaaaatgtatcccatcagccagtgatagttgtatttccatggagattattccagtcgcctgtatttgaacaattatacaggatctgactgtaattagaaaaaggagatgggcccaagtcaacctagtacaagtttggatttcacattttaaatcattggttaaataaaaacaaagtgaagatgaaaatgtttcttttgttaaaaaagataagaaaatataaaattggagcttttattaatttatacatgtctcagagaaataatagtcacagagaagtagcagacagtggcatgcacttattagcttctcacattattatattacactgg

SEQ ID NO: 149161 - DNA, 182 bp, Homo sapiens
ttgtcatttcatttttatttcactttggttttctttgtacgacccttcaagaagtcaagggtgctaagaaaattataattttttgagattgatacacatctagtgacagaaagggaaaggcttgtgtccagaattcttggaacagtgagcagaatattggcatctacctgagcatccacaga

SEQ ID NO: 149162 - DNA, 282 bp, Homo sapiens
gctctgtatgtctccagtggaatgaagaagggggtaggttgtaaggtatggatggaagatgacttatttttgttccttttggattttgtactccatgtataagttctgtattaaaaaaaaattccagcaccaattttaaaaacaaatattatgtcacagactcaacaataatctgtaccggccagattcaattcaggggttaccagtttgttcattgtgctctctgataccaatcagaatcacaacaggattttgttgtttttgtcaacatgaatctaaagt

SEQ ID NO: 149163 - DNA, 351 bp, Homo sapiens
atgtcacagctcaacagcagcaactgtgttttgccagggtcttgagatggggtcttgctatgttgctcaggctggtctcaaactcctggcctcaagtgatcctcctaccttggcctctcaagcagctgagatgtacaggcatgaaccactgtgcctggttaagaatgcaaataattatcctcctgtctgtatgaattgtccaaatatgatccaatgtggtgatgaatgtagagtggatggggaaaaaaggaatgaaatgtaagaaaactagatcagactttactagtagcattagcaatggcagaagttctctgagggcggagcatgaagaattatgaatcagaaatattt

SEQ ID NO: 149164 - DNA, 271 bp, Homo sapiens
ccatccaaaaaaatcttgtcatagtcatataaagacgcaaaatttcttatgcaaataagcttttgccaagttcttatctagaatctttgcttcatttcaaacactggtaacccacttatcgttagttctcaattatctaatgttgaaaatatgttctcaggtacacagttttccatcagcaacatgttaatgtgtaatattatttatgagttacattcagcataaaagatatttacaattgtcattgttaatctgctattatatctgagcc

SEQ ID NO: 149165 - DNA, 318 bp, Homo sapiens
cccggcccatggtagtggcatgaacagctcctttactggcagtggcatgaacatggcaacagctcctttaatggcagagatgttaaaatgtgaggaaaatgtacacctcagaaattatgatatgcagtatatagacataaccagcacaggactggcctcccgaagtgctgggattacaggcatgaacatggctcatctgtacaaaaactggaccacctactgagtgtgatgaaatgctgtctactttttagcttttctgtctctttcttttgttctcagggtaagtaaaccgactcagagtgcctgccattaaaggag

SEQ ID NO: 149166 - DNA, 430 bp, Homo sapiens
gacagagttttgctcttgttgtcctggctggagcgcaacggcgcgatctcggctcattgcaacctccacctcccaggttcaagtgattctcctacctcagcttcctgagtagctgggattacaggcatgcgccaccacgcctcgctaatgttgtacttttagtagagatggggtttctccatgttggtcaggctggtctaaagctcccgatctcaggtgatctgcccacctcggcctcccaaagtgctgggattacaggtgtgagtcaccgtgcccagccgacttgacatctttactatgttgaatcttcccatccatgaacatgatatttcagtccatttatttagctattttctgatttctttaatcaatattgtatagctttcagtatataaatgtgataaaagttttattaaacttacacctaagt

SEQ ID NO: 149167 - DNA, 302 bp, Homo sapiens
tgaaatgagtagccaaatgctacacatcttgtaaataagaagggtcttggtttctaagatccttctcactgagggctctcctaactacacagtcagatatacagtgaggcctacagtctatggaagagcctggacaacaggtgaaaaagaatgccctccccacaaccctccatcaccacaattctgtacagcctatagaattaaaaaacaatatcaggtaatgcttcaaacttgataactttcaaattacttaaaagtcacacaaattattaatatttatatttaatgttaaaattatgttc

SEQ ID NO: 149168 - DNA, 453 bp, Homo sapiens
tattagtgggaaaatgttattttatagagatgcatactgaagtatttaatggtggaatgtcatgatatatacaatttactgaaaataactgaattcggctttaaaataatctgacaaggatagctagtggccttgcacagtggcaggacagatctattaggagcagcaaagtacaggggaaaagcatgtacttttcagacagctatgagtttgaattttgttccaccatttaccagcttcaatttttctctcaaccagtgatgagattaaataacgtatgtaaagcccagggcctgggtcataagaactcctcaacaagcagtatgactatattctgaggggtgatttatcagtgagccagggtggaaaaacctcatttgagtaatcctcaactgttctgcaacattcctagatgtttctggtgtctactttaaacaggaaaaacttcccatg

SEQ ID NO: 149169 - DNA, 289 bp, Homo sapiens
gtggagggaaggatcagtggtgtgagagaccgtgacaaggcggcagcatcaatggcctgcaggtttgctggagcacaggtcggagcaaaagggaaccgggaaaatagaaggtcatcagaatgcaacactgcaacggattatgcaggtataggggccgctggcaaaagaaggtttaaggtatgaccaaggccaaatccagtggggagtcctttttggaaaccttgacagctgtggtcatggtcgacctcatgggaaattttgcaaacttgatcctgtgtcaaatgagttc

SEQ ID NO: 149170 - DNA, 141 bp, Homo sapiens
tgccatctctccactcatcacacagtcacctttctgaaaggatattacctcatagaacagcttcctaactattccatatttttacatgtgctctctgccactagactacaataacctcaaatataggaactatgtcttcta

SEQ ID NO: 149171 - DNA, 416 bp, Homo sapiens
gtgacccagcaaaacctgtcacatacaaacaaatccccaaatatagaagcccagtatgttaaagacaaaacttcacaatcattagacgaaaacatgacagtggtttccagcctcagggaaggtcaggatgttctgagtcggtcggaaatagcaccattcataaaggataagatcagctgatcatgtgtaaggcttaagcttctgcacatcaggagcaacagaaacgcagttcaaagacacaaccgagaatccgtaatcaggaatatcaggaactcctaccaaccagcagaataagacccagaccaacaaccagaagaaaaatgagaaaaagacatcaacaggcaattcgcacgggagagaatccaagggagaggtaagcgtggtaaagacgcctgactccgccgagtcatcagaga

SEQ ID NO: 149172 - DNA, 579 bp, Homo sapiens
tgagaggaatgcttaagcgatcaccactcagacaacagagcaagaccctctctctctctcaaaaagagaaaggtttgaaatcccctaaactggaagatttttttcaagctctctgaatctaattcttatagaaaaaccatttattacaacaaagtaagttttactttacaccaatatggttatctaatagtaattataccattaattgaacatatgccattcaagtgctctattaactttaaaatgtgagataacaaaaaatcattttatgtattagcacactcaattagcattgggctgcactccagcttgatggtctcaggcaacagaacagtaaatcttatatagccaaaatgaagactgataaagagaaatctcttgtgtgcaaattctgctacaagagggagaaagatacctttctaaataatgaaggggattccactcactactccattcaaatatacttacgaaagctcaggagacagcaaaatggagaaaatgagtaagctaagttttatgttcctttcattgtatgcatattttcttatgctcgaggagcctagtgttataggaacttta

SEQ ID NO: 149173 - DNA, 420 bp, Homo sapiens
taatttttaaaatgttataatttgcaatagcaacaacaaaaatataaggtacctaggaataaatctgacagaatttgtataatactgtgtccggaattagtgggttcttggtctcactgacttcaagaatgaagccgcggaccctcgcggtgagtgttacagctcttaaggtggcgcgtctggagtctgtcccttctgatgttcagatgtgttcggagtttcttccttctggtgggttcgtggtctcgctggctcaggagtgaagccgcagaccttcacagtgagtgttacagctcttaaggtagcgcgtctggagttgttcgttcctcccggtgggctcgtggtcttgctgggctcaggagtgaagctgcagatcttcgaggtgagtgttacagctcataaaagcagtatggacctaaa

SEQ ID NO: 149174 - DNA, 450 bp, Homo sapiens
tgaaatacaggggtggagcaggcagcagggaggccctgggggcttgataaatccccaagcagcccattcctgcctggcaccacagggatccttcaggagggaggacagaggagcagaggtaaaattccaagtggaaaaagacttccttagctgaactttgtaacaatttgaacgggccaagaagcctcctgcccagaactcagggaaaggcgcgaatctggcttgcagacttcacaggcggggaagaactaaagcccttttttttcctgcaactggaaggcagaaagccttgagcaattttcaagcccaactagccttccatctggaaacagacttggggttgttgtggagtacacagtgggagtgagaatggccctctggtttgcatgggagctgagtgaggcctgtgactactcgctttcccccacttccttgacactctgtgtggct

SEQ ID NO: 149175 - DNA, 364 bp, Homo sapiens
cagtaaatggtcagcagtagcccatccgaaggtaatatgtattgcattcaaaatccgaagtgtctcaccaagcattgtgcttgatggtggatggggttcaaggttcaggtttaataatctgtttttcactttagaataacctgctttagtgtcactctaatcctagaaacttcactgatgtggttagcccttcaaattttacaggatttatctcccacactccaacatgcatatatctaaagttactatagtacttgcttcttcctgcctgttaggccgaattagcataacgctaacaatttaatagtatatttgatgttctattgggtataaaagaaaccaaagtccctctagattatgagtg

SEQ ID NO: 149176 - DNA, 402 bp, Homo sapiens
gtcagggtttctaagcaattgctcccgaagtttccacacagggttccacatcaccttgcttatgcataattcagacaaggcaacagtgatgtttctccttggcccctgagtcttgactgttccaacccccactccaggcactgtccctccccagccctcacacacactctcgtcctgcttttgctggggatggcactgctgtgctggggagtctgtccatctgtcatccactttggctctgggagacactgtggcgaatagtcaagtcctgctcagttccggaagacacctgtacacatctcacaccagggccacctggagccaggtaacccgagtttcaggccactatgcaaatggacccaggtccacaggccgttttctatcagaaggcacccaagaaag

SEQ ID NO: 149177 - DNA, 736 bp, Homo sapiens
  misc_feature (529)..(529): n is a, c, g, or t
gtctaccctccctgtccccgcaaacacctgcagagttttgattttgaatgaggcctttaattcctcttggtaatgcttataaattttctgtacacaggtgatgcacatcttcccttagatttattctcaggtatgtaatcttttatggtgcttcttaaatggcatctttaaacatttcccattttataatcctttgttgctagtgaatagaaatacaactgatttctgtatattggcttgtgcctagtcaccctgctaagctctgtattcattctaataatagacctgtaggttcttctcaattttccaggtgcacactcacatcacctgtgagccacaggcatggtggtgtgtggcaacaacaacattcagacagaaagcctaccatctttttggccaggagaacaagaggacagagctggggcaaccaggactgccaaggggtaaggtgggaacactccaaaaagaaaagagtcagtgagggagacctcaagttctgttcttcttcctggcagcttcggacgaaatnacacaggcatctcccatgcccaccacccgttaggaatgtccattcctgggctgcgtgcgcaggtccagcagccagtctgtgcaggcgcctggcccggccagggagattgaggcagacccccacaagccactgaaccccagtctcaagttttctgcacgacctgtacttcagtcaccaaacactcctcgccgctcgccacggttctcc

SEQ ID NO: 149178 - DNA, 2359 bp, Homo sapiens
ttgttcagtcctcaattgttggacattttttttattataatgatgccatgatgatcgtttatgattcactgtttttattttttgatttctttgattttagtggaggtgaacatttccccataataatgagcttcattgatttgtaaattatattatctttgagattatattcaaagctataaaatcatcaactcttaggatcacaggcaacctcaaaagttgtctagttcccatctattcctcgaccctctctacggagtttgtataaaacccatattttcattacttcctaactctgataattataggggatatattttaaggattaaaactagtatcttaaatgtttttatatcagtcagtttaaaaactaatattcagtttagtctttcagaactttgagtcacgaaatgcatctttaaaagcagggtacatttattgaaataaaacactctacagtgatctggatctttttttaatttatttttttattatacttttaagttctgggatacatgtgcagaatgtgcaggcttgttacataggtatacacgtgccacggtggtttactgcacccatcaacctgtcatctacattaggtatttctcctaatgctatccctcccctaccatcccaccccctgacaggcgccttggtgtgtgatgtttggatcgttttttttcttgaacatacaaacgttagtacataccttttctgtttgtatgcagacatatgaatgttttttcagaagaggagttacactgtacacacacagtcctacagcttattcattcagccctcactagcagggtgctttgtgagccataaatgcagggacctgttctttttggtcactgatacttctcaaaggcttagaacagttcttggcacattgctcaatatgcatctgatgagtaacaatatatataagagtcattcttctatgtcatttcaagagacctgctttatttttcttagtgccaagtcatatatttgaaagcaaactgtagttgcaggaagtcaaggattactaaaattcagttctcaatattgttaggactgttatagcctttccttgaaatctgccccaagtgttaatttttgaaatggcaaattggaaaaccaggaatcttatgtgtttttgacattggacatgaggagaaacttccaggtcattcactatatactctcctgaatatatttagattctataaattgtaatgaagtctgctttaaaatatgactaggcaccattcagattaaaaagtgtaatttaaaaacatacaatatgttggctgggcgcagtggcttacacctgtaattccagcactttgtgaggccaaggcaggcagatcacttgagtccaggaatttgagaccagcctgggaaacatggcaaaaccctgtctctaccaaaaacgatagaaaaattagctgatgtgttggcatacacctgtagtcccacctactcgggaggctgaggtaggaagatcgcttgagcccgggaggcagagtgagcagcgattatgccactgcactccagcctgggtgacagagccagaccctgtctcaaaaaaaaaaaaaaaaaaaaaaaaaaaggatagcgtattaaacagataccccaagtatcctaaggaagctgtaaaattacatgctggggatataattttgttaaattacatttatatttaattaaacatgaggtccatttagattttgggttgattcattcatctgtgattactgagcatttgccatgtgccagtcaatcagtattaggcaccagagttaccacagtgagcaagagagacatggaccccttctgcaagatgcctagacaattaaatggccaatgaaactaaagtgaggtaagggttctgatgtgaaaagctgagggtgtgatgaggacaagtggcagaaagttcacctggcttggtggaagggaaggtcagagaagacctcttagaggactcagtaatgtccattgaggattttaggttgaagggaatgtttgaagtttgagggcccttttgaggaccaccaagaacttcactgtgctgtaggatattgagcaggaggtgaagctagagagatgtgtaggccacattgcagagtttgaacttggggcaatgggaagccattgaagggttttaaacaacccaagtggtgcattcttctgtaaatgttagagagatcagtggctgccctgcacatcaaaggggagaacgattggagacaggcagattagatggaaggacggagttgtactccaagccaaagatgatggagagtgaattaagttagtgcaatgggaccaagtctagagctatttagaagtgagaagtgacacggaaaaaaaa

SEQ ID NO: 149179 - DNA, 1358 bp, Homo sapiens
atgaacagggtctttttgatacattgcctggtgtcttaattaactttgctgtgcgaaaatcattgacattaatatttctttctaaaaatatctaaagaatgtaaataactttactccttatgttactagtggacatttaaggtgttatgtacttaatatctttttagtgtatgctgtagtgtggcagcatgccacatgctgaaaggaaatgtacaatttacaaagaaatggcactttagaaatttgtgctgctttttgctttattcatttcaagtacctttgtaggtggacaaaatttaatataactttcttgtcaacaattaacaagaatataggaagcacaagaaagaaaacaaaaaattggtcctaccactcagacagtgatagatgtatgtgctattatgctgttacgctttaaaaaagaagtagccatacatcataatcattttcctgtatcagtaagtattctctttcaatattatgtgcaatggctgcttgtatattactttttttttttttgagatggagtctcactctccagcctgggtgacagagccagaccctgtctcaaaaaaaaaaaaaaaaaaaaaaaaaaaggatagcgtattaaacagataccccaagtatcctaaggaagctgtaaaattacatgctggggatataattttgttaaattacatttatatttaattaaacatgaggtccatttagattttgggttgattcattcatctgtgattactgagcatttgccatgtgccagtcaatcagtattaggcaccagagttaccacagtgagcaagagagacatggaccccttctgcaagatgcctagacaattaaatggccaatgaaactaaagtgaggtaagggttctgatgtgaaaagctgagggtgtgatgaggacaagtggcagaaagttcacctggcttggtggaagggaaggtcagagaagacctcttagaggactcagtaatgtccattgaggattttaggttgaagggaatgtttgaagtttgagggcccttttgaggaccaccaagaacttcactgtgctgtaggatattgagcaggaggtgaagctagagagatgtgtaggccacattgcagagtttgaacttggggcaatgggaagccattgaagggttttaaacaacccaagtggtgcattcttctgtaaatgttagagagatcagtggctgccctgcacatcaaaggggagaacgattggagacaggcagattagatggaaggacggagttgtactccaagccaaagatgatggagagtgaattaagttagtgcaatgggaccaagtctagagctatttagaagtgagaagtgacacggaaaaaaaa

SEQ ID NO: 149180 - DNA, 924 bp, Homo sapiens
tgtggtcccagctactcaagaggctgaggtgcaagaattgcttgagtccaggagtttgaggctgcagtgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaaaaaaaacaaacacgacgaaaagacaacaaattgttgggccgcttgtggaccttgaaaaagtttctgaaacatgtggttgggccacgggcccagtggttaccggaaacatgcgcaaaaacggtacccaagagaaaaccgggcacaaaccaaggcgggaattccaccatataaaaagccccgggggaaccgaacgtctggaaccaaccccacgggagcacggaggccaaagggctcacacagggagccaagaacgcattcat

SEQ ID NO: 149181 - DNA, 391 bp, Homo sapiens
tcccttgggagcgcatagaaacaacttacaattattttattaatcagcttgagtttggtctttcttctgtcccactacaccatgaactccgtgcaggcaggagccagggccaccttgcttcttagcatctagtcaagagcttggcacacagctggactcaactgttggttaaattaaggaagaatgaagcactcacaacatatggctggtgtattgtcgtactaaatgtgaatctatatccaaacttcaaactttgaatgttactccagatgtcacaattgtccagtgagttcactgcctgaatgcttgagattccgggcccctggcatagggccttgtgcatagtaggtgtgcaggagaagcctgttgagcatgtggatgaatggctgac

SEQ ID NO: 149182 - DNA, 419 bp, Homo sapiens
acaggtggacattggcatgcaactagcttttaggttttaattagttccttgcatctcccctgtgttcgacgctgattcttccagatgcatggaccaactaacagacaaggagtgggacattatgctgataaccttcctgtaattgcagtcttgggctttatttcctctctctctagggaaactggcttgaggaagctagctgggggcgggattggaggagctgcttaacttttctccctctggacctaataaagtttcatttagcacacgctaacccaaagccttgaaatgattggctagtcctgttttgctgatggaaaatgacctgttcagggttactgaactaccaagttggtggcagagctaggagtagaatttaggtctccttggctatcaactagatcctctgaatattcgag

SEQ ID NO: 149183 - DNA, 401 bp, Homo sapiens
tttctctaagttcatacatgtacaagcatatacagacacaaatgtggggaggcaagaaaggtcgttttgttttgtttttcacaaaaaatggaagcatactacttatacatatgctttctctcttttttaagcataccaggtatatacatctcaaatttaatacacacagaattttaagtatgaaaatgaatacaatttactagaccgggtaatatttacatttacaaaagttattattttgtatgtaaactttgaaaagacaaggattttacaacaaaatatggccgcccgatttagttagacctcatacttcataacatactggttattataatagccatgcataaataattcaatcatttataataagcctacctaatgagtcttaaaagctatttgag

SEQ ID NO: 149184 - DNA, 316 bp, Homo sapiens
gggaaagaggaagaagagtggatgagatacgtaagagtgcctgagggctaattttatgaaagctttgggaagttttaagaaaaagaaaagctatttttcaaggtacatgtgtgtatgcgtgtgtgtgtgtgtgtgtgtgaaagacagaagaaagagggagacctaagaagagcatgacacactcctccttgacggactgtgagagtgagcgtgcatggcatgtgtgtcacacagatggctgggacgacagacagagtgcgtgcatgcgtgcatgcatgtgtgtatgtgtgtgtgtgtgatgcacgcactgacatat

SEQ ID NO: 149185 - DNA, 567 bp, Homo sapiens
ctgtctcctcctttctcctatcgacataattgcatgaaaatccaaaggcagaaaacagcctttccaattcctactcttacccctaacccaggcttctttaatccagaggcagtcagctgattaaaactcagatctgcagttagacagattttaccagctgaaagaccttgtgactgttacatacccatagaatggagataatatctacctcacagggttattttaaagataaaatgaaacaatgtatgcctacaccaatacctgacacttagcaaacattcattaaagagtagctattattatttcactagaaacatatttcagtctgggtactctctggtacctccagcagaaagtgagaagcaagaaatactctttgatataacaggtctatattctgctcacctcggtgaagccaattttaaaattactattatctggatcatggagtggacttaacaatctagaattgtcattagctcacatcctgccctcgttagttcagagttcggtgaaaagcataaagctactcatatccagtcagttccagctatatggagcgtaaga

SEQ ID NO: 149186 - DNA, 732 bp, Homo sapiens
ggagattttccgctcataccccctgcatttctgattccccctcccagaagtccttcagaatgcccccgacggaccgtgatcatcttccctgaagatctccttcccatatccccaaaataaatcttcctcacagactttgtgaaatgcccccagatcccaaaaactcacctagaagactccatccccctccccaccgtattgcaaccatctctcatacacactcccccttcacgtatccctctggacctttccacagatcccaaaagtctcccccagaggcctcctgtctccccctggtctcaccaccctaaaatgccctagagatcaccctcatgtagcccagtgatcttcaccgggatccccttccccacccccactcattctaaaaatctccagcaattgcctgaaatctccagaggactctcagcatcatattccaaaagcttcttccaaaatcccttttacatactccacatcttttccagtcccccacatcacacgctccaaaaattgtttaaggatcctgaaaactttcctcatggtttttctctcagatcccgtagaactccccttcactaacacctcagaatccccccttgcagaccggttttagaggaattttctgaagatcctcctcacaacccctgtaagaccgtaagattctcttggtgacccctctgatatgcaggttttcaggaccccccccccccacacacacacacagcttagaga

SEQ ID NO: 149187 - DNA, 462 bp, Homo sapiens
ggagattttccgctcataccccctgcatttctgattccccctcccagaagtccttcagaatgcccccgacggaccgtgatcatcttccctgaagatctccttcccatatccccaaaataaatcttcctcacagactttgtgaaatgcccccagatcccaaaaactcacctagaagactccatccccctccccaccgtattgcaaccatctctcatacacactcccccttcacgtatccctctggacctttccacagatcccaaaagtctcccccagaggcctcctgtctccccctggtctcaccaccctaaaatgccctagagatcaccctcatgtagcccagtgatcttcaccgggatccccttccccacccccactcattctaaaaatctccagcaattgcctgaaatcgtccttaaattataacagttcacagccacagaactaatcatatttaaagtc

SEQ ID NO: 149188 - DNA, 234 bp, Homo sapiens
aaagtgttgggattatgggcgtaagccagtgtgcccagactgtctcacagttttctgaagcactgttaattttttaaaaatcttttttctctctgttgttcagattggataatgcctattgataatcttcaagtttcctgactttttttctgttgtgttcattctgattttgagccactccatgagttttatttattattgtgtttttctgttctaaagtttccatttgtattt

SEQ ID NO: 149189 - DNA, 142 bp, Homo sapiens
cttcctttccttctaaagggcttcccctccttgactcctaacccccaggcagagattgtctccagggacacgaactagacacggcgggcatttcagcatcactcccagcacggggccgggatgggccggggggcgcaagcca

SEQ ID NO: 149190 - DNA, 210 bp, Homo sapiens
cagagtacttttgtatataatataaagttttatataaaatgtagaaaatacataatggaaatagttgcctttttaagttttagataattgtgaacccctttcattcgctgttaggatgatagagtttgtggacttgtccttctctcctttctctgttcctcagaattgaaggacttcacaagggagatgctggtgtgctggaaaagaatg

SEQ ID NO: 149191 - DNA, 202 bp, Homo sapiens
gtgggctttattagagttgccacattatctagggcttcacctgggggtacctgcaaattactcaagataattaatgggtgaatatcctccccttcatgcatttcttatttgccactaccaacccagacagtaactacctttattcttgaagtttaccctcaaattttaaatgcagtccccaaagcaacacacattatcagaa

SEQ ID NO: 149192 - DNA, 270 bp, Homo sapiens
  misc_feature (118)..(118): n is a, c, g, or t
ttgatgttctaccttactcttcttattccgacaagatatatcccatatatatattatttttcttgggtttttttcttgagacagtctcgctctgtcacccaggctggagtgcaggggnaaaatctcagctcactgcatcctctgcttcctgtattcaagcgattcccctgccagccatcaccagtttccacccatttgcaccatggatccactcagaagctgcagtggtttcctcttgcccatgatgacaaagctactttccttatcctg

SEQ ID NO: 149193 - DNA, 353 bp, Homo sapiens
cctcccatggggccggcctgctcctaccccacccacttccccttctccaggataagcccgctgcaacagctccgtctcccagtgtctcagcctctctggctgctcagcccagcctggtccagctggctatgctggcatggaccctagtctggtggccagttataaatagcccctgcacccacagccttggcagggtgctcctagtgtgggtgcagaggacacttgagaagaggcagccgtgcctgccatcctgaccatgccaggcccagagctgccatggaggcacccaggagcaggcccaaggacacatgggccctatgagctgaggaacctgccctgggcacagggttctg

SEQ ID NO: 149194 - DNA, 249 bp, Homo sapiens
  misc_feature (111)..(111): n is a, c, g, or t
tgggctttgccaggtgtcccccatcctgatgcacggcccggtggtgcggtctccaggcctcccaggattctcagctgcgccgtctccccagtccccaaaccccagtggtgngccgccaggggactggaccgtcagtctgtggagctggggctgcagctggtggtgtttccaacaagggtcttttggctgcctggctccagggagaggcctctggaggcaaggggtaacctaccgggaaagcctcaaagg

SEQ ID NO: 149195 - DNA, 589 bp, Homo sapiens
ttttgctcctacttcctcttgcagcctcaaattcacagcctccttcttggtctctgtattctagggacactggcatttcccttccagaggctttgaacatgcgcttccctcgtactgagctaaaatgctaaccatccctgcagtggcataatgaacactgctcaacgctcatttcctaaaggatgctttccatcttcctaagcagcaccctgtacatctccattgtagtctctgtcatacttgcattgtgatattttggggacatgattatttgattaatatctgtctattcccctagcttgtacaatccatgaaggtagggaccatgtgtctttctgctcattattgtatcacagcatttagtccagtgcctggtacataggaatggacaataaactttgatagaatgaaatgctgggtgaaagacaggtaggaaggatggtattttcacttggcatgtgtgaattgcacaagggcatctgattactcagcacagatggagcatgaggaccagtgccctgatggttactttattcctcttcctccatgctgcctcctgtcttctctctcttcttctggatatgacttt

SEQ ID NO: 149196 - DNA, 124 bp, Homo sapiens
tgattccttattttacttatgtttcagtttctcagttatgatagggagatttcctttatatcagctctctattaaaaatgcagttgaaatttatgatgtagaaatcttgtcacagtctgaagat

SEQ ID NO: 149197 - DNA, 396 bp, Homo sapiens
aagtgggcagcctgcttccaatccaagcaggcagctttccgctcatctgcaggtagcctcgtgctgtggcagcacaaagttgtgtgagccagagctgaacttgtgatccccacgggcatctcctgaggcgcacctctcctgagagagaaagctggtccgtccagcccattcagggctcagcctccccagccgtcgcagggctggcttgctgaaaggtctgggtgttaacacagcactcctgttctctctctctgaaggccctttatgctggcatgaattccttttctcatagagatctgaaagctcttttgactaaatgggtcacctttctgagtattttcataaggctgtcagcctttaccgtgccagacaagttttctggaatttcctttccag

SEQ ID NO: 149198 - DNA, 288 bp, Homo sapiens
attctgatctatttgtttctgagcatttctttgtaagcttaacaatggagtagtgcatcagagtaactgatcaatataaccttccccatgtggatgctctgaggaatacgctttagaattttagtgatatagaagcttatttagaagaacatacacagtcttagggagcatactcttggtttattaattaaaaaaactcatatgttaagcagctgtgcaaatgcacatttaaataaccattttaccataggataggactagaataccttaaacattgttttctgcctt

SEQ ID NO: 149199 - DNA, 345 bp, Homo sapiens
gaaaggagacgagtatggcccaaggtaggattaagaccttcagaggctctgggtaccacaagatgtaattacaattaaaaaaacaaaaccaatctgtaaacctcaaaacaattgcattttctccagcttaaggaagactgtatgactggaaggatatacatcaatggaaatatgatttagaatctccagtgatacttttaaaaaaccataaatgttgggatccttcccttgatctactgaagtgatttacctggttccatggtaggtgtatttcacaaaacacaagtaatccaaatgtacacctctagttaagaaccattagactgaaaacaaatgagcccagaa

SEQ ID NO: 149200 - DNA, 341 bp, Homo sapiens
gtgctggtgcgatctagaggaccccagcgacattagcgcagagaaatggatgccatctggggtcactgtaactctctatgcacctcccattggttctgtttctctggagaacactgactaatacacacctcatatggttataacgaagattagataaactaatatatgtaagcatgtttagaacactgcctgccacctagaaagctcccctggaagtgctagatgctgttatcgaatgagcatctactatgtgcgaggacattttcacgtttcctcatttgctgatcagagccacagtacatgatgggtggtgggattcccattttgcaaatgagaagctg

SEQ ID NO: 149201 - DNA, 173 bp, Homo sapiens
tgggggtgtctcagcttgtgaagaggagatggctttgagcagggctgacactgaaaaggctggaagaaaaaaacagacacacaagagtctcaggatcaggtagcataggaaagttgtggacagtctttgaggagcactccctcaggcaggcaggcaggcaggtcatgagctat

SEQ ID NO: 149202 - DNA, 368 bp, Homo sapiens
  misc_feature (41)..(42): n is a, c, g, or t
  misc_feature (45)..(46): n is a, c, g, or t
ccttaccgcgcacgtttcccgcgaatggagaggagaaggannggnngccttgctggtcactctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149203 - DNA, 356 bp, Homo sapiens
  misc_feature (41)..(41): n is a, c, g, or t
ctggcctggcgaataaccataataagaagaaggggggcctnttggtactctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149204 - DNA, 359 bp, Homo sapiens
tatttctggtctacgtttgtaccaactacaccgcccccctcgggaactctatctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149205 - DNA, 357 bp, Homo sapiens
  misc_feature (47)..(47): n is a, c, g, or t
cggcgtgaggtgatggtgatgtggaggtgggaaaggggggggggggncttctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149206 - DNA, 512 bp, Homo sapiens
aatttgtaagctatggaagaagtgactcatctgcttgaagggagagatgttgaaggagcgtggagccagggaggagggaacgcaggaacacgatgggaacccacaggtggtttatgaaggagccctcagaaacagagaggggaaaatcaacgatatcacaaacaacagaatgtgcagctgtcatggaagttggtgtttacaaagtctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149207 - DNA, 383 bp, Homo sapiens
cttgacgtacgtaaaaccggacccattatcccgcaggaggaaagacacgcggccttgctcgtgctacctgtaagctctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149208 - DNA, 382 bp, Homo sapiens
  misc_feature (46)..(46): n is a, c, g, or t
  misc_feature (68)..(68): n is a, c, g, or t
aagtacgagcagccgcttcctatgccagtgaccgtacacgaaacangtcacaattccgctcctgctgntagtactctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149209 - DNA, 380 bp, Homo sapiens
  misc_feature (58)..(58): n is a, c, g, or t
ccaccgacggggaggctgggttgtggtgggggcggggggcgcggcgagggaagttacntgtgtagctagtagtctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149210 - DNA, 375 bp, Homo sapiens
  misc_feature (40)..(40): n is a, c, g, or t
  misc_feature (55)..(55): n is a, c, g, or t
atagagaaaatgaacacagccatataaacccaacaaaacncactttatgggtacngtagattcattttctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149211 - DNA, 381 bp, Homo sapiens
  misc_feature (46)..(46): n is a, c, g, or t
  misc_feature (60)..(60): n is a, c, g, or t
  misc_feature (71)..(71): n is a, c, g, or t
  misc_feature (73)..(73): n is a, c, g, or t
tggtatatggttgatctccgcccgcatgttttgcggaagacaaganaagacgctttactnctatactagtnantctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149212 - DNA, 372 bp, Homo sapiens
  misc_feature (52)..(52): n is a, c, g, or t
ctcggggtgcagcagagacattagtcaaagggagaagaggctactgggtacngtagattcattttctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149213 - DNA, 360 bp, Homo sapiens
ctcgcattttgtttagttttagttgtttttttggctagttgagcacagtctgtctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149214 - DNA, 365 bp, Homo sapiens
attaaataaagctattccttttttttagatcaaacccacacctactgtgtactgtaatctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149215 - DNA, 358 bp, Homo sapiens
tgcgatgagctaggctgtgtatccatgtcttaactgaacgcggggcattgtctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149216 - DNA, 358 bp, Homo sapiens
ggcgctgtagagcgtccggccctgtggccggccccgccaaagaaattcgatctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149217 - DNA, 362 bp, Homo sapiens
  misc_feature (44)..(44): n is a, c, g, or t
ggtccaggaacaaatatttatacggcagaaaccacaaacacccngcacaatctgtctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149218 - DNA, 345 bp, Homo sapiens
tttttttaatgcttgtaatatggaaagagggggactgtctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149219 - DNA, 393 bp, Homo sapiens
  misc_feature (41)..(41): n is a, c, g, or t
ctggcctggcgaataaccataataagaagaaggggggcctnttggtactctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagccaaaaaaaaaacaaaaatgtggtcctatgtggcctcaaa

SEQ ID NO: 149220 - DNA, 379 bp, Homo sapiens
  misc_feature (66)..(66): n is a, c, g, or t
ttacattttcatttagaaatcaatttatagagaaaaggggggggctttcgtgtttactgcgagaancctactctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149221 - DNA, 382 bp, Homo sapiens
gcgtcgggagttggtgcgggaaaggttgtggggagaacgcggggaggctacgtgtctgcagtagcaatcatttttctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149222 - DNA, 358 bp, Homo sapiens
acgcccacccgccaaccccgcacatactcttcgccgcaccggcacattcgtctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149223 - DNA, 375 bp, Homo sapiens
ctctagtaccagaaaaacccatgacgaagggaggggggggggctagtggctacaggagatagccttctctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagcca

SEQ ID NO: 149224 - DNA, 409 bp, Homo sapiens
  misc_feature (66)..(66): n is a, c, g, or t
ttacattttcatttagaaatcaatttatagagaaaaggggggggctttcgtgtttactgcgagaancctactctctgatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagccaaacaaaaaaaaactggcctcgctggcctca

SEQ ID NO: 149225 - DNA, 494 bp, Homo sapiens
agatattggtattttatccccattcacgctacacacaactcttgtttttcaccctgttaggaacaagtcggggatcttacatgaataggcacaggattggtcacagaagtcctcaggcatctgggaatagcttcccctggtatcaaggctggaatgttgaggctgaagcattcagtcaaggagatggcaagcctgactccgggtccctttctgagtggcagcatctcatcctcacgagtctgtgtctcagcagagcaggtcgagctgcctgagggcttctctttttatagtccctgtttggggatccacctgtgtctggttatcttgaaggttggtgcgccctagcatgtgatgtcgtctcaaattggaatatcccaatgcagttggtctaaacagatttgggcattctggcagacatctgcacttacaaactaactgtgataacatatttacactatacccataaattgcactccaaacaatgacctaatcat

SEQ ID NO: 149226 - DNA, 173 bp, Homo sapiens
caggtagttgcgtttcttctcaggtagttgcgtttcttctcaggtagttgcgtttcttctcaggtagttgcgtttttttgcgttgagtgctttcgcttagtaactcttataaaggagcaaatattcatatgattgtaagagaacagaagaatgctttcttctttcttttgcta

SEQ ID NO: 149227 - DNA, 477 bp, Homo sapiens
caatcttatttgctcaggagcatcaaactaagcattctaatagaagaagttaattccaaaagacttctttatagtcttttggtgctcaggaacatcaaactaagcattctaatagaagttaattccaaaagactttttatccaatatttatagttcttgcacctatttacatattgagaaaaaaccatgctgtcctcacttttgtctaagtattggcctgtatggcttctttttaattggcaaattataatggctatatatttaacgaatctaacaatattaaacaaatggcattcaattacactccaaacactaaattgctttaatttgggaagaagaattcctggagtctcgctgaacagttatcagtcattcagaattgctcgccttaatataaaaagttctgtacttaaaaaattcagaaacagcagcattatacaattggagagttcacttatttttcttctggacatttaa

SEQ ID NO: 149228 - DNA, 452 bp, Homo sapiens
cagattccaggttggaggtttgtcaagcaggtgtggctaaaggactagtggttaagggagttaatggtcctggtgagaacagtggggatgatgcaccttaagtctggaaaggctagggaaggaattatgaagtgtggtgggagtgctgtctatcagaggaggttgtgggggcaggcatggtaatcttgcacaaatacaaggaataaagtagtaaggctagagaaagttctgaaaaaggaaaatgagaatttaggatcacaaaattctctattgtgaaatagcctgatgtgtaaccctagaagcaaatgttcaaaactgagtagagggaaaaagctgtaagcaattatggcaagggtattgggtgggctttcctctataagcaattatggcaagggtattgggtgggctttcctctagaacactgaagtcatccaggatgatggtgggacatg

SEQ ID NO: 149229 - DNA, 622 bp, Homo sapiens
tgacccatcatctgcccctcctccctgcagagggggaagtgagaaggaggggggccagagaccctgccttctgggccaggaaggctaataaaagcagaagtaggaagagtaacggggccctctggtcaccggcttgagccccaccatgcagaccccagcagatttccccagggttgagagagacttggttccctgtcccagaaaggtgagcagaagagtcgcctgcctccagcggtgtctgtcaccatgactgggcaaggaatgggtttgggggtggctctgtcccttgggatttctgggtggtttcctgtctctgtccccagggagtgctctcagtcagaggcagacaggtgaggtggaggttcagatctcagggtggggtgtgcaggtattgccatgtgggcttggccccctcttagtccctctttgagccaggctttctgcctgtcccgccaggaggttacactcaggggtctgatttgactgcagttttgtggtgtttttgtggggctgttccacccactcctccatctgtcaggaagggttaggtatcttcccctgaagataagattgtgtctccgagggccaggacctacagtgggaggtcacagacggaccctag

SEQ ID NO: 149230 - DNA, 451 bp, Homo sapiens
ctgggttcccaggcctatcttgggaagggcaggaaagggcctctacaagctgatcctcttcccagctgccatctcagaccttctgtcatcctgagccatgccaggtgcccggctgaggcaggcaagccccagggcccactgtcactcaagggcagagctgggtcaacattgggtgcctgctcacatctagtttgggaaagaaagttcaggtcgtctaggctctggttaacactgactcatgggcgaggattccctgtgtgtcacattgcttcagaggaggggggtcttcatctgagccatgggaccctgagagtttcaataaggactctgggggggctcagagcctcctgacattgtaaaatttgtatgaatgtgttttctggggaggagatggccctgagctttcacccaatacccaaaaggacccttaaccccccaaatgttcaagaga

SEQ ID NO: 149231 - DNA, 157 bp, Homo sapiens
gcggccgcctactactactactgctcgaattcaagcttctaacgatgtacgggaatcatgtcatcttgacccagctgactggaaattttcaatactgtcttttaactgttgtactccagccagcctgggcaacagagtgagaccctgtctcaaaaaa

SEQ ID NO: 149232 - DNA, 225 bp, Homo sapiens
ccatgggtcatgaaacaaatatggtggattgcaattggtgtataggggagaaaagggaaatgtcagagggtgtcacaattttcaaggatatttcataaaacctttgctttgatcttaggtgttgtgtacatgataaaatgtgtttcttatgggggggtcatgtcagaggagttgaattacattggtttccatgctacttgatggcaattgtgaatacttgatttg

SEQ ID NO: 149233 - DNA, 310 bp, Homo sapiens
tttgtcattaccaacaaaatttgggagaagcaaacagtctattcatacattccataaaaaacatgattttatcatcttattctaatcaaatacagaatctgcgtatgtgacaaacttttaatatccactgatcacaaaaaggaatactttcaactgaaaagtgccagcagagctttctccctacctgcaaggagccagaacatcctcattatagtaccatctaccctaaatgataccaaacctaagggcctttcattattttagagttaattctgtgaaaaaatatgtgcagaccaaaatgtgggttgga

SEQ ID NO: 149234 - DNA, 251 bp, Homo sapiens
tacaggtgtaagccaccgctcccggccttgtttttatttttattttttacaatcctttaaaaatgtaaaagtcagctttactttgtgggcccatctattctatggatggggtttggccgatgggttctagtttgctgcacctgctggtataagtgtatagtcacttccttgggtcagggtcattctactttggatctatctttgtaatttttttttttttttagacagagtcttgctctgttgcccaggct

SEQ ID NO: 149235 - DNA, 836 bp, Homo sapiens
ttatcaaggagcctcgttctcttgcaggatgtctgccagctcctctccagccacccattctcatagcgggtgagccagaccacatctgctaatccaggagcacagctcaggactagtctatgcggatggaatctctctccagccttttctctatgtcagttttatctacctggcaagaaaaaacaaaaacaaccccaaaacaacccctccccacaaacacaacacaaaacaagggactcgaaaagttggagaaaaccttttaatgtgtttctgtaaaatcctttcttaggaggtttagtacaggtactacccatcagcaacttagccggccaggtgagttggtgcagaagggcttcggctgaatttataccagagccatcgggagtgacttggccacctctcccaattaccacaaggaagtcttaaaattgaatttcagtttcagcagatacttcagatttacctgagcaatatcatagacaatgtactcattatatagtagacaagtgtcattcacaccagatgaaatcccagtcccaagaggaacctctgcaccatccagagtaatactagctgaagggtcaggggtagttttgcccaaacctttgacactgtgcttgccctttgggtaacttgctgatatgtgaagcgtgcttcagttcatacattttccaagggcaacttctcccaacaggattaagcccgttgggcctccctgagaatgtatggcagtattggcactcttggaggccatgtagcaaaataatcctttaccaacatgtagcccgtcatgggcactttaggcgggcctatccaaagaccctgggacaggatcc

SEQ ID NO: 149236 - DNA, 476 bp, Homo sapiens
cttgctcaactcctttgtgaggtgatttttcagtgaactttcagaaggcaaaggggaagctttcccttggaccctacagttttggtgctgtgggcaggctcaccaaagccactctgctcttctagaagccacagtgaagggaacccagggcttgacaacgggcaaaagggtaagaattcctcaacagtcaggctcccagcctgtcttcctgtgaaacccagttgagcagacaggaaaaaaataaccgtttatctcctctacataatctcaattaatgggagtgatatggtttggctctgtgtttccacaaaactctcaccttgaattgtagtaatccccatgtgtcatgggaggaacccagtgggaggtaattgaatcatgggggcagatttttcccatgctgttctcctgatagtgaataagtctcacaagatctgatggttttataaaggggagttccactgcacacgctctct

SEQ ID NO: 149237 - DNA, 324 bp, Homo sapiens
tttgggaggctgaggcgggcagatctcttgaggtcaggagttcgagaccagcctagctaacaaggcaaaaccccgtctctactaaaaatacaaaatcagcccggcatggtggtaggtgcctgtaatcccagctcctgggaaggctgaggcaggggaattgcttgaaccagggaggcagaagctgcagtgagctgagattatgtcactgcactccagtctaggtgacagaggaagactccatctcaacaacaacaacaacaaagaatggaatagaaatctgaaagcacctaagcaaagtttcagatttagtaatgatagttatag

SEQ ID NO: 149238 - DNA, 831 bp, Homo sapiens
cagatattggatttacatcttaaaagcctcactcatcgacttactcactctttgagctcaaagcattaagaactgccactgagattgtggactccatccgcttcacaaccgccaactctcctaagtgaggacatggatgaaaaccctgtagcaactgaaggataattaacagtgggagtcagagggtatttgctttgtcagggctgcatgatctttgaacagaaataaatatacctcattatggcaacagaaaggtgctgacattaaattacagtctaccgtatacctggtcagaatagagatagaatcagtccctcttctaagttcggctggcactttacccatttttaagaaggaatattgcgtgatttgccaaggaagggtgaaaaaggacaaattgtaagcactggttaaaaagagagctcttctgctggattttacaattctccatgaatgagatgaatgttttgtctgtcatgctgcattctcaaatacagtcagttacaaagaaaggctcacttactcccttttaagatagtcacaccaagaagataaagaagctgaagtcacttccctaggagccacggctttgctggcaagtcaaaccaacaaacattcattgagtatctgtgtacccaggactttcctaggcactgatggaaaaacataagaagcttgggactcagtcccaggacacttaccctccccaagcagagaaggaaaactgagtgtgcctcatttagcagtctgacaaaacaaaacctgaataatcaaatgtcccttgtttcatttttgtaactttattttattttgctataatctatgtacctt

SEQ ID NO: 149239 - DNA, 303 bp, Homo sapiens
ttctctttgccccagtttcctcatttgtaaactgccttaaatctttcggggaacaagaaggaaggggtatgtatcaatcaatcaatccataatttctagccattctttaaggtccacctccatgaaacttggcttcaatcttcttgcccagtcatttctcctctccagttccttgtatagcatttattgtttactactcaatggctcaatcatggtttttttttgttttttttttttggaaacgggttccggcccttaaacttcctaaacttagggggaaccctctaaattcaccctgcagcc

SEQ ID NO: 149240 - DNA, 146 bp, Homo sapiens
aaggaaaggcattccaggtggaggtaacagcgtaggcaaaggcacggcagtgtgaaagcactgggtgcgctggatggctaggatggaattgatcagagcagagctgcacggagagatgtaaaggaagatggtgctgcagacactta

SEQ ID NO: 149241 - DNA, 294 bp, Homo sapiens
gaacaactacctactttaaaccagactcatgtatttttcatatactgccattataattaacgccatggactttcaacctcctttttaggaccaaaatcttccagaaccatattaaatatcacatttgagtcaataaaaaaaatttgtcatttatttttgtgatatttgtgcactctttcatcaccgagcacatcttggctcgatgtctctaacagtctaactggttttaccatttccactctcagtcccctcctatctgttatgttgaagtcacagacattccctgactctaat

SEQ ID NO: 149242 - DNA, 353 bp, Homo sapiens
catggtggggctggaaagctggggaatgagatgaggggaacataggtcaagtgtgaaccccaagatgtgagaccaggaaggggaacatcacagcttcctagttctgccatgccaggcgaggacacttgaaaccagtccctgtttccctcctgggcttcctcctcaatgtcattccttcccagcaccagggccaaatgctcagccctgctcagttgaagcgacatcttcctctcttcccaaggagcccaatttcctctgccgctcacgtgcaggcaacagtccatagttcacacacagcagtggggccaggccagactctcatcactatgaggacttcgtggctgacgtgcagg

SEQ ID NO: 149243 - DNA, 442 bp, Homo sapiens
ctatggcctgtcacaatgtttctgggagagttgggattccatataaggttttaagtaatgggacatctaagtaactgggtacgtaaggaagcccaggataggtaaaggaagtggtttgccaaggcctattaggacagctcatccgaggatgggtctaggaagtacacaatcccacttaaaaggaaaacagtattttggaaacagcatatataagaaactgcaggttttggaggtatgaaaagcaggaggaatgacaacttgtctaaataattcttggaggaagatgaggaccagaagaatcctgcaggaaaaaataaactgccagtatacttgataggaggtatttcagtgcaattttgagggtagtgcacagattgataactctggatcccgctggtttgtttatgggtgggaccacctaagttgactagggcaggcctat

SEQ ID NO: 149244 - DNA, 363 bp, Homo sapiens
ttccagcagcaaatgggttatgtcgaccataaagcaacaccttcttttcttgttggatttgactttaagacaaatgagtgtattgcctgttccaaataggaggcacaaagttccagcaatctaaagcttacaagcaactagagacagaaaggggagagtgtagcctttcaatgattatctcattaaaacccttcttctaaatttaacaggattctataaatcttagaaaccatggatcacattcctagtatcctaacctggtatccaggctttctaactcaatgatttcttccagttaacaaaagccaaactagtcctatttcggatagagatggaacaaaaagggggcagtgggggcgtgtg

SEQ ID NO: 149245 - DNA, 378 bp, Homo sapiens
tgcctggcacagagtaagtgcccaataaacagtggcttttctcactggtggctgttactgttatctgctgatgcaaacacctctccatagtaagctgcttattccctgattcctgggactagattttattcacattcccacactgcacatcttgggctcttggattaaatgcttactaaatcaatacatgaataacataaaaatgtgatccctaccttcaaggagaccagactctggttctgaaataatcacagcagaaggcagaaactacatcaccatagggagatgtagttaaactaaaaggtttagaggagaaagatattaataggcaggtttaaggcaggtacttagtaggcactttgttcagcgtagtgtttt

SEQ ID NO: 149246 - DNA, 442 bp, Homo sapiens
ccagcgcgtgagcctgtttccctatcccctggttttgagtttctggcctgatcgttgcatgcttggcttcactgctactttgtgaaactctttgctgagattttaacctgggctctactttcagggcacgatgggattgagacacatcttgggggatgggtaggcaggtgagcaggtctgaggaggaggctgggtctgccttgacctgtcctctcccatctctacatacttaccagtaatcagtgcttgatgctgaaggtcatactgagatggaggctatgggcaagagtttgaatctgtgtggtcttctgtgggtgctcactgacctgctgtatgtggatttccatgcaccagacacatgctcttagaatgtgcctggcagcttgagcaggattgagggatctagagctttcttctggctgcttcccccacaatcaaggag

SEQ ID NO: 149247 - DNA, 174 bp, Homo sapiens
tttgaatgcataaaataacatatataggatgtcatgggaaaaacaattacagtgaagtccagtgatcagaatgtttcagtgtgtgtttcagcatgtgcttccatggcataggtgcttctgttttacatgtgacagataggcataaatgacacaatctctgtaacagctgtgaca

SEQ ID NO: 149248 - DNA, 330 bp, Homo sapiens
ctcgcagcttataaaggaaagagggtgacaagaatgaagcctctgacttccagggctctttgtcctgctccaagtcaggcattagttctgtctgtcaaaatccagattatcaaaggaccatagtataaaagggctctgcaatatggggaggtgcatccacgcttctttgggagaaacgcctcacatgttggcttcataaaactcttctatgccccgtaggttggacaatgagaaataaataatccagacattggtgtttttgataggtggttagagcttccccaacagggggagtaaacaaaagaaccatcttaatttcaagcttagtta

SEQ ID NO: 149249 - DNA, 460 bp, Homo sapiens
cagtaaagatgtaagtggcccttgcaggccactgaaaatagactctttaggctcccagaaatgggttctgttcggacccttctaccacatctttctgtagcctatgcagaggaagacccgagtctagtcatgttgggggaagcggaacttttggtcacagtctccaaatttagtcacatttctttttttacttaagttctatttaagatctagtctaatgctatttttatgtggctttttaagtagtgcttgttaaaaagagaatacaaaattctaataatcactgctaattatttatcagaattctgtaaaaagcgttcgtcattgtagataagctgtggtttctaaaagcattagaagtcattttgacaagtgccgcggaaggtgggcaccggggaaggtaggcgccggggaaggtgggcgccgggaaaggtgggtgccaggtttcccttcatctctg

SEQ ID NO: 149250 - DNA, 333 bp, Homo sapiens
tgtaatatccttacagaggattttaagatgtgtggtatgtttaaaccaagtattttcacttggggcctttacttcatatgaggtcccactttcagatgcaactcaacattaggtttaaaaaagacacagggaagagaaagctgatggtatgacgcctacctcctgaagcataaactcttagattacagcccgtgtctccacaaggcattctgagcatatttgttttttttgtctgtggatcaaagggcagatatcaaatgatataaattttaccttggggtatcactatttattctattctctactctttgccagtctgtgaggaaaacctct

SEQ ID NO: 149251 - DNA, 122 bp, Homo sapiens
ccagccctcctcctcaggttaagaaaggcaaagagccctgcttttggctgtaaaaagccaggttccctaatcaggtgaaggcctgaggcagggactccttagggcagtgtaactagtagcca

SEQ ID NO: 149252 - DNA, 143 bp, Homo sapiens
agctaacatcagaggaaagttttgttttaagagttgtgcatttgcataaagttttttgattttccttgttctatggaccacagagcaaaactactgcttagcttaccttgcagtgagtttgcttctaaacagaaacactatga

SEQ ID NO: 149253 - DNA, 168 bp, Homo sapiens
ggagtttgaggttacaatgagatatgtctgcgccactgccactgcactccagcttgaatggcaaagcaaggccctgtctctacaaaacaaacaaacgaacaaacaagtattagcctgcacctgctccaccaaaacttctatagtgttggaaatcctagccagagcaat

SEQ ID NO: 149254 - DNA, 317 bp, Homo sapiens
agtatttcctagtgttgcttaattaagagaatcagatcagctgggtgcagtagctcacacctgtaatcccagcactttgggaggccaaggcgagtggatcacctgaggacaggggttcgagaccagcctaacatgcagaaaccccgtctctactaaaaatacaaaattagccgggcatggtggtggatgcctgtaatcccagctactcgggaggctgaagcaggagaatcgcttgaacccaggaggcagaggttgcaatgagctgagatcgtgccattgcactccagtctgagcaacaagagtgaaattctgtctca

SEQ ID NO: 149255 - DNA, 303 bp, Homo sapiens
ctgccctctgccagtgagggcaaaggaccagtgtaacagcctttctgggtacctgtactcagtgggtcccgagctcttgtccagtgtccaagaagaatgaggtcatgcttgacaattgaagaatggtgagggcagagaattttattgagggatgaaaacagctctcagcagagaggggagctggacgggggacgagaagggcaggtcatcttctcccgaagtcaggaggtctcctccccaaagtcaggccatctcccctctaccaactgagtatggggtctttataggcacaggatgggggtg

SEQ ID NO: 149256 - DNA, 289 bp, Homo sapiens
tgtttgtatttttagtagagacggggtttcaccatgttggccaggctggtctcaaacatctgacctcaaggaatccatgcatcttggcctcccagattgctgggattacaggcgtgagccaccgcgcctggcccagtctcggtatttgaggtcatgctggtttgtaaatgtctttttggcttgaccgtggcctctgacccctctcccattggagcagcgtccccgcgttacctgggccagggagataggtgaagaacttgctgcttgttacgcgtgtggggcttctttg

SEQ ID NO: 149257 - DNA, 329 bp, Homo sapiens
tagaacagctgaccacagaaacaggctagggtaatcctacaaggtgaagttcacaaggccagtgcctgcttccatggtgcctactgccaggcctgctattgcctttgagatctgactcagaacacaatgccaagagctttctattagatacaaacacccgactttggacactctgttactcaggtttttttaatccctcacatagaaaagcaccagagttgtcaccatacagagcaaccccagattcaaggacaaattgtttgcatctgttaaaagtcttacaacttaagttaccattttatgaaaactaccttcttgcctctatcttt

SEQ ID NO: 149258 - DNA, 711 bp, Homo sapiens
tgataggaatttctgtgatgctgccaaaatgttcatttctgcacatataaatccaactcccttgcatttatcatagctgaaaaattctttgaggtttctgtaactggcttttaactgtctcagtgcctgttttttagagggttagcatccactaggaaagctttccctgtcccatttcctcaaagcaaggtgcttcaaaagacagaacagctagaagtattccagggtatattcatgatccaagcacccactcctgagaggagagagaaacagaatttagaggtaatcccacccaatttttggacttttatgcaatttgacttaaaaaatccacaccaatctggaggcatatggatttatttactcatttcctttgcagaagagtactttaggaatcatttctgcctttcccccacctcctgcctttctctgtctcatcatttggaggctacaggggaaataaatttatcttgaaggagtgttatgaatatgattgtggccattatttgattaaatactcaaaagatataatcctacccagcgaccatgtcacatgaaggaaccatggttaccatcaattactgttcgttttctgtaaacatggacctgagccaactttagggggaaaataaaaagttggcaaatgatgtatttggcatcttccatctgtctttttttttttctctaccccttcagtttttgctctgggtt

SEQ ID NO: 149259 - DNA, 228 bp, Homo sapiens
tttgttagaacttcaaatgtaatcagaacaaaactgaaatgcagtgagtagactgttagataaaaagaaactctaagttcacgtgtgggtttcaatgagactgttagataaaaagaaactctaagttcacctgtgcgtttcaattactccaaatgccctcagtttccctacttagtgtggatggatgcaggcagttgatggatgagtatacattctaggtaatcaagg

SEQ ID NO: 149260 - DNA, 383 bp, Homo sapiens
agttcgacggagactctcacaatcaagagggaattcagtcttgaatttgtgagagaccattcaggcttgtgggaataggtgctgcagagctgacgccaaggtgccctggatgggatggacagtggtggagacctagggtccaggaggaggagacacgggagcattccacacctttgacccaggggtcgggggcagagtggcatgtgctgtggacagaaagagatgcacaatgcaagtgcatgtggtggttgggaagagtgatctggggaggaggagcattgtgattcaggtgagggaacaccacccaaggaatgtccatctggcatttgtaaactgaggtgaacctggcatttgggagagaggtggttgggtagagaattggg

SEQ ID NO: 149261 - DNA, 370 bp, Homo sapiens
tcaaacactggagtatggagaaaagatgctgtgtgactccaaggcttagacacaaaaggccacacagctcctgcctggttttctggggaccctcactctgggggacaccatccacatgtaaggagcctgggtctgcagtctgccctgctggaaaggcctgtgtaggtgctctggtcatcagccccagccgagagccaacacaactgccagctgtgtgtgtggaccacctgactgctcccccgagcagggctttcagatgactgcagcctcagccaacatctgactgcaaccacaggagatgagccacccaggctcaaacctaacttgtggactgccaatagcaaagggaccagaactccagatccggtaa

SEQ ID NO: 149262 - DNA, 457 bp, Homo sapiens
gtctcatctgaatcctctataaaatatgaaaagagaaaattttaaatttgggttgctggaatattgagactcagagaatttgaaactttttccataaccatagtaaggctaagatttattaagtactcagatacatttcatgtcacatggttggttttcagctaagacaggattggaagcagagtttcctgaatttcaggctctatttttcctcacctacaatgaactattttgcctgtgcacataatgggtttctgttaggaatgaaatatattttgtcctgaatctgtttacatttcaggaaaagcagatcagttctggaccagagcttgtcatattcgagataaaatctctcttccaaatatccctcccttgcacatttgatttctgattggcttccctcccttttctcctccttcttctccggtttttatttctattgtccagatcacatgtg

SEQ ID NO: 149263 - DNA, 828 bp, Homo sapiens
  misc_feature (768)..(768): n is a, c, g, or t
  misc_feature (772)..(773): n is a, c, g, or t
  misc_feature (775)..(776): n is a, c, g, or t
  misc_feature (781)..(783): n is a, c, g, or t
gggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgtgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcacagagcggtactggcttttaaagggaagccntcanntnntcgtnnncccccacagagagagcgtcgggatcctctagatcacatgctgatg

SEQ ID NO: 149264 - DNA, 111 bp, Homo sapiens
tttttaaaagcaatgttgtttttggcaatggctatcttccatgttaataattattgatctgtagcataattttaatggctgtaaagtattcccctgcataggtatgccatt

SEQ ID NO: 149265 - DNA, 311 bp, Homo sapiens
agtgcccaccagctaactacggggattgagaacaagtctttagaaagctcatgtcagggtgatattgggatagcatctaactgcatcctcactggactcatcttactggacaggagatagaccctttcagtgttgttgaacttgagtggtgagttgcatgtgacacaagcagtgttctagtcacattcaggaggaccaggtatcaaaccgtgatggaaatataaaaacaaagtgacactaactaggttttcatcatttatggtataagaagtgcttgtagtccataaacctaattttaatgtgagaaaatc

SEQ ID NO: 149266 - DNA, 543 bp, Homo sapiens
  misc_feature (456)..(456): n is a, c, g, or t
atcaacgcttatacttccctgtagcttctgagctacagtctttctcaatcagcctccttttactgatgacatgcttctgaagaggaaaaagttgctttctttttctatgagaattttccagtttttcgttttgttttgtttattatcttcctagcatctctcttcctcatttccaggtgatgctggcaatctattttacagtttagcacaacctttagactctaaagaggtcatttaaaggtgctttccaataagaagcattttagtgttgtctctgaaatgtttttactctccccctgcaccactcagaatttacatagtttttgcgtacataaatgtgctctctcctcccccaaatttagtaaaatgtaaaagtctgagttactgtcaattttgagatatttaggaaatttaactcaataccaaaccagccatttctttgaagtataaagcgtngagctcaacgctttatacttccggaaagggcctcatgaaaaagaactattacaatcaaaaacagctttatctagtgtccaaacagtc

SEQ ID NO: 149267 - DNA, 215 bp, Homo sapiens
ccacttcacaccatctcgtggacacatcccaccctttgggcagtgctgctgtgcagacttatagccagggcagccaggagagagcatccccaggggaaagccattctcggttcccaagaggcaactcctccaagtcactgtcaacttcccagggggctggctagcatgtaagggggaacctatttaacaaaaaggtgtgtctcatctgctgtctg

SEQ ID NO: 149268 - DNA, 203 bp, Homo sapiens
gtgggcccagtttcatggggatgggcccggtttcatggggatggacccctgcaccatccgaggtgaccattagcccggctccccgggaccagccctgagtgctccctggggaaagcgggacctgcagaggatggttttccaggatccgcctgaccacccacccccagcccgctcttacccccagcttccctgacctccatcct

SEQ ID NO: 149269 - DNA, 422 bp, Homo sapiens
gtccagtctcctctggcaacatcgcagagcagacacgggtgattccaggcaccatccagtgtccagccctgagccagacacatgataggtactctatcaaggatcaataaattgattgctcaggtttatttggatacatttcattggaaagtactctgtgatcagacctgtctgcagagccctcaaccctacagccctgtcctcatgctcttgaccatgacttcgagtcatggagaaacataacaatcctatttgtttactgagtgggtgcctgccagatgcagctatatcatctttctaatgcctccaacaacccacaaactagagacacttatgcccaactaggacacgcttggcaaccacgaagatgcccgtttactcccagaaaattatatgttgcctttcggagaagaggggctcat

SEQ ID NO: 149270 - DNA, 213 bp, Homo sapiens
ggttagaggatcccggcacagaagacgtacccgtacattgtgtgaaccagtattcttttagttgaaagtgataaaaaccctcctcaaagtagtccaggggcagaggttatatggagtttcttaggactccgttgcttttgctccaagtttacatggttaggattttggatagaaaaagagagaggggagtggggtgtgtgggtggcagggaga

SEQ ID NO: 149271 - DNA, 339 bp, Homo sapiens
agtctgaacatccaatcaatatcatacagacttctcttcaaactcgcctatcattaaatcccttggtgtgaggggcttcacctgactatcacaaacattccctacatagcaaatctgaatgaattactaaaatattttcaattctttagcactagtacaacatttacattcattcttttaagttcattggaattactatattgaatacttctaaaaaatgtaagccattccctatgtcacctagcaataaggcatttaaatcaaccagagtccttagaactgattaagataagttaagagagtaacaaagtatttgaagataaaatatccaaatataca

SEQ ID NO: 149272 - DNA, 517 bp, Homo sapiens
aggtgggaaagacttttgccaccaacatgggctgtttgagcaccaaaaaacccataatggggagaggccttatgagttcagtgaatgtggggaattgtttaggtacaactccaaccttattaaatatcagcaaaatcatgctggagaaaggccttatgagggcactgaatatggaaagacctttattagaaagtccaacctagttcagcaccagaaaattcacagtgaaggctttctttcaaaaaggtctgaccccattgaacatcaggagattctcagtagaccaacaccttatgaatgcacccagtgtgggaaggcctttcttacacaggctcatctggttggtcaccagaaaacccatactggagaacagccctatgaatgcaacaagtgtgggaagttttttatgtataactccaaactcatcagacatcagaaagttcacactggggagaggcgttacgagtgcagtgaatgtgggaaattgtttatggacagcttcacactcggtagacat

SEQ ID NO: 149273 - DNA, 362 bp, Homo sapiens
agacacgggaactctcggcaccgtgtgtggtcatctggggcctgacagcatcactgcacagtcttctacagtagctgaggccagctaataacaggctttggttatcagaaaccaaaacccaacaaaccaaaatccgaatcaagacgcttacccagtgggtttctgctcaggaaattaaactgtggaagcatatacaaccaacatttgaattcaaacaggtttttgagtttcaagttggtgctttaaaggtgaacccctggctgcctggaaacttgaacctgtcagacccgctcagaacctgaggtcgggcaggctcagcctcacccacttctggatcttcagctctcactcccacatcttgt

SEQ ID NO: 149274 - DNA, 286 bp, Homo sapiens
ctcctgaggctgcggcagtggattggctgacacgcagatggctctgcctggtagcagggatttaataggcaaagcgatgcagggaggagaactgaaagggaagaatagctgtgctaagcctgttgccttctggttaaaaaaatttatagatctatttataacctgccttgctccacaaaggatttgaggcggctgccttcttgttgggaattccttgatgccaatgcttggcatctgataccatggacttcctggcccgcagcaaggggccaagtcttccttgttc

SEQ ID NO: 149275 - DNA, 346 bp, Homo sapiens
agtacccttcaccctacactttctctttggtttggtttttatttgcatcctgagcaaagggatttttgatcaatagacctcattcctttgttcctttgtgactttacagtgaatctctttatctggttttagacctcacttactagttcctttgtgacttatgatgaaatatatctgcacgtgatctctttccagttttattcaaaccctatttagtaatgactattggctgtctcagtgatttgataagttgattcatgatagttcgtgctttgtccttgggacttgtattgtttgggagcctgataatcagtgtaagattttgtgactcagtgggccttgctgt

SEQ ID NO: 149276 - DNA, 334 bp, Homo sapiens
tgctgtgggcaggagggagggaatccatggggaaggaggaaggaggaggagggcagggagcagaggaaggggagagtgaggcagaggcacagaaaaggctcccgtggaagggggagggcacctgggccagcagattgcctgtggctgggcctgtaggcagagccggggtacaagggacccaacagctgctgggcagtgagtgggggcgacgggactgggccagaggggaggaccagctaagctcagttaactggatgccctttcctgggaatggctccaggcacactccccagcccacagcagggagggagagatcagccagcagccagccagg

SEQ ID NO: 149277 - DNA, 361 bp, Homo sapiens
ccccaccttcccaacccaacatcaccacctcactttcacactttgcttctttttgctaaatgtcactggaaggtccttctgtccatggtttcctcttcttcccactctgagaccagagccatgctgcaggctatcaggtgctatgcacctgccaattgcgctctttaatgaaactctgaaatggacatggccgctggacacaacaggaggttgaccacagagacctgcacgcagggggggatgccagacctacatgtgagacagcttcaaacagcagagcttcagcccaagtcctaactcctccccatcggagctcatcaccaaaacacccaggagccccctgagaaggttgtctgggggg

SEQ ID NO: 149278 - DNA, 356 bp, Homo sapiens
ggttttccgatagatgaaacaaaaaaaaaaaaagggaagcttggccgaacaggttttatttccatttgagagtttaaacctcatttcacaaaatccagccagtccatagtctttatctcaatcatatgcttcatttagttaattggaaaaatctcagacaccccctcatttctacttggtttccaagggttgcatggcatgagctagtggatgggacagagcgggaaggacaagggatcagtggaggcctatcaagacccaaacatggagcatgtagagcacatgctgatgttcagatgtgtcacccccaatttaagtcattggtatcactctggaacattccctggaaggggctg

SEQ ID NO: 149279 - DNA, 193 bp, Homo sapiens
ggatgtggttattcttacttctagaacctaaaacaaatccatgggtttaccttgggttaaaagatgagttgaaaaagatatgctaactattcgagactgaactgtatcctcaaattcgtatgttgaaggcctctcccagagcgtgactgtgtctagagacagggactataacgaggtaactgaagttgaatta

SEQ ID NO: 149280 - DNA, 2965 bp, Homo sapiens
  misc_feature (1002)..(1002): n is a, c, g, or t
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccngtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggggacaagaagtacacctgcgagatctgcgggcgcaagttcttccgcgtggatgtgctcagggaccacatccatgtccact

SEQ ID NO: 149281 - DNA, 2038 bp, Homo sapiens
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacaggactcatagcacaccctggagagggggggcccggcggcagtcggcttagagacctaccagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggggacaagaagtacacctgcgagatctgcgggcgcaagttcttccgcgtggatgtgctcagggaccacatccatgtccact

SEQ ID NO: 149282 - DNA, 952 bp, Homo sapiens
tggaagctgggagtgacgcccgggcgcattccctcctttctcgcatacaggctcgggattagctgggaagttttggaaggaggccgttttcatgctgcttgtaacctggaacttttttcccacctgtcttttcccaacttattgacgtccctgggcaggttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcacccttcgtcggggattgctttaggtcc

SEQ ID NO: 149283 - DNA, 873 bp, Homo sapiens
aattgaggcacaaattgacctccaggctttctggtggccagagttagaacagagtcaggttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacaggactcatagcacaccctggagagggggggcccggcggcagtcggcttagagacctaccagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggggacaagaagtacacctgcgagatctgcgggcgcaagttcttccgcgtggatgtgctcagggaccacatccatgtccact

SEQ ID NO: 149284 - DNA, 913 bp, Homo sapiens
tggaagctgggagtgacgcccgggcgcattccctcctttctcgcatacaggctcgggattagctgggaagttttggaaggaggccgttttcatgctgcttgtaacctggaacttttttcccacctgtcttttcccaacttattgacgtccctgggcaggttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggggacaagaagtacacctgcgagatctgcgggcgcaagttcttccgcgtggatgtgctcagggaccacatccatgtccact

SEQ ID NO: 149285 - DNA, 1894 bp, Homo sapiens
tgttcccaagcagtgctggcactgctggttcctggtccagggaccacattttgaaatcactaatgtaaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacaggactcatagcacaccctggagagggggggcccggcggcagtcggcttagagacctaccagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggggacaagaagtacacctgcgagatctgcgggcgcaagttcttccgcgtggatgtgctcagggaccacatccatgtccact

SEQ ID NO: 149286 - DNA, 852 bp, Homo sapiens
gatgagagcgggtgaaggctgtgggtgtcctggcgtccctgggccacctgtcagcccctcgtcctggtcagatgcccacaagcgcagcaggaagagtcaggagaatgggggtgtttggtgcttggagtggggctccctgagtgtggagttccctttctagggcaggtgaacagcaagagcaaacatcctttgtgttcctaaatagagcgggagggtggtggaggtcagagtcataacagacacaggcgtggagtcgcccgggcagcacgtcgggggctcggcatctgtggactctgcgctgggccatctcactcacggcgtgtccctctgaccaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcacccttcgtcggggattgctttaggtcc

SEQ ID NO: 149287 - DNA, 505 bp, Homo sapiens
agtgtgtgctccccgaatgcaagtccattttgttgtcttaagaaaacctgacaagcataatgttgtcagaacccctgtattaggtaaaatcttacatgcacgttgcctgggatgggacccaggatagtgaacaataggatttgtactgtgacatttgaagttttcttttttgccacttctgtattctaggctctcatcaagtttttgcctggccttttgctgtagacttctgtctggtctcccacgttctactttaaatccgtccaacccaatattccacagtactatcagtggaggtctttctggggggaaaataaataaattaattaatgaagagcaacctgctgctgtatgtccttcgtttaaactttcactgactgctaagaggccacactcaccaggtcaagcaataacttatcatcatttagttcagaagctagtaaatataaatatggatagtctgtgttattaggatgtcactagaccagttaattcattaaattca

SEQ ID NO: 149288 - DNA, 379 bp, Homo sapiens
ttatgtttcctcctgaaacactcttaatccttgtttggaggaagtttatctgcctctattctaactgcctagcaaaagaaagttaaatattctttggagaaagacataatcaaaagcctctatgattgttcatgcacagtgtctagcaatcaataaagaaatatcaactatttcaggagacagggtcaaatgatgataaaccaaacaaacaaatcatacacaataaaaattatccaggtattggcattattgggcactggctttaattatgattaatatgtaaaaatagatgaaaatgcatagtttcttcagagaactggaatctctaataggggatcaaatggaaattttagaactaaaaatagataccagtaagaaa

SEQ ID NO: 149289 - DNA, 155 bp, Homo sapiens
tgtgcccggctctgcccactacacccctgctactgggctggacccctgacgtggtcatagaaacagcgcagtcatgggtctccccgtggccgtcacgggtcccctcatggtcctcatgggtacaggtccccccatgatcctcacacgtccccccc

SEQ ID NO: 149290 - DNA, 302 bp, Homo sapiens
cacctacctcctcctcattggtacagaccattgtaaagatgcacaaagttcctacggacttcccgacccgcccccttccatctacctcagtcttagggggaaaggtgggggtgaatcctggactgcgttagctccaatgagtcaccaccctgcggctcctgaccttaatccatcttagtacctgtcattgacatcctcccctccctgagtggatcgatccaacataacccccctcttcttccacctagtttgacaccaacccctgtccggttgagcggagcagtgttcggttgagcgcgtga

SEQ ID NO: 149291 - DNA, 851 bp, Homo sapiens
ctgaaaacttactgtgatttggccttaagataggcaaggccaaattattaagacagaaaggctgttggtaaagagggaagattaaataggaaagtcaaggtaaactaatagtagtctagtagcatcacctttttgtattaatgattgtctattgcctgacattttgatgagtcaaaagccttttcaaagatttatcgataagcaactttataatttctttgtagtattatacaattgcctctcaacatatatatgcttctcctatgccctttaattcccaaagtgttcagtcctagatgtttaactccttagctacttttgtaccagggatcaaactgattgaaagtaaatggtttattgtgggtcaaaaatgaggaaccaggctttgccattaagcttgattcttctaactctagctgagtcccacctggctttttcttggcttctgtaatcatgaactatttccaatagccagtggatataaggagttatagtagaaccaatggatggtttatagttgagaccctctgcattgtatgttacctatttcaagatttaagagtcattgctgggcacggtggctcacacctctaatcctagcactttgggaggccaaggtgggtggatcacctgaggttgggagtttgagaccagcctgaccaacacggagaaactccgtgtctactaaaaatacaaaatgagccaggcgtggtggcgcatgcctatgatcccagctactcgggaggctgaggcaggagaactgcttgaacccgggaggtggaggttgcggtgagtggagatcacaccattgcactccagcctgggcaacaagagtgaaactccatctcaaa

SEQ ID NO: 149292 - DNA, 410 bp, Homo sapiens
aagtagaataggctagtttgagggaaatctatgcaataaactaataatccaaagtaagaggtaataagggagtgtgaataaggaaaaggaaaactaaaggatcccatcggtttctaccttcagtaagtgggaagaaaaagcaagtttgggtacaaaaaggcataaaatgaagtagatgaggtgtagaataattagtttgggcttagacaatatggacacatttgagttcgaggtttcaataaaagaaagaccaaaaggaaaaggtctaataggaagttgactagaaagagaaagagttcaaaaaaagaggtagaaagaatcgctaggataaacatatttagaaatcaccaacatacatcaacaattttaaaactggccaagccaagtagaaaataaatatccatggtcat

SEQ ID NO: 149293 - DNA, 319 bp, Homo sapiens
ccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtctt

SEQ ID NO: 149294 - DNA, 334 bp, Homo sapiens
ggctgaggctgggagggtagagaatgcaccaaaaagtcaactaaggcaactatccggaatgattggaaatttccatatcttgaaattgcagtggcattgcacaggtatatacatttaccaaaactcacaaagctatacatttaaaataggtacattttattgcatgtaaattacctcaacaaaagtagcagggagaaggagaagggtgatctgatgtctctgaggggtgctcccttttggggaagccaatacatcatttctttctcctaagatcctccacgtggtcacacagttactgagaagctgttttaatctatacaactgtggggattct

SEQ ID NO: 149295 - DNA, 196 bp, Homo sapiens
agtgaacagaggagagggaagccttgttggaagagggcagtaaatcacagcatagctatccagactgcaattatttacttagtgcattcagggtcttgtgctaggtggtggggataccgcactgaaccagacagacaagggtcctgttcctgcctgccctcggggtgtgttttgggaattcctccttgagggtgct

SEQ ID NO: 149296 - DNA, 409 bp, Homo sapiens
ctttgccaggaccttcttgagctgctcagttgcaggaactggtaacatgttaactagcttgagtcatatttctgggtcttggagttgaaagagtacctaacatggaggtgtttgtgtatatggagatttgacttttatatttttttagaactggaggaatttgagtttatataggagaagtagctaatgaagagcaaaactgaagaaacgggggataataatgcagaacggtgtgatctgcagtgagactgagagcctggggtgggagatcaggcttaacaagagggacacctcttcctctaaggccacttgaaagaagcaggaatggggtgctagatgatggggacatggagggagttctcacaccatggcttctgtaccctctgtgaaggtagcaggtgaagtcatt

SEQ ID NO: 149297 - DNA, 144 bp, Homo sapiens
cttttagaaaaaaacatctcttacaactcctaccaccacccaaactcaagactaggtatggttcctggagaacaataatgcaaatttacatgatacattaatccaactataatgtgagcttttttttttttttttttttttttt

SEQ ID NO: 149298 - DNA, 409 bp, Homo sapiens
gatggaaattgtgaaatgtaatttagcttgaggaattgaattaatgttttctaatagccctgagatattcactgatttataggtttgaatgctgggaggtgcatttgtgtttctctgtgtgtgcgtgagctcatcctagttaatctaaataggtgtttagaaatgatgcacattctatatcataaaaatatgtattatctctgtgactggtgaatattggtatggtttatttgtgtctgtcatggaacttatacattgctttatacacctggtataaattcgtgctcaactgagaaatatttgttgaattttaaaaatcctttaaatgtatatgcatatatatgtagacatggaatcacagatgtatatatttagttctaatgttttattttcaagcaggtgcagaatt

SEQ ID NO: 149299 - DNA, 247 bp, Homo sapiens
gacacagagagtaactcatctgggaagagtgagataatcaagaaagcagagatgtcttgaggaatgccaccttccttaaacccctgcccaaatacctcttatcaagactcctgacctcggaggcagtccagtgggtaagaaatcccccaacttcccatttccccaccttactaccctccacgcccacaaactggacacatgtacctttctctattgccaggtgtgagcagtctacaggaggtacttt

SEQ ID NO: 149300 - DNA, 548 bp, Homo sapiens
atcctcccacctcagcctccaaaagtgctggaattataggccaaatgggcattttagatgttactacagacatccaaatctctacctgtaagaatatgtctcactctagattcccttcattcgttcatgcattcaacaaatattcaatgagcggggacttcaggattctgggctacaatggtgaacaagacaatgatgaactcgatgctgggtgcttttgttctaataaacaaagagacgagcaagacaatttcagatagtgataagtgctatgaggacaagagacaagaaggtgacgccaggcagggtcagggctcgtgggacacctgctgagggagggcctttctgaggaggtggggagtgtagacctgaatgatgctaatctggaagcagaagcttctaggctgagtgaggccagtagaccaagcacttgacccaaaggcccaggtgtcccagggagtgagggtcaacacgggaggctgcagcagttggtgggaacacccacacaggtttaaaaggaatgagaataactggagtctctggtttta

SEQ ID NO: 149301 - DNA, 528 bp, Homo sapiens
agaacccatctccaccaaaaatacaaaacattagccaggcgtggtggcacacgcctgtagtcccacctactcaggggactgaaatggaagaatcactttcacccagaaggcaggggtgtggtaagacaagatcacagcactgcacttcagcctgggcaacagagcaataccctgtcttaacaaaagaaaagattgatttacggaattaataaaataaaagaggaaaagagctcctcaatctgacaaaacgcatctataaaaaactcacagctaatatcttacttaatagcgaaaacactggatgcttttcctctaagattaggaaaaagacaagaaaattccctcttgttaacttctactcaatactgtaccataggttctagccagcagttagaaaaacaggcatccaaatttgaaaggaagaagtaaacctatctttatttgtatgtaacatgattttatataaagaaaaccctaaagaatccactaaaaaattactactagaataaacgagttcagcaaggttgc

SEQ ID NO: 149302 - DNA, 461 bp, Homo sapiens
tatgcaaagcctactcagactccattagttgtaaatttttggtggccattgttttcaagtaagataactcgattgcaaaaaataactcaggaaataagttatttctaaataatttcttaattcaactctcatattctattgacatatttcagatttaacttactagctttgcatctttcctttgcttgcaaatattttgatgataaattctagtctcttttgattagtaatttttctttagatgaatcacacatctatggaattctttttttaaaattccttattttcttcttgatagtttgctatgatcctcatctttaacacaatttcagaaatttaggaatgtcttacatataacttaaagttattcacaaagaaatcaacctcaaagcagtcaattgattttcaaaagcaacaaactgcttgacattacttgccccaaccaacaacagaagtctttc

SEQ ID NO: 149303 - DNA, 343 bp, Homo sapiens
caggctgggcgaatgactccccaccatccaaacacagccgcaggacaggttcggcggctgtcaaatccgatgtcccaagacaaggctctgagagtggtttcatttcatcactctgaccacaaaatgccaaaagaggacatctgtagtgtttgcaaatttctaatgcaggttacatggaaaataaatccaattctaaagtaaccggtaaccaggataaatatttggttttattttattttatttatttattttgagatgtagtctcacaccgtcaccctggctggaatgcagtggtgcgatctcggctcactgcaacccccacttcccaggttcgagcatttct

SEQ ID NO: 149304 - DNA, 292 bp, Homo sapiens
tggggcatattgcttttgagaatttagcagagagcattcaaatggagtctggatgtgatgccaaattatgcagatttggagtttattttggttaggtttcccatgagtaggtatgtaggcaacgtaatactgttctcagtttatatggtctggaatttcccttataaatgttatataggctttccttattgattgttttaaaacacaaatatgtatgattttgagaaaacacattaccagaagactattcttgataggtttttttgccaaaaagattgttgtaccaatggat

SEQ ID NO: 149305 - DNA, 553 bp, Homo sapiens
ttccctcctgcctgctgccttctgttcctctgcggttgtgttttcttcccttgtcttaatagtctaataaagtttaaattgcagccccgaacacacacacacacacacgcacgcacacacacacgcacgcacacacgcatgcacacacacacgcatgtgcacactcacacacactctgcactttcccgccaacactttgggactacttaagagagttccctccttgtttgggagtgggaactcacagcttgcctgctcccagcacgacctgtacccaactgtgcagtcatctgggtgttcggagacaaaaaacagacaagccctgctcctccaactcttgcaaggaggcatgtgttgtaggagactgtattgtgccccaaatccccaaggttccagaaatcagcctctcttcccctgccttttcctaatattttacaaatgaaggaaacatacagctgggctttgaggagccctgagccctgactcctcttcctgatcctgcccctctgaataacacacttctcattttggagctatcatttctgtatctctt

SEQ ID NO: 149306 - DNA, 279 bp, Homo sapiens
cagtctggtagtcaggtactggtcggttctctgaggaccagggatccaagagactcaaaggaagaggggtttgtgtggagccaggctagagctggttacactgtccctccaatgggtgcagcccagtgtaggcaggacaggcaggggccaccccagggcctgagccccaattaattctcattaaggataatcagacttcagatcccaagatgggcctagagccaggccctgggccagagtcagggaattccatggggctcccttggcccttatcaacac

SEQ ID NO: 149307 - DNA, 225 bp, Homo sapiens
aaatagaagttgaaggtttaaaaaaaaagaagaaagaaagaaaggggttgaggatgcaatgaactctcaaacagtttaggaaaataaagtgagaaggtgaatctcaggatacacatgagaaagagagatagggagattgagagactgtgggagaaagagagacagagagagatgggggagaggacttatactatgagagtttttgtattattctggcgactcttc

SEQ ID NO: 149308 - DNA, 142 bp, Homo sapiens
tgaccagtccttggcctgcctgattgtgcagagaccaaccctgagaacagcagtctgtcacaaatgcccaggttagcacaaaaactcactagccaccagtcatgctacaaagatcacagagagcgccatctcctagcacccc

SEQ ID NO: 149309 - DNA, 195 bp, Homo sapiens
atgagatgtaagatatgtataccagaagaattggggttatatatttgtgatttgggttgtgaagatgtattttccatgtgttttctcagatgaatgttggcgatttgtatttgtctaatgtttggcagatttggaagaattatcttgtgcacatgggcaataacagagaaagtgcttgtgtctattttgtggatg

SEQ ID NO: 149310 - DNA, 488 bp, Homo sapiens
caggaggtgcagttttcaacaagctaagctctgaaggccaccaaagaaatcagataacagttaaaattttattgagcacttactgattaccagacactgcgctgggtgcttcaaatatataaactctttttaattcttgaaacaacactactgagtcacaagataagtatccttcccaaggtcaagtaacaagtgcagtgagctgagagtcaaaacttggtactggagttcaagagaggaataaggatcagtgtttaatttgtgtattaagggtgaaagctatgggaagttcaaagagagtagtcagaaactcctaaaatcctacttttgctcaaagtctaaaatatactgagtgtttactgttaggtacatactaaacactttgcgtatacactcagccctccgcatccatagagtcaaccaactgcaaattaatgtttaagggcaagagaagatgggtgtcccagctgtgagagagaaaaagagag

SEQ ID NO: 149311 - DNA, 338 bp, Homo sapiens
tagctgggactgcagtgcacgccgcacgtctggctcattttgtgtattttggcagagacagggtttcactatattgcccaggccagtctcaaactcctgagctcaggcaatctgcccgcctcggcctcccaaatcccaccagccattctgacagaggagacatggcatgtgataccgtgtctggccatggatgggccagacataagctatcttgtttaattttcattaatgataataacagctaaccttaattgagcagctactctgttccaggcactgtgctaggtgctagttgccttatgtatactaactcaatccttgcaaacaatgtgatgagg

SEQ ID NO: 149312 - DNA, 564 bp, Homo sapiens
tgttatagtcctcagctgtgcataatccagccctttgtgggccatagccctcctctcattcaagggggagggtatcaaattatctcaaaaatcttttctcacatgggatttctattggaggaagcaaataaaactgtagctaaataaaaactacaaaataattttgcacaaagaagaaattttcttgcagattaaaaaattatgattagaaaaacttccagggtagttatatttgatcttaagaaagatgtaaatagaaattataagctaacattataggccttatgtttttagaacagaagaaataagctaattaacatttgactgtgcactgatgtttgtaccctcatgacagaatcctttaacttttgcataagtataaatcagatcattcaagaaaagaattctctatttttgtgtttagaaaatgaaataagtagtggatgacttttccagatttttcatgatctatcatagagttaaaaaaatttatttttcttatttctaaacaacgctagtggtgaattgcgtggaagatattaacaagagattcctgtagcacta

SEQ ID NO: 149313 - DNA, 751 bp, Homo sapiens
cccaggaggttgacgttgcagtgagctgtgattgtgccactgcactccagcctgggcaactgagactctgtctcaaaataaatgagtgaatgaatgaatgaatgaaaggaagtaagacagaaaagaaaggaaaaagaagcagctaagcatggtgtctgatgcctgtaatcccatactttgggaggctgagagacggaaggatcacttgagccaggagtttgagaccagcctggggaccagcctgggcaacatagtgagacatttgtctctacaaaaaataaaaacaaaattaggtttggtggcatgtacctgtagtcccagctactgaggaggttgaggtgggaagactacctgagcccaggaggttgaggctatggcgagccaacatcatgccactgcactccagcctggagtgcagagcaagagtctgtctcaaaaaaacaaacaaagaaaacaacacaaaatgagttggggggcggggagaaggagttctccaagatttatataggaagaagtacagtggtatatagtatactgctacttgagttaaaaaggtttaaaagcaaaagatgaagatgaaggagcaatgcagatatgttaggaagatttacatgttcactgtacactctgtacagcttgaattgcgttaatctttgcatagacatacacatgtatatatgcgtatatatcaggtgttttaaaaatatatgggtttatatatgggttttaaaataagacaaatctggttttg

SEQ ID NO: 149314 - DNA, 373 bp, Homo sapiens
tgaaagtggggggcctgttccaaagatggggtgcggggtgttggagaggataaagaaagggatatggtgtttgcttctaggaaccacattctctgtgggatgggggcccccagggcaagtttaaaggaaggcaggggcagggaacctggggaaggtttgtgaagcacccaggaggtcgcgcctcagaagaggagcctgcaggctgcctccaaacggatggattccgtgatgccccagagggcagaagactagactttagaaagagagaaaggacagtggcctatggagcccagaacctgggatttgaggcctgacctatctctccctgactgtgtgactgtgagccatcacgtacccaccccgtcgggtggag

SEQ ID NO: 149315 - DNA, 363 bp, Homo sapiens
ctttgtcagggcatgaaatgtaatttgccctgggactaaacactcacctggggatgttaatgtttgtgaccatctgtactactgaagagaagaaattatttttatatctatggtaaattactcaataagctttttgccatcttctagagattctgttatcaaggttcaaaaatttaattgtaggctttaactgttctgctagatttgagcactttggggcttttagattctgtggagaaaatctttagccttctataaattgaaattaacttaatcaatcaagtcattttcaggatttaaacaattttctagaaattataaaattgaaattcttttcatgataaaactataaaaggtaaaaaa

SEQ ID NO: 149316 - DNA, 255 bp, Homo sapiens
attcgcagtctaagcctatggtgtgtacagcacaacacagagggcaggcagaacgggccaggggagaggagatgcatcaatcacttttcttcccaagtccaacctggaggcgttgtgaggcaacgtctcttttgagtctaccttccaagctctcacagccaatctcaaaccttcctcttattcccttacccgtcagagcctcatcttcatgattaatgaccctcttaggggtcccagccccgtgcaccttcctaa

SEQ ID NO: 149317 - DNA, 303 bp, Homo sapiens
gaaatgaatgaattagaaggtgtagaaatcagaatcatggaggcctgatatgaagcttttgcaataattggatacatgttatgaagaccttgagtgtatagtggtgggaataagcagaaatgaacagaaagaaggtacatttctaagaggggacagtatctgaaatgaagttttgtctaactttgcattcagtgtaatatttgaatgaatgaatgctgaactttctgactctgggttattttaagaaggtggcaaaagtatagctacatgattttgaagttgggtgacagaatggagataccg

SEQ ID NO: 149318 - DNA, 978 bp, Homo sapiens
ttacagagctgagctacagtgcagttcaaagcaggccttcctttttcatcacaacatggaggagttatgtcagtctctcccatcccttcaccaagagggcctctggggaagaagcatgaccaggtttgcaccctagaatgtctgtcctcagtggtctcttctaggaccttaggggtctccctgcccaggggcagagtatggccctgcggaggctagagcttccccaagagagtgcaccctcctgacctagatattagatatatttttcctgggtggagagatatgtatgggacttctctctcttctgggtccagatcagaggtagtacatttgtgtttctagagcggaggccctcagagccctggactctgagataagagtcagcaccacccacagcacccctgcaggtgacactcccttatccagatctccccaggcaggaggcatcagcattgccagtaaggagacagaagggcacagatgaccttgaaaaggggaaaagggatgccctccctcccacaccacagctgcacccacttctccgtggcacccagttgtgtgcaacctggtatttctgccatttggaaatagctgtgatcacagtgggcttgcacatcttgcacaaagcttcttccctgataaaaaccggaaagtttaagtgtttgggataagggaacggatgggcagccatgctatgaggaaggaagtcagcgctctgcacgcatccctgtgcactgtccccttgccctccacgcggctctttgggtgaagggccgctctgtgggtgaagggcctgggtcctgggagttgaaggtgcagcacagcaaacctgagtgtaactgggagaggcccctctgcctgtgaactttaaagagcagctccgcagggcagtgccggctccagctgatcctccctttgaaagcaaactgcaactgtttctctcctgaatttaatagagcatgccaaaaaatgacagca

SEQ ID NO: 149319 - DNA, 175 bp, Homo sapiens
gggaatatattgagtttcagggaactttggaacatgctaataagcagggcataaaaggttaacctctcagggttaattacaaagaaaaatcttcctgaaactggatatctatgttaagaaagaccagtccctgagctctcctcattctttctcctgccacagtgcagaggaagac

SEQ ID NO: 149320 - DNA, 308 bp, Homo sapiens
agcagtcctcccacttcagcctcacaaaatgctgggattataggcatgagccaccatgcctggctgacaaactattttatagaaaattctggaagaataaaaaatgaatacccaacaatagagggaaagagttaactaaagaattggcttggccaggtgtggtggctcacgcctgtaatccctgcactttgggaggctgaggtgggtgtatcacgaggtcaggagttcaagaccagcctggccaatatgatgaaaccctgtccatctctactaaaaatacaaaaaattagccgggtgtgggggcaggc

SEQ ID NO: 149321 - DNA, 122 bp, Homo sapiens
atcaaagaggaggaggaggaagcacaacagtgacgtgcaagaaacgccgagcgagcaggacagtagtaaaggctacagaaaggcaccggaagggccaagagcactgttaatttgcggactgg

SEQ ID NO: 149322 - DNA, 796 bp, Homo sapiens
gtgaaacctttgtaggctcatgctttattccagaatgatggaatgcactgcaccttcaggaagctgtgctaggaaaagtctttccttggtcattagagagttaaggaagtaatggcaagattatgggcaaagttaaaacattagccagattctttgttcttgtttcgagtaattttaaaacactattttctgagcctttttttttttagtctaaacttgattttgaaaggtatggtagcttattgtagagttatagataattttaaaagtgactctatttttcttttaactacctggaagtaccatttaggctctagtaagacaaagcaggtatttaaaaaacaacttctgagtactcatttctctgttaccactcttaccttctttttctgtgtccttccctgtatccatacccaatcctttaaaaaggggaggcagagggggaagttattacagttattgtccaggttcatttatatataaagagctctccttcctggattgtactgtttctcttaaaacaaattttagtgaatatttcactttttaagtatatatgtgaaatcatttgagttaatttttaatatatagttgtttatactgttatgtttggttgaactactgttaatacatgtgcatatacatatatagcatgcatttgtatgtgtgtatatagaaaactttttagaaacttagagtgacacgatatatcataaataacgcagtcatggacatttggaaggaagagcttctactgtgatgtaaaaagatatagatatactttgtccttataaaa

SEQ ID NO: 149323 - DNA, 428 bp, Homo sapiens
ctggaggggtggacaggacagggagcttcagtaggaagaagagaggaaaggatatttctatccaggggagggggaaggaaatgccaaagagagaagggagagtcagagtggaactcttgggaaatactcccttacttagtcatcttggatgtcagagtaaagtaggtcaggcctcgattcttaacattttatttctatgactccagtagtcattacacatccccaaaatgagggctctgatccctaaaccacacaccagctgtacagaagcaactggcacaggaagtggcagtgtggtgtgatggttagacacacgggctttggcatcagatatgggctcaaatcctggttcagtcatttactagctgcagggctttggtctgcagtctgttttttgttatggccttctccagttttggtaccaggga

SEQ ID NO: 149324 - DNA, 392 bp, Homo sapiens
gcatcggttcacagtccgcccatgtaattatatgaaacctacgtcactctatcaaataacatacttttaaatatggcagaatgaggtacactagaggtttggtcatcatctgttaagtctactgaaggctgtcttattctcccactggactgaacaaatttatgaccatctgctcttgaacccacatctgtggaacgactttttgttttcttttccattttttccctagcacctgaagatgatgattttgtaacatctttggaaggagaacctgtggaacacctatctttatagaggctagtgaaactctttcgcttttgggttgactttctttcagtttctccagtaaccagactgattgtactagctgtatctacatcagattctggtga

SEQ ID NO: 149325 - DNA, 382 bp, Homo sapiens
ttttttcccttgctctgttttgattcctatctttcaaattaaaggttttcttaaatgtttgatgttccttgcctatctgttcagacttaagcctgaggcttttaaaaaagtttttatttttaaagcaagttgggaagtctttccatggtatgggcctgtgacatggtcttcctctctgagggatgaactggtgaatctggctttccgtggggaccctcagctgtcagtgtctccaggtctctcttttttaggctgttttgttttcctgtctaagcttgactgccagaattctgtggtgaattggggaaaaggagggtggtgggtgggtggtaagttatcattcagtatttaggcttgcatttaatccccatcatacctccct

SEQ ID NO: 149326 - DNA, 424 bp, Homo sapiens
acatgcagctcgtacccccaccggcaggttgtactcatcaaaagcaggtattttgaaaaattggcagtaaaatttcagagaatatgcagtataattataaataaaatattctgatgagaaacttttaataagcatttaaaagaaacaagtggccgggggtggtggctcacgtctgtaatcccagcacccaggaggccaaggcgggtggatcacctgaggtcaggagttcgagacccagcttagccaacatggtgaaaccccgtctccactaaaaacacacaaaaaattagctgggcgtgctggtgggcacctgtaatcccagctactcaggaggctgaggtaggagaatcgcttgaactagggaggcaaaggttttgatgagctgagatcacaccactgcactccagccaggcgacagagcgag

SEQ ID NO: 149327 - DNA, 224 bp, Homo sapiens
acatagaattttgtttgtacgtgagtttgattcaggtaggtttgtatcttggagtagacttgagattgctattagaggattaagtattattggaacatggctatttatgttaaattgtcatcttctttctctttgtcttcgtatgtagcggtatggtatttgcctctctagctaaagagggttctggagaaagagatcattaaagcagagatggaagatttgaa

SEQ ID NO: 149328 - DNA, 758 bp, Homo sapiens
cttctagactgtaaatgatgtctaacatgatgtcatacatggcatgggatttttcttctttttcattaagaaattattttttaagacagttaaaggctaaagtaggggaaggaatgggtaaaagaagaaacaatatgatggtaagatgatcttaaaggcagcatttagaaaggaaacgagagagacagtataagttggagaagaagtaaaaaggtgagaaataaggattttccttcagattatcttctgttatatcctatttgaattgctgaatatcataaccattttatgtttttctcttcaggggaatctggaggattcatttgggttattaataattgttgatgataagatttgaaagattgctataatcctatttgtcattaaaacttaaatacttctctcaaggatttcctagttactatatagttaccaaaagctatagtttttagcttttgaattttaatgaaaaatacattattgtgaagaattaccagaaagaattaatttagggagagaaaaggggggttaaggcatgaatgatcttgagtagtttctgccttgtggaaagtttgaggagaatatttgagtatgtttgttcgccagactgttgaagcgaattcattctcagatcaaaatctgaggtttcaaatgctgaaataggtagtaatttctttttatcagttttgacagcttattttgtgagcttattttttagggctggcttaaattctttcccctatagataaaaattaatt

SEQ ID NO: 149329 - DNA, 383 bp, Homo sapiens
atctcagggaggaaggagctggggatttgaattcctgggcctgaggaatgagggtctgagacgaggactcctgggtctgaaggaagagggagctgggggcaatggctccgatgaggaaccctatgggcacccgctgagcaccggctacccgtagctctccggccgctggggccgggtgttcacagtgcggctgggcccgcgccctgcggtggggctgtgcggctacgcagcgctgcgggacgcgttagtgctacaggcggatgcggtctctggccgcgggtccatggcagtcttcgaacgcttcacacgcggaaacagtgaggccccggcgctggacttgccggcccggacgctccaggctgggcgggtaaatggtagaggcg

SEQ ID NO: 149330 - DNA, 300 bp, Homo sapiens
ggctggacaacccttgtcctaactctgccagcactgtccacacgctttatttctttttttaatttttattcttttggtcagtagttgaactaatatcataggctgggccctggttgatttttgcagatgtggttctcaaagcttagaattgggtacggaagcaggtaataaaactgcaataagtactttcggaaaggaaggacaaagtgcttggggggctaggcaaggggtcagagaaggcactctagagcaagaggcatctgcactgaaacttgagggataagaggaaggggtgaggag

SEQ ID NO: 149331 - DNA, 379 bp, Homo sapiens
ctctgtcaccatttagcgcttctctccatgtgtctccctcttcatgtggcattttcctcttcttataagaacaccagttatactaggttagagctcaccctcatgaactcatcttaacttgattatatttgcaaagaccctatttccaaataaggtcacatgcacaggtactgaaaattaggacttcaacatatctttctagggaacataatacacgggtgttaattcctactaagaatcttgcaaccaaaactgtgtgccagtgcttgcttccagagaacccaatccatgacatctcttttctctttcttgtccataggtagagatacttggaatatttttactctttcattgcctgctccactctaagctactaaat

SEQ ID NO: 149332 - DNA, 132 bp, Homo sapiens
ctgagtttgcattgagagttccactgttcttttaggagtatcccagccatttgatgctgcttcacttattgcttgataggaacctaagactatttaactgtttgctcctagttcattttcaaaaaaaattta

SEQ ID NO: 149333 - DNA, 507 bp, Homo sapiens
tgattacactgaatataaagaataattgaaaacttatgtaattttttttcttcaagagctcaaagctacatatgcctacattgctgcaattgtatgtattacttattgaattttctaatgcaacttaaacattgattttgggggtttttaagttataaaagcaggaaaaacaaaataattttttattttttaagtacatgttttcaagtgtatgtacaagtccacttatatttaggccatactgtgcattacagtaagcacactcttgcacaaagaaattgagtgtgtaaacaatcatagcccaaggtttcccattattatgtgaacttattgttttgttttccatatacttcccagatttgcttatgctatttcctcctattgaaatgattttttcttgctcttttctgaatatccaaatgtagttcaactcaaatgccaccttctctaatacttactcatctaccactgtggtacttagtctcttctttaaatgtcaataacctt

SEQ ID NO: 149334 - DNA, 385 bp, Homo sapiens
cacatttcaatcctaatccaaaggattttcattgaactagttcactaataatctggccaacgaggaagacaaaaagggctgaccctaaaaagacaattcccatccaagcagagagagagatggagttactcacgccaagtcagaaagtcattttcgggggcatttggaaatctttggagtgaacttcccgatgctatgaacattgtttgagaccctggagacactgcctgtgtcactgtgggtttcccagcttccagccggggaactccagactccagccggggacagctgggtgtggaggagcggatgtggaggcaacgccagcagcacaaacagcagctctcctcccggccggcagacacatggaaggacagcctctttcagc

SEQ ID NO: 149335 - DNA, 415 bp, Homo sapiens
tcactatcatgtcctcaagctgaccccccacccactgctccaaaggttttctgatcttctacaagatgggaaaacgcctctgggtgaacatgacccgattgtggatcccagagcagggattacctggctcatctgccacagaggcccatttccgccatctttctctctgacgtgcaattacaccctcctttttccttggttcttgtaactgaagagccactttacaatgattttgcaaagcctagagaattgcaacatttgtgtgaggcattatctcacattcagatcattgctggctgcaaaatcagtaaagcatgctaatggttccctggaagcttaaggtttttagtagtatgtggcctaggtctctctctaacccttagataaacacagaatggcttacttcctgtaggtt

SEQ ID NO: 149336 - DNA, 742 bp, Homo sapiens
tgaaagtccctgggatctgggaacttttatcgttctgaggaacaagaaaaacagagacacctggaaaagctttgcaggaggagtggccacaggtcacctggtagcatgtacatgtctgcagggcccagctgagttctgggggatggaaggtggctccaggaaatggtgacctgaggaacaggtaggggctgagaacgtggggcctcctctgggaagaccatcgaggaagcaggacatgagtggggaggggcagtgttgtgtgagggagctgggcagcaccgggcagtgtccaagaagggtgtgggggagatggatgggtgggggcagccagagcagagaacaggtgtagacagcaggtgagagagcaggtggggggagcaggtgtagacaacaggtgagagagcaggtggggggagcaggtgtagacagcaggtgagagagcaggtgggaggagcgggtggaagaggaaggtgagagagcaggtggggggaatgagtgtagacagcaggtgagagggcaggttgggggagcaggtggaggaacaggctgacagctgggcaggtgcctcttcagcaggtctctgtgagtttctactgtggactttgcagtgaggtcagtgggaaccacggagggtgtgagagagagtgtgtgtcctaatgctgggaagctggggtttctccactgaggcacgcattgctgggaaggccaggccagatctccctgcccctgggagcccccggga

SEQ ID NO: 149337 - DNA, 408 bp, Homo sapiens
gctaagctagaatggaagagctgggattcaaatccagaaagacttgctccatagggttctcaagcctataaccagtatggaaacaggcttgacattaaatccagcatttccccatcttgtttggttatggaaccttattatcttttagtatttatagagagattagtcagttgtccacggcatggaccctgggaagtgttgcctgagtcagtttacactggtgactgcagtcttttaaacagcattgtttcagactataactagttttttctaacttggttctctgttgataatacttaaatgttatatttatttttctatttgagagccttatattttgacttcaaggcattttctattccctttcacaatgaccttcccaggaatcaaagatattgtcaccaccac

SEQ ID NO: 149338 - DNA, 313 bp, Homo sapiens
tctcaaactcctggactcaagcgatctgtctgcctcaccctcccacagtggtaggattacaggtgaaaatcactatccctggcagttttttaaaacttactgttaatttcagaacctgagaggaaggaaatactttaggaaaaaaattatgaataatcagaacatagtttatcttagagataatgaaaattataaatctgtcattgaattacgcttcattacgttgaaacttaacagcttttccatggaataaagaccacagtcttgagtaaaatagataatcagcttgacttctttgaattagttgtatgag

SEQ ID NO: 149339 - DNA, 266 bp, Homo sapiens
cagggccaaaccccttctagaccacacgctggatacctgggagcggccactgccaggggccccctcgtccccttctctggctcttcctcccgagggcaaactgtacctgagaaggaaccaaggatggggctgggtgcctccactgtgtacttgccctggccaggagccaggtaaactgaacaatacaataacattttgaccttgatgttggttttagaaagaaatgggtggaattctttttatccgccgtgggttcgagcagcccg

SEQ ID NO: 149340 - DNA, 549 bp, Homo sapiens
acaggctttccaacattgtctgtgactcttagtgattctaaaattctagcaatggcacaagattgagtggaaactctgcctcaccacaggactgaccatgagtagctcacttcaatggattggtatttcacaacttagcctggacatcggtcaagttggtaagccctgcttctggctatggctgacccaacttcaggacctggagcaccttaactttttgtgaatctaaagaaagaaaagcacacacacgtcatcatatcttcactttcagggtgttcacaatccccttgtggccagaccatggtcccaagattaagacctcttggcccacatgaccccttgtttgcctctcgacagtagaatctgctgcctgtgaccatctctggcacagcattagcctccaatcgcccctctcccggacactgagtccacatcagcactatggatgaatctgcctccaaaaaaggaatgagaggagaagacatatagggaaggaatcaaaaagaaaaggaaagaaaaactatgatgtgaacccaaagatgtgtaact

SEQ ID NO: 149341 - DNA, 599 bp, Homo sapiens
gtcgagtctgcgcacgatggctggcatgctcattctcagctctatctcatcatgctaggctagttctcatgctagggaagggtgctatgactacccaggatcatgtttataaagggcccagtgacagaatcccaggaacttaatggtgtttaatgatgtttctttcccttctcctcctgagtaaattcagggccccaggtcatctctgtgctgggctccagggctggcagcccgggccagtctccctgcctgagaagcgtgattcactgacaggtggcatccgcgaagatgagtcgagagctggctgcggaacctccatagcactctgcaggtgaaaatcccaggagtccttgggatctgcaagtgaaaaagaccgaatctgccctcgggactgggaggagacagagagtaaacaaacgggcagcggacaggtaaataccgaaggtgtgagcaggacatcccggacacacggatggcgaagatgaacagaggaggggggcagaaccactctggttggggtagacggcaaggtcctgctgagctcttaaagaaagggcactgtaggcccggtgcggcggctcgcacctgtaatcccagca

SEQ ID NO: 149342 - DNA, 320 bp, Homo sapiens
tgcaggcagcaaagctataaaaatctggatgacagaaacatagcacagtgaggctgggaaatcagctcagctaagtgaggacctgtattgaggttagtgttagaagcaggtccagaaagatagcatagtcactctgaagtgacaccaaagacagagagtcactctgaagtgacaccaaaggattttgctcagaagatgctacagaaaaaaagttacatatcaaagtggaggtcctggtatatcatgagggtgcttctgattaacaaaagccagccagctgtttggagaaatctaaatacgttaacagcctgtccttgtcc

SEQ ID NO: 149343 - DNA, 456 bp, Homo sapiens
atgacgaccctcattatcttgagaaaagaatgagaaatgagtgttttggacactgtaataaccacaacttcccatgaggaagaaaaagaaaaaaatctaagaataaagactaaatataggtttcattgctaatcaaaattgcatgcgtgcaacaaatccataatttcagttcataaaaatagctttaagtaaaagttcacagatgaagaaaaaatgtttaacacaacatgaaattcatattctaagccacctgctgcaaagatactttcacaaaactcctagcaacttctttggatcttgtttagaagacttttagatgctcccactgaatgaaaggtgttaggttaatagcgatttcctatctgtccacgtatcatcaacgtatttcctacatttggcaaccaccaccaatcccgatgtttcacaggcaagataccaagatcatcacacacatcc

SEQ ID NO: 149344 - DNA, 286 bp, Homo sapiens
tgatgttctggaggtccctccaggggctgggtgaggaggccttccccaccacctccttgtcttcctgggaagcaggcacccgttcagaggccacgttcccacaggaccaggctcctcacccccagcatcacccttttccacggggttgtgccccttccttggtcctgtccactcacacacacccgtgtccgtgtccatgttcacacctgttctgtgtccactcccacacacctgtgtccactcccacacctgtgtctcgtgtccactcgctcacacctgtactgtc

SEQ ID NO: 149345 - DNA, 269 bp, Homo sapiens
catctacctttgactctattcctattaaaaatgggttaggaaagtgctttcaaaatcaagtgtgttcatcagggaatcatttacctaagtcttcttaacactgcttagtgaatattaagcctgatatagtaaatacacgctaaccactaaattgaaggggaaagagggagaacaaagaggcatgtaaagtacacttactttttctagtaggaaaaagccaattaaaactatcacctattagttatattggaatcagtcttacaggagga

SEQ ID NO: 149346 - DNA, 315 bp, Homo sapiens
acccataagaaagaatgttcttgtaaaagatcatgtggattcatgatgcatttgtgcttactttaaaaaacaaagttggtcagatatccttaggaatctcttgtgattaaaattcctgggttgaaactctagaagagatttctcaaactttgaagcaattgtttagttaatatggacctgagagattctatgccttttaccaaaaaaaatatatcttctaggattactttgcagatgggacataggtaaaaaagcatggcctgaagtgaggagaagatgtgatgaatgacaaaggtgtcaaccctcaggcaccat

SEQ ID NO: 149347 - DNA, 626 bp, Homo sapiens
taatttttattaattaattaaaattattaaaacatgagaactttaaaccagccattgtaaatattcttagtgatttaaaggaacacatgaagatgataaggagagaagtggaagatgcaaaaaaggaaccaatggaaacctgtggatgaaaaatattagagaattttaaaactcacaaaatgggattaacagcagatcatacactgcacaagaaaagatcagagaacttgaagagagcgaaagaaaccatccaaaaatgaaacatagtgagaaaaaaaagaccaaagaaaaattatgcacagagagcctcagagactttagggacaatatcaagcagtataaaatacatacaactgtagtcccaggagggcagggatgggagtgtgggagtgttttaagaaataatgggccagacacctgcctcggcctcccaaagtgctgggattacagacatgagccaccgcatgtggcttattctgtatcttaattgcagcggtggttacatgagtgtatgcttttgtcagagctcaccaaactctacactcaaaatggctgcaccttatttcccacaattatatcccaatgaggttgattttaaaaccaaaataaatattgcctttgcatga

SEQ ID NO: 149348 - DNA, 756 bp, Homo sapiens
ccagattgcttctgttatttaagtcaatattttattgaggtataattttcatagggaaatatgcacaaatcataagagtgcagttcaaagaatttacacaaagagaacactcaaaggcacatcaagaagcagattttacagaactccaggggcacctctccttccagccaccccttgcttctccttgagtggccactgtgttgatttgcaactcccatagtgccaaattccattgtaaggttcaagagaaatggtgacagacagagcccttgtcttatccccaacctcagaagctttcagtagcataccagaagtatgatatattctcaatcacagtaaggaacttcctttccgtttgagctttcttgcagtgtttgtcaggactcagtgttgaactttattaaatatcctttctgcatctgtggccttgtggattcaggatgggtgggcagagaacctgtctatgctgggcaccgcctcgtttgcaaactctgaaaggataatggaaacacactccgtcttccacaaatgtcttcgtgatgtgtgaatccttagtctcttcctctccatccaccctaatggagtactgtaaccagcggctttttacttccgggctggccatctgggactttgggacagtggacgtgtagctgagctagaagggcttaccttctttggaccaagtgattaccctaagtaacctggccgggtttttcttctattgtgcgttaaactaggatgccctaggactgataa

SEQ ID NO: 149349 - DNA, 448 bp, Homo sapiens
ccagcctgattgttaacagtgcccccttcactctcagaagtctcctggtttagatgatacatgacatggttgccctactgagaacgcctcacagcccactctctgctgcctgcatctgggcattgaaatccagaaagccctgctctacccaagcccattgcatcaccctgcaagggctcccaaagggcactcggctgtcaggcttgtctcctcagggaatgagcagaactctggaggccgagctgatgctatggctggagtgggaaagactgaatttagtacctcctccgtaccccatgggtaagcctacccttgtcgctgggctagggtccacctaggctcccccatccttttctggggtaagacctctctgctaccagtcttcagccacgggagccttctccaaatggctagttctgtcagaaccagggagccatgtcccattgac

SEQ ID NO: 149350 - DNA, 218 bp, Homo sapiens
ccaagcctttgctaagtgaacagcaaagtgatgttttaaaaagtcagactcacagggaatgggtgaagtgggagagaagacagtagtgaagttctggaagctgggaagcagatgggtgagtgatcatttactgagcagatccgagaaagccagattccatgtcggcagtgagggaagctaaggattcatcctgtttgtgctacagaacactcaaaagt

SEQ ID NO: 149351 - DNA, 641 bp, Homo sapiens
cctagaacataaacatggatggaggtgagtcagcttcaaccacgccatgaggaacagtgccttagaagatggcagagacactggaagaatggaacctgagtcatggaatgacctcttattgtagagctgcttcgctaatcctagactgctcacgtctggactgttactagaaaaataagtaaacgtttaaatttttaaagccactgtgttttagaatctttttgttatagaagtttacccatatcttgtatttagcaagtgagagcttgagtcaaactttctgttgtgaagaaatttaaatcaattatatatgcagataaagctaaaacatcttcctacttaaaaaaatctgttataattgattttattttaaaatctatgagaacctttaagtagattatatttcagtgagggacagcatctttttttggactagtatatggaaatctttttggcagcgggaggataacacttcatgttaaaaaatttaatacatcgtggaaaacttgaaaattaaaaaaataagtaaaaagaaaaataaaatcaattcagaggagcccatcatcaatattttgtattatattcttcaagcttgattctacgcacatagaattttatttttgaaattggattatctgcat

SEQ ID NO: 149352 - DNA, 563 bp, Homo sapiens
cctagaacataaacatggatggaggtgagtcagcttcaaccacgccatgaggaacagtgccttagaagatggcagagacactggaagaatggaacctgagtcatggaatgacctcttattgtagagctgcttcgctaatcctagactgctcacgtctggactgttactagaaaaataagtaaacgtttaaatttttaaagccactgtgttttagaatctttttgttatagaagtttacccatatcttgtatttagcaagtgagagcttgagtcaaactttctgttgtgaagaaatttaaatcaattatatatgcagataaagctaaaacatcttcctacttaaaaaaatctgttataattgattttattttaaaatctatgagaacctttaagtagattatatttcagtgagggacagcatctttttttggactagtatatggaaatctttttggcagcgggaggataacacttcatgttaaaaaatttaatacatcgtggaaaacttgaaaattaaaaaaataagtaaaaagaaaaataaaatcaattcagaggagcccatc

SEQ ID NO: 149353 - DNA, 261 bp, Homo sapiens
caaagtgatacgatatgtgataatggactctgagtgtagactcttctactttattaataataagaagaaagcagttgagattagaaaagcttgtagtaaattttcattcatcacaaagtaattgacagactcacccttttatactaaggaaagtatttattgagatggtctcttcaaaggaaagaaaagcactccatctaaagttgggcaaaaaatgaccgccagttgacacggctgagtgaagcaggaccacaacactca

SEQ ID NO: 149354 - DNA, 173 bp, Homo sapiens
gcccaagcagtctgatttcagagacttcatcatgacaatatagtatacctacaaacgtgtacttccctgactttaaaatctgagtaaattgggggctgggtgcggtggctcatgcctgtaatcccagcactttgggaggtcgaggcgggtggatcacctggggtcaggagtta

SEQ ID NO: 149355 - DNA, 294 bp, Homo sapiens
caactgagctggcaaaaagaaaactaggcaagtatgacagatacatgatgcacaggctaagtgcaaaggaaagaaaaacaccaactgcagggatgagggactcacccctttagaagtttctacttgagcagctagaagactacaatgccactcatcaaaacagtgactcagggggagtatttgggataaaggaggaatctgatgttggaggtcaaatttgaagtgtctttaagacctacaggtaacgagacagctggacaaacacatggaactcaggacaaaggctctaaggac

SEQ ID NO: 149356 - DNA, 319 bp, Homo sapiens
ctgtggtaactagtactgaggggtggggaaggctacagaaatgaactaagatgccttgttctcaagggacagagagataagatagatatgtagagtcctcagaagttattaatttaatgtgctaagtacacagagggagtaattacatctatttagggagataagggggcatcgataaacacctctgctaaatgaaaaaaatctatacattcacgaactttcctttaaaaaacaacaacaaaaaaaaagccaactatttttaatgatagcctggattaaccagcacgtttcccatttcctaccactgctgggtgactgt

SEQ ID NO: 149357 - DNA, 352 bp, Homo sapiens
cgaaggtgatgggttacaggtgctgggtttctccacatgggcagtttctccccaggagtctcactccttacatcatcatctagagcagtaattaatttcagaaaccactcctggctgccataagctgcacacccacttccagaactggcttaacccgccaggaagccacagtcctcaagggacagtcacccagagctgcatgttggtgagtcagagacgagaacaaagaggaagcaatgacccctgaacacagagcccttcccagcccagagtgctgctctaagcctaacccaggctggccagggcctgaaagacaaagaagaatgccacagagaagggccagggcactaca

SEQ ID NO: 149358 - DNA, 588 bp, Homo sapiens
tgcatttctacaaggtaagtacaggacagagacagctgaggagtggaaggcaatcagtacagtgttgcaatcctctaacaatccaagcatttctaggtgagtaacagtgacatagacagtcttaggatagcctcaaaccaacttcgtgagcccttttccagttatctaaggtcctgactatccgtaatcgtaaaaaatgtctcaaagaaagaaaagagtaatgaatagatttcttctttatgggagttaaaaactgaatataattatggcagcttcaaagtagacggacacatgttggttttgctgctcttcatcctgtgctgcagttgaaaagtctgaccccaattatttgtccctgtgtgctataaaattcttaatcagagctgagtagaataagtagtctttgtttctgaagcctattcaaagaaaggcttatgtgaataccaactctgattgtgatgaggactaagagttgagaccaaaattaatccaattctaaacgacacttaataagtcagcgaacacaaagataggctggaatccttagctgtgcccagcaaaacttcttcagacctcataaattgaatt

SEQ ID NO: 149359 - DNA, 792 bp, Homo sapiens
gttctctctgtggggttctaaccttgaaataggagcatggggcttgccttccccttctccattcctccaagaaagagaaaggaaaggaagagaaaagaaaaagcatcctgtattatgtgtaagtttgtaagaatccttactatgagttctgagtacaacatctttttaactcttttctctccctctcctgcttccttcttcaatctccagctaccattcatttcctgatttcatttataggtcttaccaggcaagaaggccaagcagaaggaacctacatcagggaagtgctgggctacgggccccacctggacttggggttctgggcagcctgaacacaggtttcttagtttcctgaagtaattgagcttgttgccttaacttcagttaaaacactgatcgtgctttacttttaactgagcattgagacctcttataatattccataaggctggatattgttttgaggaagacgatttttcctcttaaccttgcctctgtgtttgtgtgtgtgtttggtcggtgtttagacagttttccatgcatggaccctgattacagcgggagcaggcaacgtgaggtgcccgcaatcagacatccagctccacatggtggcctccctgcccccagctcatccttacgcagtgccttcaaattgagtgtcttcaaaggtgctgcttagtctcactttggttgttgtgtcgctgtcgtatttttcttttttcgcagtattgaaatgttcactcctagggaccgaacactggttttagtgtccatagtggcaaaaaaaaa

SEQ ID NO: 149360 - DNA, 263 bp, Homo sapiens
tgcagctattgtaaaagaggttgagttattcatttgactctcagcttgctcactgtaggcgtatagcagaactactgatttgtgtacattaattttgtatcctgaaactttcctgagttcatttaccagctttaggagctttttggatgagtctttagggttttctaggtatatgatcattaccaacagcaaacagcgacagtttaacttcctctttattatactttctagtattctctcctttccttattttcatagaagct

SEQ ID NO: 149361 - DNA, 347 bp, Homo sapiens
aaggagagtcaagtgagcccctaactttactgtgaaccccagcactagaaccacctcagtgaaccccagtgccaggctggcacccatggacccaggcaccaggccagatcccacagaaccagtctccagacccatccttgcggatccagtaactgaggctagcctgctggagaagtcaggcagcaagcctgctcgtggactatgccagccatgctgtccggaatctctggacaggctgactggtaaagggcttcctatgttaaagctcctctgtaaagactggagaggtgactacttcttcaaatatgcagacaccagtgcaagtccataaggatctcaaatgatca

SEQ ID NO: 149362 - DNA, 398 bp, Homo sapiens
ttacatcagctccagctacatcatgctccagttacaacagctccagttacaacagctctagttacaacagctccagttacaacagctcaagttacaacagctccagttacaacagctccagttacaacagctccagttacaacagcatatgacctatcttggagaatgttccatgtactgatgaatagaatgtatattctgcagttgttgggtagaatgttctgtaaatgtctgttaagtccatttgttctagggtatagtttaagttcattgtttctttgttgactttctgtctagtgctgtcagtggaatattgaagtctcctgctattactgtgttgccatcatctcatttcctagagcttttataaatgggagctccagtgtttagtgtatgta

SEQ ID NO: 149363 - DNA, 285 bp, Homo sapiens
aacacaccattcagttagccaaggcctctgacagacatgtaagctgctttcatcttcttgcaatgacataccatcacaaaggaccatgcctccttgtgcccatgcatgaaaggtgccctagggcctcactagggtcttgcaagcagtaaggccacctgggaggctgctagtcccatgccttagaaggtacttaaccggctttttaaccagaccccaggcgtttccatgcacaatacgatttgagaccccaggcagcaatgtgctattgaaacttctaaaactagg

SEQ ID NO: 149364 - DNA, 607 bp, Homo sapiens
tgaactttccaattagcaacttcttttactttgaaaatctcatatatttctatgaaatattacatattttattaaatattacatattagtctaacgtagtagtagtggaatagacgtgatcttaaaatctgtattagctgtgtgatttttgacaaataactttccctgtgtttccaatcatttgaaaaaggactaaaagtcctaagtgacttccaacattagcgatctaataccctatcatcaaatctgtattttcagctgagagctttaaacttgctgctgtgaagtttaagggaaatagcacccattatatatcaacccgatcattttcttctgtcggcaaaactgcagagccagcttgggttgtagtaatacggtgaccgccatgtgaaacatgtttcttggtgttttcttttaaaactgccaaatatagaccttaaccagctgtaaggcagtgcttgaggtgtggagacacctgaggaagctgtgggctttctccctcgaggtgggcccacgatgagttttaagcaagacgggcaagcagtcacctggcaccaggaaaaactccttgccctctggagggagtcgccccaggaacgtgggtttt

SEQ ID NO: 149365 - DNA, 2393 bp, Homo sapiens
gagatgatgggacagctccccctcagcaagactctggcctaaatgtatttgctttatttacacaacaagaggataagcgtaaacacgggcactttcagtttgtggcactgaaggacgatctacacagggcaccctgcagaggccacaaccaaggccgcctggcttcccagtgggacaggcctaagggaggacttctggcccctttgcttgatgttcatgttttatgccttgatatttctttttggttgcattccctggagctcatgtagatcattttacttttcagaggtgctagttctggtgcccacacgcacacacacaaaaccatcaactcttctggattccttggttttaaagcttgcctcatacaaagtacagagacatctttttcaggaaacattgccaccacatgcttgaaggaccgcttatggctacacttagacatctccaaccaaggtctcttcacctccttctacaacaatgcactttgtctgcactgggacaaaaaatgacagccttttttcttttcttgtttttatttataattagggcgtggagcatttccgaactttcacgtcataaaaaatgcagcatagttaatcagcagcttgcacttctgagggcacattcacctcgggggaggaggaaggaggaggagctggtgggtgctgagactgcagtgtcctccttcccagcagctggacccagagaccaggcaccaaatttttttgatgaaattatcctaaggaaataatcaaatttgtacagaaatttatgttaaaaaatgttcatggcagcaccgtttaaaatggggagaaaattggaaacaacagaattgtagcaatacatatgatcattaaaaattatgttttagaaagatttttaacagtctttggaaaaagttggtgacatgttgctagtttttaaaaaaagtacagagtatgtacagtatgattccaattttgtgtttaaaaattagacatagtggtaacctagcttcagttccagataagatggagaaggcatactcctttcatgtctcccactgaatgcagctataaatcctggagagtagacagggagaaactatttgaggactctggaacaaagacatagtagcaatcgactggtgaagaagacaagaatttgaagtacggtcaagtatctgtgggctccacatctgtagatacaacctacatgtattgaaaatatcagaaaataaaaataacaatacaacaataaacatcaatacaaataacacaccaatacagtatagcagctacttacataacactgacattgtattaggtagaagtaatctagagatgatttaaagtctgtcggaggatgtgtgtagcctgtatgtaaaaaccacgttattttatatgggggactttagcatccaaggatttgaatatccacgggggtcctggaacaagttccccatagacaccaagaaacaactgtattcctgaaacagtcttgagttatcattttctttcttctccctctatgtatgtacatagagtgtacatacatagagtgagaagcaaagaaggtccatgaaatggaccaattcttttgaaaactgcaaattaccacagttcatctaacatgaaatagataacctgaatggtccaataactagtaaagatattgaattaatagtttaaaaaccttctgaaaggtaaatctctaccctaaatgatttcactggtgaattctatcaacacatttaatgaagaaaaaactccagttctaaacaactttcagaaaagaagagggaacacttcctcactcattatatgaggtaagcattgccctaataccaaaaccaatgttaacacaaaatatgaaacctacagaccaataaccctcatgaacataaatgtaaaaatcctcaagaaaacattagcaaatttaaaccagcaggatataaaaggaataataatacaccataacaaaaaaagaaactatccttggaatgcaaggctggttcaatatttgaaaatcaatcagtgtaatctaccatattaacagtctgaagaagaaaaatcatgattatatcaatacagaaaaaaattgacaaaattcaacatcagttcatgataaaattctcagcaaactagaaagggaaggaaatttaacatgacataggacatctacaaaaaaacctacagaaaatcctaaggagtctatgagaaaatttcctaaaactagtgagtgagtttaacaagatcacagagtgcaaggtcatcatacagaagtcatttttatatcttagcaatgtacaattagaaattaaagaatatcacagtagcttcaaaaatatgaaaggcttagaaatctaacaaaatgtgatctggatgctgaaaatgatgagatgataatga

SEQ ID NO: 149366 - DNA, 137 bp, Homo sapiens
tcaggctactataacaaaataccgtagactgggtggcttatgaacagagatttatttcttgcagttctggacactggcaagtccaagagcaaggtgctggcagattcagtgtctggcgagggccttgctttctggct

SEQ ID NO: 149367 - DNA, 350 bp, Homo sapiens
gtggtccctgctcccccccgaccccaactccttctcatcatcatcattagaaaggcctcatgagatccagtctcgtcagcactttgctgatgaattaatcacaactggctggcgtgttctggccactgtggtcttggtcacccttggcctaatgacagtgtttccagagataagaatatagaagttgccagagctccaggggcccagaaacaaccatgctctgtcctaattacatctgaatctgttcttgggggaaacaggagccactcatgtttttaaatccttggccattaaacattttaaatataacttggcctgggtaatatttaaatcctgacatttggctcaca

SEQ ID NO: 149368 - DNA, 479 bp, Homo sapiens
tgtagagacagggtctcactatgtttcccaggctggccttgagcttctggcttcaagcgatcctcctgcctcagcctcccaaagtgctgggattataggcatgagccgctgtacatggcctacattttcttaaggtgcacttttatgtgtgtgtactctggaaataccttgattacctgcagggtggccaggttctttaaatctaaaacactagcccctgtacactcgaacacacttatacgaatgagttttgtgtggttctgtggccgtcacccttgtcatttgagactcacagtaggtaaaaatcatatgcctttctgtgctcattcccatctctgttattacaaagttttcttgggaatcaaatgagaaaatatattaaaatgctcacacctataatcccaggacttttggaggccaaggcaagaggattgcttgaggccaggagtttgagaccagcctgggcaacatagcaagac

SEQ ID NO: 149369 - DNA, 294 bp, Homo sapiens
tctcactgaaggatgtccatgtcattatttggtagctaaactttatgtgcctacacagatacacacaccctgtacaaagacaaacaggtgtgaacttcagactttcccttttgagacaagtgttgatcaggacttaagataaggggctttgaaaagtagtgtgctaagtaagactttggaaggaaggtgtcgatgcacttgatacgtccttttattccctgctctttgaacatacttgtggataatgacagagatcatttccaagtggcccaaagcaacagatttcagcaccca

SEQ ID NO: 149370 - DNA, 352 bp, Homo sapiens
aagagaaatgaaaggggagtgtagaagggtcgagcagctgcattctttccaggctttgatcagctttcagtcaatccacgttttgcatgtgagagggagggggccgaggatcagtcagttgctctcagtgaatctgcattttcacattagatacacagagagtagagggggcagtcgcacacgcatttgtctcaggtgagcagatgagtgacttgtagtcctgccttccttccctacctgtgaagataagctgctgatttacactgtcagggtgaaattcaacagaaccgttttaaggtaaagatcttggggttcacaaggaatttccttgtgagtaaattgtgtgggaggc

SEQ ID NO: 149371 - DNA, 145 bp, Homo sapiens
cagcgctgacgtcaatttacaagaatgaaaagtgagaggagggtttgtgtgtgcaagagactgagttgggggcccaggtgcagtggaggtgtcctccccactgagcgggtgagccagggcagtgtggggcgggcaccatgggaaa

SEQ ID NO: 149372 - DNA, 564 bp, Homo sapiens
taaatagtcaatgttcgatacatgttcattgttaccacacccattcttcctcattacttccttcacctcctcccaaattcttctacagtaataataatattactattacaactattatcattaaaaccagaggccagtttagttagatttggtggtatctgatatgattcacattaagagagttataatgaagacctgcttgtgattgcaaaggttcacttgcaaagggataggatgaatgggatgtggattagcagcagcattataaaaaactttacaagtttcagttgagaataatctaacatgcttcgacctaaagaagcatacaagtaagcccaaaaacaaggagtagggaagggcatccaccaaccacaaggccaagggaaggcctaggtatctctacaggacagtgaagaattgtgacctatagtttaatccaccacaaagggcatgcactggtatggttggacagtttttaaagcatttatccatcctaaatgggcagtcccaatgcttgattagtagtgccagtgtaatgcctattgttaagtattttgagtagca

SEQ ID NO: 149373 - DNA, 345 bp, Homo sapiens
gggagcaggactgaaggaaacgcggcaggtgttaggcaccggtcgcggcaggacgcagcatcctctgcactgatggcccctcccgtgcagccgccccacaaatcacacctgcagggcttcccgaggccagggctgggaaataccaagttctgagccagggattactccagcctcgacttgtacagccctgcttagagcaaagtgagcttctgctcctccatccacacaagcccatccagcctcagccctgcttgaagactacgctgtccacaaacccctcccatgggccacgctggtggctccattctctgtggcctctggctaagtgttcacagctccactggg

SEQ ID NO: 149374 - DNA, 516 bp, Homo sapiens
cagtactctgggaaagctgtcactgaatactgttcccctgacagcagacatcatacatcatggataaaagtcaaaaacctaatcatcatctcctcatgggtctggtgcagaggagccatggtggcattgaggtctgggagcagtaagtggctgtgtccagggagacgggtttttgcctatttattcatgcaacaagtttttatcaagcagcatcgtggagtggaaagagccccacattgggtaggtagagacctggattccagctctgccatttgcaagttgggtgattttatctgtaaaattgaggatggtgattcttcctcaagatttgctctgtggacttaaaggaaatagtgcatgtaaaggcatctgttaatgttaagccagggctgagaaatattgatggatgtggttgttctcaaatggagaaatgattattggaagcttactgagcatggagctctatgctgggtattcaggggattttacaaggacgtattccagcacaactcctta

SEQ ID NO: 149375 - DNA, 1075 bp, Homo sapiens
gtcaacctaaggcttataaacagaagcccacaagataaagcagaaactcatcgctgccccaggccaagtgagatgggggaggggaggcctggagccccaaatgctctcagaatactctctccccactgaccaagggtcttattcttggatgagaaccccaaggagcacagtttaaaaacactgaggttttccttgggtctcttcaagtgccaacaatatgattctgtggctttatggggtcatcagccagtgctgtgaccaaacacataccaacaacctctctttccagagaatcaacttctccttgtaaccttcaacctctgggctcagtgtctccactgctatgcaatgggttgaggttatggccactcagagcttaatgtgagactgccccctgatagcctgggcttggcccaggagaagtcaccacaccataccgaatcatttttcttatttgtgaaattgaggacaaaatcactaaccagatagatcagggaggctggctagggaagttttatcccctagagtaaaagcagagggagttaggctagtgattgggttaaacagctccatcctggcagctctgtggaaatgcattcacaggtttcaccccatggggcacatcacccagaagttaaatggcttataatggccaagggctggttaagtccaagggcggattttagaaaatcctgcctggagtgacaggctgctcgcacattgaaaggacactacctccagggatcaatgacttttcgtggccttgaaattcacatagaagcagggcgtagtggctcacgcctgtaatcccagcactttgagaggccgaggtgggcggatcacgaggtcaggagattgagaccatcctggctaacacggtgaaaccccgtctctactaaaaatacaaaaaattagcaggcgtggtggcaggcgcctgtagtcccagctactcgagaggcttaggcaggagaatggcgtgaaccccggaggcggagcttgcagtgagcctagatcgcgccaccgcactccagcctgggtgacacagcaagactccgtctcaaaaaaaaaaaaaaaa

SEQ ID NO: 149376 - DNA, 147 bp, Homo sapiens
atgctctgcaattttttcttccaaatgtttttctctgactctttgggtggaggcaggtacaataaaagaataaactctgaattaccttccatttaacatctgacacctttcaaattcagctcttgaaaatccacagctctttaattt

SEQ ID NO: 149377 - DNA, 562 bp, Homo sapiens
ggggattccctaatagaatgccatggcatgaatagacatgttattgacccattcaccaatataatgtatgttggagtgcttccactattgggctattatgaataatgctgctatgaacactcacatacaaatctttgcatatacccttttttgtatgtgatatggtttggttccctgtccccgttccaatctcatgttgaatttgtaatccccaatgtcggagatggagccagatgggaggtgactgaatcatgggggtggatttccccttagtgccattcttgcaatagtgagttcttgtgaaatctggtcatttaaaagtgtgtggcagtatctaaggctaccttttaaattaagctttctgtagtaacaaaatcaggggagagatactcagttttcctcagtaccaaatataagcccccaactagagcaaaaaggagccctaaagttgcatgatgttccattaagtgttttggttgaatgcatatattgttatccacctttcagagagggacatctacccatctgaacccctgggaggtctgactgtctacaaaatcca

SEQ ID NO: 149378 - DNA, 124 bp, Homo sapiens
gtactatttcttctaatgtttcttatgagttagtaacgtatgtctctattcttagcacaatttgtcacctttattttccttaggtgaaaattgaaggaacatagatttgaagtttaaattctaa

SEQ ID NO: 149379 - DNA, 417 bp, Homo sapiens
  misc_feature (361)..(362): n is a, c, g, or t
agtcttaatacatatagcagagtacgaagatagttcggtatatattttgattagtaatcaatgaaaaataacttataaatttgtgatattttattgaaatagtaaagagtaacattagaagtgtaaattaaagggcaatagtattcctgcaatagcatttctccagttgtgagataataataattattattattttctgagacagagtctcactctgtcacccaggctggagtagagtggcacaatctcggttcactgcaacctctgtgtcccgggttcaagcgattctcctatctcagcctcctgagtagctgggactgtaagtatacaccaccacatttggctaatttttaaaatttanntttgtagagaaggggtcagggggtatctcactttgttgccttaagactggtcctg

SEQ ID NO: 149380 - DNA, 815 bp, Homo sapiens
agggtgaggcaagttccagatcactcaggagcctgcagcagagctcagggctccggactccttacccagtgctcctcacggcaataatccccaaaccataagcctcccaaggttatatggacatagacgacatgctaggcgggaatgcactttggaaaagtgcacaaggtgagtaagagtgtggggctaaggtgtttccaatgggcaaagggatgggagagaaaaagagcagtttgcttctgtccattggaagccgaggacctaaggcagcaggaagggcagaggccagcaggtgaagagccctgcttagccacaggtgactgagaggccagcagggtgtcagccctgctgaagaaaagtgctcttttcagctataaaaatgaggaagtcaggaaatgtgacattaggcaggcctttaactgattgtgggagaacagggctgcgggaggcatgccaaagaaacgactggcattcactacgcacactataccaagctgggccctggaagtgggtggagctggccatggcctggctgtgggtctctgggccttggtttccacagaacccagaagcagcctttacttcaagatcatcacagatagccctgggcatagctgttaccaggcatattcccagtatggtcttttcattctctgaaagcgtcagtcagggcaacgactgcaaaagccaaggctctcacatcagaggctgcgaaagaggaagaaggcttcggcccaggaggagtgtgcagctcagagccccctctgtgtgtgcgctgcatccttccttcccattagtctgtctacctgacccct

SEQ ID NO: 149381 - DNA, 251 bp, Homo sapiens
cctcacctcaatggggttaccttccacatctcaatggcattaccttcctcacctcaatggcattaccttcctcacctcaatggggttaccttccacacctcaatggggttaccttccacacctcagtggcgttaccttccacacctcaatggcattaccttccaccatcataggccacctgtagagaatggccaccagagagctacttaaggaagctgatgcttcagtgatggattttttcgggaggcctt

SEQ ID NO: 149382 - DNA, 720 bp, Homo sapiens
ttagctatgtgcatgaatttttggtaaaacaggacaactcatttagttgtggctgaaactccactggaaatttttttggtttgtttcttgtttattcagcctggctaatctgagctttctcagagattgtttagtgctgaactcagcaacaaaaatcagttctaggaatttgccactgctctgactgtgcagaggagagctctgattatgttttggaaataacttcagaggttttgctgtaatctgagcttgctgacagtcactgtggcctgaactcctttctagtgattgcaccctttaaataggaaatgccttccagctacttgggcagtgcgatacttgtttagttgtaggcccaggagcctcatgcaaagaaaaattcttatcagaggttcccatttcagttttctttctgggctgttctgttgcacattttgttgttgttgggctgacatgtattacagcatttctttataagcccccatggctcctcttttcagtagattaattatgttattactcaaagggaaatgttgaacaaagcaatggcgactccattttattaatcttaaaaaaaaaaactggaaataggccaggcacggtggctcacgcctgtaatcccagcactttgggaggccgaggcgggaggatcacctgaggtcaggagtttgagaccagcctggccaacatggtgaaaccctgtctctactaggaaaaaaa

SEQ ID NO: 149383 - DNA, 289 bp, Homo sapiens
cagaggcgagagccgtatgctacttgtacttctgtcagtgttggtggaaataagagacggattttacctactgtattacattcaaccagcaattggcagaacccccagctcagcgggttttcttgacttttttttctgctgtgagaacaatgggatgcaaaagggcttcagaaaaggagagcagcagatacgggattggggtcacttttcttctaattgccttgtaattggggagtggtttccactttcccactatctcactggtgggaggggaggaagacagatgtgg

SEQ ID NO: 149384 - DNA, 459 bp, Homo sapiens
agccgggacaggagagtatagagtctcactccctgatgtacttggcacgtaggagaagcttatcagtgctgggattacaggtatgggccattgctcctggccctgggtcttacattctgaagcatctgtcactatgtaattagaatattttctaaaatcttttgaaaggcttggactattgtaatcatttcctaagtttacataaagtctgtagtcactcttcctctctccactctacgtgccactgctggggtaatttggcagagatttagcttagatagtgtcacatgctcaaaaattttatctttgttgtctattagtaagttctagtttattgaactgctactgtcgattgctaactctcaaaaaaatccttcagttcactgtcagtatttccttttatgtttaatatgtttttactctttagcgaggttttatctgtggtgtgatcttatatga

SEQ ID NO: 149385 - DNA, 299 bp, Homo sapiens
ccgtccaatttattttctgaatattttccatctgctgttgctgaatctacagatgcagagctcctggatacgagagccaagtgtgctttgagagtagggtgggtgaggttgctaatgagtacaggggagcaggtgttgatcaggaggaccctgcactggggcatctggacgtcctgcctcaggacttgagactccagttggatggcacaggtagactcagcccaggtcaaagccgtccccttgaagtttctttttatcccaagctctttctggaccctggaattcggcatcccctaggc

SEQ ID NO: 149386 - DNA, 491 bp, Homo sapiens
acagagcctgcctgctgggatgtagaggaggggggttccagcccctcctgtcccgcgtcaggtctgtagcacacaagctgcctgcccagggtcctcaaatcagctgtcttcactctgacctgcaggtctcggctcctgcatactgcaagctgggtgccttccttctacagaacccatgcccccttgcaaggaaaccatggaatttccccaggagtcttcgacaactccaggccacaggaaggtcacaaatggtcagaaaaggaatgaatttgaaggaggaagaaccagccctgcccacgttgtctggggcccctcccaaggggacaggaaagctccacaaacaggacctggaacatccagggagcgtctgggctgcagaagcccgctgtgcaaatgtgggaacggaggtagcttgtctaagctagcccagaggctgatccacatcaagccccgtcacagctgctgctcctgccctgtactcccagttgaca

SEQ ID NO: 149387 - DNA, 280 bp, Homo sapiens
ggtcatcctcattgctacactcccaccagtgccgtgagagcttacaaatgccatggaaatgtcagcaagttactgtcaggcctctgagcccaaacctgcatgtattcatccagatggcctgaagaatcacaaaagaagtgaaaatggcctgttcctaccttaactgacaatattaccttgtgaaattccttctcctggctcatcctggctcaaaagctcccccactgagcaccttgtgacccccacccctgccagccagagaacaaccccctttgactgt

SEQ ID NO: 149388 - DNA, 260 bp, Homo sapiens
accttgagctacttgttccgctgtgtagtgcctcattgttctcatctgcagcatgaggctcagctttagagaagacaatgggcataaagcctgaccgtgttcctggaacccctctcgtatttgtatagctttctctttcctccatttgctacagggcacaggcacactaatgagcagcatggttttctgtttcttaacggcattgtggtatattaggagtctttggttataagagacagaaaactcaccttagaccagct

SEQ ID NO: 149389 - DNA, 379 bp, Homo sapiens
tctgcctttggggttcaagcgattctcctacctcagcctcccaagttcctgggattacaggtgcacgtaacatcacccatctagtttttgtatttttagtagacatggtgtttcaccatggtggccaggctggttttgaacttctgacctcaggtgatctgcccaccttggcctcccagtgtgctatgattacaggcttgagccactacacttcgcctgtgttatgtattttagatatagatttataaataaggaacatttctaacattttaaaataatggctgcatcattattttccaccagcagtcaacatgggtttcatttttattgcatcatcaacagatttggtgtatcaaaaaaaaattatagtggccattct

SEQ ID NO: 149390 - DNA, 133 bp, Homo sapiens
actgtggctactacagctaattggttactggctttgccaaaggaggctgtatctgtaccttctccatctcttttagcgtatctttggaaaaagaactctctctactccactgttctgaatgccattcctccag

SEQ ID NO: 149391 - DNA, 420 bp, Homo sapiens
tgcttagagactgtcctttacacacttccaaaggctggtctgattgcaaaatccaatacagatcaacctggattatctgaggtgtgtaactcagccacaattctgacacaaaaaatgagatctccccaccccgcccccaacaaaaaaaagctgagatcatttggaatccaaagaggaaatatggttttcctgaatttgacctggtaatatcacaattccatgccacagctaagcacagttacgtttccttttactgttatactgagaaaaacaagatcatttggccacatgaacatgtgcatttgatcatttaaaagctattttagtaggggggaaatgtttggaatgcttctgaccataaaaataattctgggcaggcacagtggctcatacctgtaatcccaacactttgggaggctg

SEQ ID NO: 149392 - DNA, 386 bp, Homo sapiens
ctaatccttgcttctcagggggctgaggcaggaggactgcttgagtctagtttagttgactagcctgagcaatatggtaagatcctgtctcaaaataaaaataaaaacaaaatcttagaataaaaaaatacaaaccaaagaaagaaactgtatggactaaacaccagaatgggaaatgacagagaaaagagccaggacacttgtaggtaagtcaatagaaagtatctaatctgaaaaaaagagagaaaaaaattgaaaacagtgaacaaagccttacagatctgtaggacaacagcaaggggtcttaatgtcttaatgacagttgggtcattaaatcctataagggggccaggcgcagtggctcacgcctgtaatcccagcacttt

SEQ ID NO: 149393 - DNA, 246 bp, Homo sapiens
ctaatccttgcttctcagggggctgaggcaggaggactgcttgagtctagtttagttgactagcctgagcaatatggtaagatcctgtctcaaaataaaaataaaaacaaaatcttagaataaaaaaatacaaaccaaagaaagaaactaaaaaattagccgggcgtggtggcgggtgcctatagtcccagctactcgggaggctgaggcaggagaatggcatgaacccaggaggcgaagcttgca

SEQ ID NO: 149394 - DNA, 473 bp, Homo sapiens
tatttaatagagatccttttacctaaagtagtggcagcaatgtcaaaggtgccactcagcattgcctactgggtgtgtttattacaggcacttcattttcttcttgtaaagtaattcatattcattgcagaaattgtggaatgtatgagaagttaaaagcaggggataaaaaacatggttaacattttttcttgtgaatttttgagctgttctcctataattgagagcaagttatgtatacagtttgtatcaaggcataactaaatataaattttgaattttatgtgttttcattaacattcgtaaacataatcagcattcaatttattccagaaacatttattgaatacccaatataatggttaagagtacaagttctggaattagttccctcatctgtataaatacaagtaatagtacagtactttattgggttgttgtgaacattaaaatgcttaaaactgtgcctagca

SEQ ID NO: 149395 - DNA, 778 bp, Homo sapiens
aactggctctgaggctgcacctggatgctttattagtgatggtcacttaaaatgacccttcaaaatggactgtgtgccaggaagggcgctgattcatgtgtggtatcgcctttagtcctcatggggacttagtgaggtacctgctctctgttgtctaggtgaggaaactcaaggcatgggaggtgtgctgacttgtctgacagcacaaaattagtgctgggtggagccaattcatccccagggactgtaactccaaagccccatggttggatctgttggttcccagcagtgtgggttcgaattcatgttctacctcataccagctgcctaacctctgtcaagtcatgttacctccctgagcctccctgagttttcttctctataaaactgaaacaaggtaggtaaagttttcccatgataacacctactttagagattttcagcaagaaccaaagagagcatgtagaagcatctaggaccgtgtcggctgcacggagctatctccttcaagttctcttagtcccctccttacacacagtggacagcatgactcagagggcctccctgatgcctgcatgtgctggtctcagccctgtgttccccttgaactctggcctgctcactgtcctcttgtagctttggatgtccgcatccaagcccatctcactgcacccttgagactcagctctgggatctcttcagctccagccctctaactcagctctacatgagccagtgacctcagggccacactcaggagtttgttgcctgctccttc

SEQ ID NO: 149396 - DNA, 722 bp, Homo sapiens
tctcacggttgcacctgagaagtcagctctctcctcctcctcccgcccccttcccttcctcctccctccttagaagtgaatcttatttttcttgtactgtttttgttaagagttacttttagtattctgcagtttcatgatatcaaggggtgaacttttttttattctgctaggaggtgtctattttgaaaaattattaggtatcatctcctcaagtgttatcactgccacattttatctcttttctcctttgggaactccagatgactgttagaccttcccattctttaaacaaggtcttgctgtttcccaggctggagtgctgggaccacaggcacgtgccaccaagcccgggtaattttattttttgtaggcgtggggggctccctttgttgcccagtctggttgaccttcccattattcatctattttattttcctttgcttccattatctctttgtgttacattgcagataatttcttttgctccatcttctggttcagattttcttcttagtcacatttcatctgttgctaaactatccactgagttaaattttaggtattttatttttaacttctagtttttttcaaatatgcttttatatttttctatcctttaagtattttctaacatcttttatatctgtacgctcactaaatctttctccagttaatgttttctttttttctttttttttgagacagagttttgctcttgc

SEQ ID NO: 149397 - DNA, 228 bp, Homo sapiens
catggcattttattgtaaagtacctggaacaaaacccagcacacccagtagatgctaaaaaccacatgcattgcatgtattcatattataaattctaagtagagatttttttctaagcatatagaaaagtgtgtttgtatggattatgtaaagaaatatgtaggctagaaaaacattaattgtaatactagtggaaatactaattttcagtgttgaagtatttggtgt

SEQ ID NO: 149398 - DNA, 357 bp, Homo sapiens
ttaactataaggcagcttccagttatgactgaatggtcttaaaacatccatattatttttttagacaaaggaatgctctatactgcacagtcagaagttagatcttcctgagttatggcaaagttacgacactggggtcctcatataaaagcataagactcagcaaatagaggacaatcttcttcacgcatgcataaattagaaggagctacagcctgtcaatacgatttcagacacacaaaatcattgtgaggctaaacttagcagagacccatgaaaatacccactataggatcagaccaattaactgatcaaaagagtagctgcaagaaatttaacttatttaatatataacca

SEQ ID NO: 149399 - DNA, 138 bp, Homo sapiens
gccagtgtagctggaacagggcaagaagcagtaggaggtcaagtgaaggaaaacaaaacaagctcctggggtgaagtgacagtttgctgtatggactggatatctatgttcatttcctcagcttccatcgtattatag

SEQ ID NO: 149400 - DNA, 181 bp, Homo sapiens
catgttttcacttagggggcagcccttcctgtcccaccatgactgaccaattacactagccaaacctcaccaactcctaagttcagagccaggcctggctctgaacttaggaacagctgcctgactgcctgaaaggttgtgatgtggtagttattccggctggagtccccagaaagccagg

SEQ ID NO: 149401 - DNA, 197 bp, Homo sapiens
aaggcttatctcctctcagataaagaccaacagtccttggatggggacagccagttggctgtgaaatgcatgcagagaagctgagcttcagcctaagagaagagcgaattaaagtgacagaagccctttgggaggcggaggagggctgactgcttgagcccaggagtttgagaccagcctggacaacatagcaacct

SEQ ID NO: 149402 - DNA, 393 bp, Homo sapiens
agaactcataaagaaaactagaaaataatttgaaattaatgaaaacaaacacatatagcaaaatctatgggatacagaaacaagtaactacatttaaaaagaagaaagatcttgaattggcaacctaaacttctacctcaagaaactataaaaagaaaactcaatacaaactaagcagaaacaagggggaaaaaatacagctaatacaaatgaaatatagactagaaaaataatagatgatcaacaaaaccaaaagtttattctttaaaatgatgaggccgagcacaatggttgacacctataatcccagcactttgggaagccaaagtgggaggactgcttgaagccaggagtttgagaccagcctggaaaacatagcaagaccctgtctct

SEQ ID NO: 149403 - DNA, 966 bp, Homo sapiens
gtttcctgttgtttgtttgatgatctcaaatggagtccacaggcgtgcctgccaccacctcaacaccaagacgtgctgcacaagggagggggtggtacaagaacaggaggagagacatagacacagatccatagggggaaaaggccatgtgaccacagaggcagagatgaagtgctgcagccataagccaaggaactccaagattgcaggtcaccaccagaagctggaagaggcatgaaggatcttcccctggagacttcagagttggcttctggaaaagcccaaaaggatgtgtcttcttcatctctgaatcaaccaaacttcagttcccatggcctgcaagaactgtctccctgttctcagcaaattgtaccccattcttccaatcactcaaacccaaactctggaaatatctttgatccctttcttcattgacttcacatctcatccatcaccaatattctcttgcctctaacttcaaaacatatccagagtctctgcatatcatattcatattgctgaaaagcaattgtaacaggaaaaatctaagaaaaaaaagaagcattgtatacagaagtacaaagataagaaaaacagctgacttcttctcagaatctatgcaagtcagaaaagagtggaggcaaaatgaaggtaaagacaacaccaaatgcaggtgagcagatcaacaggaactctcattcgttgctggtgggagtgcaaaatggtacagccactttggaagaaaatctggcagtttcttacaaagctaaacatcctcctgcaatacaatcctcaggtaattcccttggtatttactcaaatgaacagaaaacttatgtccatgcaaaatcctgcacacaaatgtttatagtggtttatccataagtgccctaaactgaaataatgcccgtagcggccacactttttttttttaaattaatataataataaataattttaatttta

SEQ ID NO: 149404 - DNA, 367 bp, Homo sapiens
ttacactttctgggaccaaaagccatttctaactatattaaaaccagaaaaagaaaaacacacacacactcacaatgctgtcagaagagctaatataatttgtacaatggaacagtgttttttgtttaaccaaataagaacgctgcagcatcgtttcttgagagcttatctccactctaaaattcacatctgttaatctcagccttaatcaattggtgtaaatgttacagaaagggaaggagcccctgtcaacaaatgaatcatactaacttttctctgaggcttctcagctctgatccggctgctgaaacagttgagctgaggggaaatctccaatagcttatttactttatggtacagagtatca

SEQ ID NO: 149405 - DNA, 477 bp, Homo sapiens
ggctaatgcctgagctcctgccctttctatgcagtgagggtcaagatcctcagctagtgtttgagggaactggtgtaacctgggtctctcattttctaccatccaagttgccacctctgtcggggtcccactctaatttgggcagccactaagcaatattttgaaatataccttgttcatgagtttaaaggatcaactggtaggtgtgtccattagcaaatcctatggaacaaatatctgctcttcctaacccaaataactagcatgcatagcgggatctatgctcggtccgtacgtcactcagtgactgggaaggcacgctctccatccatgacagtgtcatgtgctctgaccgtaccattagcctgaattctactagtccctccacattccatttccttgcgcatgggatcgcaaagagaaagacctagtctgtgccggacatgtctataggcggggggtggatcactgtatgtt

SEQ ID NO: 149406 - DNA, 437 bp, Homo sapiens
agttgggtgggcctggagggtgggcagccagggactacctctcgtctcagtggtgttcgataagcaatttaagagccagatcctgggggtctgaaagtgatgaaaacccagcccttgcccaaataacagagcctgaggctttctattgcccagcaagttgaactcagcagggaagtgaaaaggtgtcagagagaaactcagggcataagttcccagcatttattattgtttatctgtgcatgtcagataagagtacagtggctggagccccttaccctgtccatgtgagcaagaactgcatgtaagggtgacaaaggaatgaatttccatatccattagaaaactcagctcccagatagcaaaccctgaagagagacatgcatattgattcttgaaatgaaatattttcaagctgacagtttggtagcaataaacgt

SEQ ID NO: 149407 - DNA, 876 bp, Homo sapiens
  misc_feature (24)..(24): n is a, c, g, or t
  misc_feature (191)..(191): n is a, c, g, or t
atgtgaggaagggcatacggagantagtgaaataagtgatagggaatgacgctgttgagagaggtgtgtgggcataagtgaggactagtatatggaacaggttctgttgggtgggatagtggcatggcattgttgggggaaacgaggaaacacggcgttaaaagtgaggggaataaaggataacactaaanctatatagtactaattgcaatagaagtagagggaagcgaagggatcaattaattaaacctctcactagaaggcatatggggtcggcaagaagctccaaccgtttgagggccacaagtagggcggaaggtagtttatttatgttcattaattaagaaaagcaataggtttatttcttaagagaagaaataatattaaattgtatgcaaaatttaaatcagagaatgaaaaaatgaagaggaagaaaaaacgagtaagtgcaataaatacaaaataataaaatcatgattgatattaatattaatgcagtgccataaatatttgctttaaatgtaaatgttctaactataccaattaaaggcaatgatttttttttaattttattattattatactttaagttttagggtacatgtgcacaatgtgcaggttagttacatatgtatacatgtgccatgttggtgtgctgcacccattaactcgtcatttaacattaggtatatctcctaatgctgtccctcccccctccccccaccccacaacagttcccggtgtgtgatgttccccttcctgtgtccatgtgttctcattgttcgattcccacctatgagtgagaacatgcagtgtttggttttttgtccttgcgatagtttgctgagaatgatggtttccagtttcatccatgtc

SEQ ID NO: 149408 - DNA, 328 bp, Homo sapiens
tgatcaagtgtcagggagaggcccaggcgacgggtttcctgggggcaggagggccgggggcaccgacagataaacaacagaggcaagaggagcaaggggcaccacagatgtaacacacagggagtgaggggacagtgagtgagggccacacggtgtgggcagcacagactcgcacaccgtgaattcacctgcacttcaaagcagccctgtgaggcggggtttctcattccaatttttactgatgaggaatctaagtctcgagggatgaaggaacttggccatggccataaaactggtcagtggcagagctgggatgagaagccccatg

SEQ ID NO: 149409 - DNA, 444 bp, Homo sapiens
taaaaccaatgagactgcaaaataccaagtgagggttaataaaaacatggacaggaaagggacaaggatagataagaaaaatgaaagagacagaacacacggtgactggtctgagggaaaaaagggagcagaaaactgttcaaaggcaactggtgttttgagtctgggttacagggaggttagccaagcaaacaacagaggtaggagtaggttgagaggaaggagaccgtcaggggtgcagatgggttgttttacctgtggtgactttcagatttagggagagatttagagatatcaaatggacaactggagatgcaggagaatcttatatgcggagggttaatttttcagtccataatggtgattcccaaatccatatgaccatcagaatcagctggggaacctgtcctcccccaaaagtcccaccctaagaaatcctaagta

SEQ ID NO: 149410 - DNA, 382 bp, Homo sapiens
gcggccgcctactactactactgctcgaattcaagcttctaacgatgtacggggacatgtcttactttctggctatagtttttaatagacttttcaactatatggctcattttaactgaaggtttaaaaagtcattttgttgtctcagaggtataaaattaccatcaaataagcagacatatgaaggaaaagaaatataaaatgcttttctggacctctaaatgaattgttaaaaaccctgcaaaccaaagcaacatttctcctctgaaattatattttgcaaacatattttagaaggaaaacttgaactgtcaaaagtagtgaaatgtctccagtgtttatggatgtaataagtgaattagctgaaaccccatccaaaaaa

SEQ ID NO: 149411 - DNA, 329 bp, Homo sapiens
ggtgttcacagtcaggtgaataggaagtggcagtgcaggtgacagtgtttggggtgtagacagagttctgtggcaagaaacacaggggccctgctgaatccagttattgctattcgcttatcagtcttccttccaggggacctcttttgcaggttctttcattgggaagaggctctgtttaaggacctagcttgctgtctgctgccctaggggctgaccatgctcttcagcaatttgggttataatgtgaggcatctattcttatttctagctttcttccttgtggagccattattggacttaggaagttggacttgggcaagtcactg

SEQ ID NO: 149412 - DNA, 354 bp, Homo sapiens
tactcgtctactcatggcaaatctaaaaccttctacttcagcttaggcaagacatcttcttgggtcagtggtagatgtgaacaatcttcgtgggtcagtggtagtttaacagtttgttaaactgttgttaatcaatgtatctactctcggtgattttaagagagaaaagaagactttttgtttttgtctgagaggagtttttaacctggaaagacagctgaaacgttatctgaaatgtgaaatgttaaacattttattattaagagacagtgtgttttttattttactcacacagtatgtgtgcatttgtgttttctgcgactgcacatttgtaataataggctcatattttgt

SEQ ID NO: 149413 - DNA, 461 bp, Homo sapiens
ccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggca

SEQ ID NO: 149414 - DNA, 492 bp, Homo sapiens
tgtgaagagatcttgaggtgatcctttcttctccatggtcaggcagatatccaggtatttggagtgcccacttgtctgattcaacagcccgacctgccccaccattcctagacatagatagtggtgcagtgagaccctctctgcttcatgtccaggcagatcctgaggcattcagagcacctgtttccctggttcagcagcctgagtcataccacccctccatgcagaaatcttggtgcaggggtgctgtctctgccccatgcctaggaagatctccaggtatctagagcacccactctcctagattgagcttcagctgcccctattaccatgcagagatcttgaagccaaggtttctcagctccacatgtaggcacacttctgggtacatggtgaccacccactggattctcctttggcactggtgcttgtgcctgccatcagggaacctgctggcagacttgcttggtccagccctacccttcatggctc

SEQ ID NO: 149415 - DNA, 419 bp, Homo sapiens
taccgcatacaggggctgagcggcgggagctgaaaaccagacattccggtgtcaggctgagcgctccagtcatcagtagggaatagcagaataggcacgagagggcacctgtacaccttcagaccagcctgagtcataccacccctccatgcagaaatcttggtgcaggggtgctgtctctgccccatgcctaggaagatctccaggtatctagagcacccactctcctagattgagcttcagctgcccctattaccatgcagagatcttgaagccaaggtttctcagctccacatgtaggcacacttctgggtacatggtgaccacccactggattctcctttggcactggtgcttgtgcctgccatcagggaacctgctggcagacttgcttggtccagccctacccttcatggctc

SEQ ID NO: 149416 - DNA, 264 bp, Homo sapiens
cctattgctgtgtcctcttaacagaggaggaagctcagacttagatcccataagtggctcacctccttaagttcccacagttggagttagaagaatagcaggcaagagaaaaggacctcagaccaaaacacaactgatcgaggctgccccatctctcctgggatttttataaagggcccctcaagtaccaaattcctgtaaaacacagggataataattagaagcctggacagttccataaagaaggggagagggaggagaggg

SEQ ID NO: 149417 - DNA, 512 bp, Homo sapiens
ggcagatacctctactgctcagatcacacaaggtaatgaacatgtgaccgggtctggctacatgactcttgcggtccagtgcaaaacgaaaacacaggctcttgttcaaagtgactatgaatttcaagatgaccatggcagaacatgaaagcaagcatggggcccttctgggcaccagccatgtatgatggcacaggtcatgtgtgatggcacaggtcacgtgtgatgacacgggtcacgtgtgatgacacaggtcatggcctgagaggccggccctgtatgtgtgctccatagacaactactgtctgtgatggtcttcacagtggagcaggcgtggccttgtgcaggggaccccatcctgcaccccaacctgttgaaagccttggcctgtctcgcctcttaggtggcctcatgacagagttggaacagacctgccagtcaataacaccaccctctgaggacaaagactttcacaccccaggcatccaagcaggcatttgccaacctcaggc

SEQ ID NO: 149418 - DNA, 658 bp, Homo sapiens
actgtggcccctccaaccaccctactttaagtggggtgggctcctaggggtacagaacgtgacctgcaggtatgagctccatccaccttgggtgccattaacgtgtggaaactgtggcctccgctacaacagtggatccaatttatccaccaaatatatgccgtgggcctaccaagtaccacaatggttgctacggcttaagtaaaagtctggtagttccaccgtcctcaaagccttggtttactggtttgataggcagaaaactgaaagaccaaaaagagaaacatcctctggatgttggactggcatgtggggcgtcacgctcaagtcacttgttctgtcactcagcctgccctgtgctgtgcagatgttccgaggtgcagtggcttcaggtcacagccgactctggggagcattttaagttccagagatgctgtgtgggtcctgctggctacacagccaagagtgcaggatgtgggtttgtggggacacagaagcagtggacgctggtgaaagtgcctacctgtggtctcagggagatcacttctcttcgtcctgcaattcaaggatgtcaacctgagagtagatgtcactgtgacatcctggaatgaggcttttctccacagtctcttctccaaggccactctcccttcctcct

SEQ ID NO: 149419 - DNA, 303 bp, Homo sapiens
gcatgtgccaccacacctggctaatttttgtattttttgtagagacagggttttgccatgttggccaggctggtcttgaactcctaggctcaagcaattcgcctgcctcggtctcccacagtgctgggattacaggcatgagtcactttgcctggcctctttcctgagatgcatggtgcttatgataagcacacattatgtctaggtccctgcttcaagtgtggcactttggacacatgctttccacattccgattttgtgccaaaacctatgagatgattgcaatgtgggaatcatggatgg

SEQ ID NO: 149420 - DNA, 465 bp, Homo sapiens
tcaacgctttatacttcttattcaggcattaggagggcataagtctggtgatcctgcttttagtgatgctaggattgactagccatgtgcatgattgtattttcctcatggtttagctctatttatgatgattgccctgaatcacttatttcattaagagttgcaaatggccatttttctgattcttttattccttctaaatttagtgcctggaattacagtgtaatgaaggtctcatcactcggattgtttggttaccaaaaatgcaatttagtattttagcaaaaatacagtgggaaggataggacatatctgattgttgattttttttttttggagacagagtcgggtttggtaacccaggctggagcgcagtggtgtgatctcagctcactgcaacctccgcctcccagtttcaaatgattctcctgcgtcagcctcccgagtagctgggattacaggtgc

SEQ ID NO: 149421 - DNA, 1149 bp, Homo sapiens
tggccttgaaaaatgacaccccacattcctggagcggtactggagccaccagagtgagcagaatgaagctgtttttaaagcctcattcccaaagatttgtcctttcggaactgtctcgtcagacctgtctggtaatactctggaagactccacatgcaagattgtctgtatttgacctgacttggagatttactggtttctggtatttacagaaatctctgtcctatccttactcaacaaccaagctaaccaaatagagacttcagttgccacaagtaacaaagagtacagactttgtagaattagttcaaaaaaattattaaatatacaaaacagctaaaaaattgcagcaccaacaatatactctggggagggagataatgattttaagaggtgtcacaatgtattattttaagtagtcatcaacagaaattacaaggcatgtaaagaaacaaagtatggctctataataggaaattaagcaactaatagaaacggttccgagaaagtacagactttagtcttactagaaaatactttaaaattggttattttaaatgtgctccaagagctaccagaatgtgtgtctaaacaactgcagtaaattatgaaaccaatgtctcaccaaatgcaaatattcacaaagggatcgaaattacatatttttgaaaaatttatagaaattctggagttaaaaagtacaactaaaatgaaaatttcactataggagctgagcacaaaatttgaagaagcagaagagagtatagcaaacttgaagataggtcaattgatattatctagtttgaagaacaagaagaaagaaaatgaacacagctttggaggcctttgggacatcagcaacaaaacaagatgtagattagaagaacttcagaaagaagggagaccagaaagggatagaaagaatatttgaagaaataacgaatcaaaacttcccaaacttgatggaaaacatcaatctacatatctaagaagctcaacaaactgcaagtagagtaaactcaaagagatacacagtcagacacatcataatcaaactgttgagagaatcttgaaagcacgagagagagacaagtcatgttcaaggatcctcagtaagctgatttctcacaataaaccacgatcggccag

SEQ ID NO: 149422 - DNA, 467 bp, Homo sapiens
caaaacccaaccaaatgtcttctttccataggcattcaccagttcttctagatgatggtcactcctttctccatgttcccattagccctttgctcattactttattagagccttagcatcttctctttcagtttctttcctatgatagaaggaagactctggaaggcagagcctatctcagttttctttgtaaccagtatctagcatttctgcctggcatacagtaatcactttgtacacaagtaccgaactcaatacatgaaattgagttgtatctgatcacagatacgtgtgggttggaagggttaaggagtctggaaattgcttcatggcacaaggtagattttgatattgatcctagaatcacaggtttacaacaggcagagacagaaaggctggaaactccaggtagagaaaacagcataagaaaaggcatggattaagaaaacagagggctgggcacagtg

SEQ ID NO: 149423 - DNA, 254 bp, Homo sapiens
gccacacgcacacactcactggcatatgcacagcacacacacacgtccacttactcccattacacactcacatgcacacacatatgcacaggcacacccagacacgcccacttattccaacacactcacatgcacacacatatgcacaggcacactcagacacacccacttactcccattacacactcacatgcacactcacatgcacacactcagacacgcccacttactttcattacacacatgcacacaca

SEQ ID NO: 149424 - DNA, 657 bp, Homo sapiens
  misc_feature (63)..(63): n is a, c, g, or t
  misc_feature (71)..(71): n is a, c, g, or t
gagttcgacttaaaataattttcttaatttttaatcatagaaccaaccccgtcgagtctacgnttcatagnattcaagcaccgcgccctcctcagcagcctgagcatctctacagggatccacctccacggaagagagctccaggtcttgaatctgcctgcatcctgctgcaacagcagctctgatgttttctttgccttcctgccagttttcctgttcgtcgattctggctgcctttttgccgaggccaactagcaccacgctggggaagtcctgatgcagaccataaaagtttcgagtcttgcctgccttcagaggtggtccagatatgttcaaagtctctctcagctttccagctatcaatttatcaagattctctcctgcacttgtgaactgtggcacatcatcttctttttctttggaatagattcctaaaacaaggcccttcgtcatgtctgcagcggagagaccccggctcccgaaacatctcacggccagacgtcagacgatgactcgccccacccaatgtttgtattttagtagagagagggtttctctatgttggtcaggctggtctcaaacctcgacctcagttgatctgtctgcctcggtctcccaaagtgctgagattacaggcgtgagccactgcgcccagcc

SEQ ID NO: 149425 - DNA, 571 bp, Homo sapiens
cagtggagcagaatgaatggaacccacatgatccgctggggtgcatcctggtacgcccttgccctgctgtaattgtgaatggacacatgcaacaagcccagccttaggagagtgtgatcatcaagggctcacacctctcaggaatgaagagttggttcacaccaccaggcacctggaaataccactggcccaggagcaccttacaccatgttgttggcttcaggtcctctgggatttctcagttaaaaaagaaaagcagaccggcgcagtggctcacgcctgtaatcccagcactttgggaggctgaggtgagcagatcacctgaggtcaggagtttgagaccagcctggccaatatggtgaaaccccatctgtactaaaaatacaaaaactcctgggcgtggtggtgcgcacctgtaatcccagctacttgggaggctgaggcaggagaattgcttgaaccctggaggcagaggttgcagtgagccaagatcgcaccactgcactccagcctgggtgacagagcaagattctgtctcaaaataaataaataaataaataaataaataaat

SEQ ID NO: 149426 - DNA, 167 bp, Homo sapiens
aactgtttcatgccagagctgagaaactgtgatgaattaagcaatcttcaatcatgtctctcaaccaccttttcttgataggaattcagcaaactttcctcctactcctgaagtataactccaaaaggagttaaaagtttggtgtctctggaggcagagaaatctta

SEQ ID NO: 149427 - DNA, 476 bp, Homo sapiens
tccttccacctaagcttggtgagctttggaactggtggtaagaactgatccaaagtgtgtgctttaacaaatccttccaaagaaaacttggaaatcagctatttaaacttggagtccacttctctgtaggaagggcattcatttgaacacaaatttagttcctgcgccataatgtgcagtgttaagagtaaccctgaacaatgcatttgctgcatggaatagctttctcagtacaactgtgtagtgctgtagagctccctttttgcccctggaattagccccaataccccccgttgacagcttcaacaagtgggatccaggtatgacatctgagaagtgagtaaaataaggctccagtcgacaatggggcaatggaagtggccaggcagccaggctctgggcagcaaccacaccagaggctagctcctggaggcaaactctatgattgatgtgatgaagtggggaaagggaagggg

SEQ ID NO: 149428 - DNA, 400 bp, Homo sapiens
caaccaaccaaacaaacctcacaaaactactgtctgcagttttcaagtgtgcagtatattgctattaactgaagtcaccgtgatgtagacttcttgaacttattctgcctgtctaaatgaaattttgttttctttgaccatcgtctccccggtccccccgctctccagtccttggtaaccacaattctactttctgcttctatgagttcgacttgtagagtccacttagaagtgagatcatgctgtgtttgtctttctgtgccttacttatttcccttaaaataatgccctccaggtccatctatgttgttccaaatgatggtatttccaccttttttaaggctgaacagtactccactgtgtttttagatcacattttccgtatccatccattgatgca

SEQ ID NO: 149429 - DNA, 185 bp, Homo sapiens
acccccgcctgacacctcctctgataccctctgcctgacacccctctgcctggtaccccctccacctgacacccctctgcctgacaccccctctgcctgacacccctctgcctgacaccccctctgcctgacagcccctctgacaccgcctattttacaccaacccctgttcggttgagcggaga

SEQ ID NO: 149430 - DNA, 300 bp, Homo sapiens
caaggcctttttagttcacccaaaagccagatgactcccgatatgtgggcaagcccaacgaagatcagctactttatcaagattagctgctttcattttttttaaataagcctatttccgataattgtaggtttatgatcagttgctttgcttttcaaagtataacatgcatactaggatcttgttagaatgagattctgattctgtagttttggaatgggtttgagaatctgcatttctttcttttttctttctttctttttcttgagatggagttttactttgtcgcacaggctggag

SEQ ID NO: 149431 - DNA, 248 bp, Homo sapiens
aaggcaaacgggtcactggaggttttacggccccagctctggccctctgcctccctctctctcatcccaccgggggctgggagaggccagggccttcccccgagagttggattgtcatctgacacactgtggacagttgttctagcccaggtcttggggaacgaaacctcactttactttttctagatcttctcccttcatctctatctccctcttctgtctctctgtctctctgtctttctgtgtct

SEQ ID NO: 149432 - DNA, 340 bp, Homo sapiens
gaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcatta

SEQ ID NO: 149433 - DNA, 122 bp, Homo sapiens
cattctcagaatgagaaagacaatgaacaataaaacaacacaaagttcaaaaataaatattaccaggaatctgagatgaaattaaggatatgcagcaatgaaatttaatgaatttacctttg

SEQ ID NO: 149434 - DNA, 257 bp, Homo sapiens
cccgtgctcaggaacttccagctccgtccctgtggccagtgccctgacctcggggtctgacagcccctgtctagacactgccatgtttcctgctgcctggactctggcctgctgcccagatcctggcctcagccctcactcccttcattcggctcaccagaccctggaatcttgccaaagcccagctgcaggtgcttatctgaatcacattcagcttttaaatcccccaggtggtagcccaggggtctatacgccca

SEQ ID NO: 149435 - DNA, 389 bp, Homo sapiens
atgagctgttcctagttcctccctccccagcccatcttcagctagacctaacctccctctattctaaagctctgggaaagtctggagctaagaccattaatttcaaggctccctggaccaccttaaagccaggaaactgatccatcccacacctgtcttcgtttctctcttcttttccataagacctcttactcatcactggcccaccgttggctggctttctccacctcagcatttcgcactgtgggttaccatgtggctggatgtgctatgaggaaaacaatttcacttcctttaaaacctgccatttgaaaatagtaacaccctggccacccaaatgaaaaaagtgagacttttcaaaaggaaagaaggaaaggaacaaagaagga

SEQ ID NO: 149436 - DNA, 512 bp, Homo sapiens
agttcctaaattccatctctccagagggaagaccatgaataataattgaaaaagcacagcactgagactcagataaccctgggttcgagcctcagtattgtgttacccagtacctttgggcattactgtgttacccagtacctttgggcatgttagttggttccttagaggggacttatctccctcatatcccttcttgtctgcatcttcagaggctcagtattcttatcttaaaataaggacaagaatatcttcttagcagtgatgttgtaaagattcaatgagataatgtacaaagctggcacagacagactctcaataaatggtatcttcaagactcttaacaacaaggctgggcatctgtaacaggcctcactactccatgaaccgtaacaggacatctccgtaagttgggcccaggaggccaaagtacagtgctgcaggagacccaggccaaaccaccagtctcagggctacctggatggagcaagatggtggctcctgaagttgga

SEQ ID NO: 149437 - DNA, 144 bp, Homo sapiens
tatttaaaatagtatattataaaattgcttgactgaagtttaacttctaaaaaatttgtactaaactgagtttttctgttcagtttcataagtgcttcttaaaatagacatgcattttgtggtagtctgttgaatgctgtttgg

SEQ ID NO: 149438 - DNA, 433 bp, Homo sapiens
ggctcctacaggaactttgggtccttttcctgctcctggcctcagtttctccatctgtaaaatgaggaggaggtgggtgggaggacatataacttgtagacccaatgttatatggaaactagggtcctgggattgagagtttttaaccctgactgggaaccatcatccctgcagcatgtgttaaatgcaggttcctgggctcaggctcactaatcagagaatctctagggtagggcctctgagtgtacatttttggggcaatttagaaaagggagattaaatgcacagaactccattttgaagtacacagttcagtggtttttagtatatttgcaacattctgcagctgtcaccactccctcactcaaatgccccgagagattccaattgctgccggtccctccgggcagccctacaggtgcatgtcctgagg

SEQ ID NO: 149439 - DNA, 239 bp, Homo sapiens
ccccgactagcccgacatgttccgacggacatcgtgatcctcgaggatcaccatgtccgtgtgtgtgtgtgtgttggggatgaggtgataggtgagtgggtaaactaagtgtttaggttccttctcaactcagacatttctgatgatgatgtcctaatgcagggatggtataacaaaatagatacaacatgcatagtctggcagatgaggaatattttaaatagctaccaatcatttag

SEQ ID NO: 149440 - DNA, 347 bp, Homo sapiens
atactggcagaagaaaggagaatgaagatatgaggatcaagctgtgctcggtggtgaccttgccaacaagaacacatgagttaacgtggcagaaaagcaacccccaccccaggaacactggctgtgagccctgcgacggcaccctttctcattcactgagttgcaccaaagtggacacgggttttcttgaccttattttctatgttgatgaaacacttgtcgctaattacactttcaaaagtagagagattcatcatttacatttcacgatatatgtaattgttttagtgtattcttgacagccctattttgttaaagagagttacatggccgggcatggtggctca

SEQ ID NO: 149441 - DNA, 382 bp, Homo sapiens
atgaaggtgcacggcagagatgtacagacagtggcttgttccgagagtggcaggaacctggagtgtacagagggttgtacgaagagacactacaaagtaggttggggtctggttttagagactgagatctctagtctggttctcggtgggcaagggagagccactgtgaggttctgagcgaggcaagtgaagtggccactgttctgtgttggacactggttctgacaaaggaaatgtaagtgaagcctgtagctggagcagctctttggagactgctctgctgatctagacgagaggcagggctgtggtccttagatgggtgggagagggagcagagttgagatgagaagagtattagcagagttagaatcgaccaggaccc

SEQ ID NO: 149442 - DNA, 508 bp, Homo sapiens
agtgggaaaaatttaacaactcccaaaatgggctatagtaatcaagacagtatggcagcagtacagaaataagtggttcaataaactgaacctcaaatgattaagaagacatcaagtaaatgggaaatgcaagatgtttgaataaattgagaaaactggatctctgagtgaaaagatacaggcctacatcataaacaaaaatttttggccaagcgccatggctcacacctttaatcccagcactttggaaggctgaggcaggcggatcatgacgtcaggagattgagaccatcctggccaacatagtgaaactccgtctctactaaaaatgcaaaaattagctggacgtggtggcacgtgcctgtaatcccagctactcgggaggctgaggcaggagaatcacttgggcccgggaggcggaggttgcagtgagccgagatcacgctcttgcactccagtgtgggcatacaggactgagactctgtctcaaacaaacaacaaaaagatc

SEQ ID NO: 149443 - DNA, 249 bp, Homo sapiens
agggtctcactatgttgcccaggctggagtgcagtggctattcacaggcgcgatcccactactgatcagcacgggagttttgacctgctccgtttccgacctgggccggttcacccctccttaggcaacctggtggtcccccgctcccgggaggtcaccatattgatgccgaactcagtgcggacacccgatcggcatagcgcactacagcccagaactcctgaactcaagggatcctccagcctcagc

SEQ ID NO: 149444 - DNA, 339 bp, Homo sapiens
ctaatctttatttctttttgcccgtctctactgcaaaaacaaaaattatccaggtgtggtgatgcgcacctgttatcccagctactcaggaggttgaggcacgagaatcacttgaacccaggaggcggaggttgcggtgagccaagctcacaccactgcactctgtcctgggcgacagagcgagacttcatctcaaaacaaacaaacaaacagataattcctctctcatacatttcccttcagaaaatagaggcaaacaaacaacaatctccgtgatagctggcacttttcttccacttctaactgccctatacaaagtgcaaaacgattctcacttca

SEQ ID NO: 149445 - DNA, 219 bp, Homo sapiens
caaatctctacgagtactcttatttcatatgacacttatttgcttataagttcgtcaactatgagtcagtgagttccccgagggcttgggactgtgtttcttttaccctctgtgcccagcatgtagcacagcactggacttgcaagatgtgtttgttatttgaattgaaatggagggaaatagcgaagtcgggacctctgaaatgaggggtccaggcca

SEQ ID NO: 149446 - DNA, 267 bp, Homo sapiens
caagggccctagacgtgaactgtggaagacgctgaataaggaccaacatgtctacagtccagcctagaaaacaggatgcctgtaatcattattcagtgagcagcaacctgcagcagctcctcctgactggcagatgggcctggcggccacccagaggctggggacacagcaagaatccagcacagcaccgatcccgattccctcctccccaaactacctgagccatggacctcattttgtggacaaaattaaacttgccactttcac

SEQ ID NO: 149447 - DNA, 440 bp, Homo sapiens
gaggaatcgccatagatacttctgaggggattttccaggccctgcccctcttctctgagaagcgccccctcccacaccataggtctcaatggccatgtttaccctgccggtcactttccctccatgacctctgctgatgaaaccaggggtggagacccagccactggacccaatccagaaactgggccgggctgtcaacctctgccaggaacttggaagtgggacatgagactggctcaatctagtgtccggttacctttagacactggcccagtgaggtcatgtgagcatgggggctgtgctttggggcctatgtgatgatgaatgagcgaaagcactgatcagatgtgcagagggaagcagaggcaggagagaacaagaatgacgaagcagctgccttagttcctgacaacttcccagcctccagttccaggccctgg

SEQ ID NO: 149448 - DNA, 430 bp, Homo sapiens
agctgtcagctttggaattcaaagaagtccccttcctaatggtctttgtcaagataaagaaatgaaagaaaggggccaagggttcgagagagttgagaccaaaccagaggctgatcctcccccttagctaatgcaatgggctaagcgagagcttcactgagctacatgtttagtggctgctggttaattacctgagtcttaaaataagaggggacgcccatgttgggaaggcccagtcaaattacaatatgggactgagccgctgggagctagtttccagtggagcacagggtctccaatgatggtgctgagaggccttaatacgccaccaggcatgctgctaagtgatattttaattaaaccttaagtgacatatctcctgtctgtgactctgatggctttttaattcaggtcccattgcagcacgact

SEQ ID NO: 149449 - DNA, 576 bp, Homo sapiens
ctccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatggg

SEQ ID NO: 149450 - DNA, 628 bp, Homo sapiens
tctccaaattgtctttctacctttttttcccttctttacattaacaccatttctatttgcttggtgttgattatatctctctataaggatttaggagaaaataatctgattatttaatacaaaataaaactatagattagatactgtgtctttctttgggaattcttcaccccattcttttgtggtttaaaacagttctgtcatttcctacatgttttctggattattttctggtttcttccttttatgtaaagccgtgagttggtgctttagcattctcaatatttgcattttcaaagaaaatcttttttaaatgaaccctctgcttccaactgacaggttttcaaattctgtgacaaaaaaaataggatgagggaagttttttcttgacttcttgaatctttgctctccgtgattagttccttaaagttatttattcttctgtatttctgaactcatggatttcccaaaagttctatgtgcacgtgtgttaggattttttgggtgtatggggattggcagtaatgttggtggttgtgtttttacaactctcactgaaaactccccagccctaccctaatctgagcaattctattagataggaaaaaaaaaaaaatccaggtctcat

SEQ ID NO: 149451 - DNA, 496 bp, Homo sapiens
ttcaaatattctgtcccaaggtcatatttcttcatatattttgtctagaaaatctggttgtacatatggcctgtatcaaacattttaatattcatacagcatattatacttgactaaatgcggcaaacacttattaagtgcctattgtatgaactcatttggctggcatcagaggcgcacgcaaatgaataatgatccgataggggagagaaacaaacagccagcaaaaatgtaaggccgaataaaataagcatgaaatgaaggcaggtataaaacctacaggtatggaaaaggatggataatttctggctgaagtggtatttgattgggcctggagcggggagagtgatcttgacaagcaaagaaaagcagcagagcatttcaggccagtccaggaggagggagcttaatgggctgaggttctggctccctgaagtgtgtggctcactcaagagaaagagaaagaacagtgttcctgcagtgatgagagacatgg

SEQ ID NO: 149452 - DNA, 537 bp, Homo sapiens
aacgtctggtgcaagctgagtggatgcagtgagaatgaaagggaatgaacccctgtggcaggaaaataaggccccagaatccggctccctggtgtgccccctctccttttggggcctgcttttgggtttccttctagaagggtcaaagtgccctcctgccggtgcagctcttccatggcccgctctgactctgggccttcacagtcatctggcccctgctttgacactccttttgctcaagtcacaatgggcagacccagacccaggtgtccagatcacgtaagaggtcagggtcatgcaagaagaaagacagtatccctggcttctgggccttttcatagctcttagggaatcatgccagcagctatttataggtagaaagaccctaacctgctcctgtagaaagaggatcactcagcaaaagagtagcaaaatacaggctattagcccagctctttcgctctcactagtgagcaactttctgatttgtatgataagtttgcctaaatagcccccctctcccccatcagattgcca

SEQ ID NO: 149453 - DNA, 681 bp, Homo sapiens
ccaaaatctcacactaaagaacttactcatgtaaccaaataccacctgttccccaaaaacctatggaaataaacaatttttaaaaagtagaaataaaggaaatgcaagagatagtatggtaattatgaagtgatgcaagaaaaaattttaaaggtatttgaacatatttagggcatagagaaagaagccatagaggagaggttaaagttaaaatgaaggactaaatcatggaggtctctctatctccaagatcagtagaaggaaatggtatcattgtcttgaggctacaatgagagatggcttttttccttgaagataaactctacacaattattaatattgcattttattttattccatatgtatttgtaacagtggagggtgagatgttgggtttaggataaacaggtggagatctgaaaatgtagcaggaagaaactgttgcattgtggaagataaatttgtagatggtggtttttaaagttggtggattatacaactaggcctcagttttctcttggcacttaaagcactgggactgaggtaagcttcaagaagggacttagatgtttaaactgtcactaaaaggaatgggagataacgatgctgaatcctgctttacctggcaaccctagatgaaggagaaaagtagatgtagtaaaatttctaaatagataagtg

SEQ ID NO: 149454 - DNA, 306 bp, Homo sapiens
ctcaacgctttatacttctctgttttttggtttttggtttctttttgagcacagagtttcattcttgttgcccaggctggagtgcaatggcacagtcttggctcaatgcaacctctgcctcccgggttcaagtgattctcctgcctcaatctctctcccccaaacatgtaaaattttcctcaagtggactctcaatcaaatgtatcaaaatattaatagattctgaaaagcccaagcagagcagcaaatgaagacgtatttatctgatctttctccgaaataaaatctcctataaataaacacctt

SEQ ID NO: 149455 - DNA, 317 bp, Homo sapiens
gcctgcaggagcgggtggaggaggccgccttagcaccttgtctctttgcctcgatcttttcctcgcaccttgagctgggtataaagccaaaccccggccttgcagaaaggatggagaggcttgatgagcgcggaggacagatgaatcattaagagcagacagcggcactgtagacatgcagtgcccgcggcatttaagtgcagggacacagctcttctggagtcagaaagccctgcaagtgcttcccgttaactgtcatcctagtgatgcaagactgccagcgaccgactctgctattgagtatcttcataccgctg

SEQ ID NO: 149456 - DNA, 463 bp, Homo sapiens
ccccctcttatatgcaaaggtctttgtgaatattctgtgtaattatttgctcctttttgctccccagcccctccacctcagatctggttagtgattccaggacagaattattgcttgctcatctgaacatcccccactgcatagcccagccagcactggacacacagtagacactcagtaaatgtttgttgggagaatgcaggctttgatgtagaaagccttcctagaattacttgctcttacctaacagtggtcttactgcttcttatacaaagactccaccacctgaggctttctgggactcagtttccctgtctgtaaagtgactatagagcaagcttatccaaccaacaggccgcatgcagcccaggacagctttgactgcagcccaacacaaattcttaaaatttctcataacattattagttcagcccaaagccaggtacaaaaatagcagcagctg

SEQ ID NO: 149457 - DNA, 209 bp, Homo sapiens
tatgtacacatatttgaggtgcttactttttttattcaattaacaatctagtagtttggaagctactgagtttgacagctgtttatttgcatctttaataggaagggcacttcaggagttaacaaagataaatgaaaaagaatcttgttatcacagacatcctgtggcagcttcttttttttcatttgttttctagaagaacgtgtaca

SEQ ID NO: 149458 - DNA, 943 bp, Homo sapiens
tgtctagtactgcactgtttgtattaggatagctttatagtatattttaatatttgataaggaaagcctccttcttcccttttctttttcaaaagtttcttagaaatttttccaaacttactcttcccagtgaaatttagaattatctcatcaagttcccctcaaaagtcttgaaggcactgagtatatagattaacctagggagggttgacatcttcacaataaggtgtcttctgatttatgcacacaatatgctttctcagggttttttttttttttgtcctaaaataaaatcataggttttaataaaggttgcatacatttctttgaaaatttacatttattttatactttttgatgctacctaaatgggatcaatgttttgaataaatggagacctctgaaaggtaccccacccaaaggaaaatagccaaactatatgaacaaaagattcaaggaagaggaagctcagcttccctcatagtaagcgaaaaccaaactgacatagtttttttccgtcagacttcaaaaaaataaataaataaaagaaagaaaacaaaaccaccaccaccaacaaaaagtgggtatgaggaaaagtcaaccaccacagctgcggaggatgccttggctgcacctataaaaattcagggtgcacatggctttgacttagaaaacccacttctgggttccatgctagagaaacacccctgacacagaatgtggtcagtaatgttcatttctccactattgcacacatgtaagtctgaaaagtaaatctttgctttaagtagttggtggtagtctatgctgatgggaaaatggaaacacaaagctgttaaatatttgattaaaatcacccaaaaagtcagttctcctttgtctttgtctctttccccagctgctgaattttgtattttctgttttttaagagagttgccttcaa

SEQ ID NO: 149459 - DNA, 320 bp, Homo sapiens
tctaataatcaattctcagcttaatctctacttatcaacaagcatttaacacatttctttcttgaaatacattctccttggctgctccttctcactgtcctttgctagacaatcctcatcttcctaatctttaatcgttggtgtgtcccagaacttgatcctaggaccctatttccacctacactcactttatagttaatatcatcctgcccctacggctttaaacatcctgttttataactccaaatcagccaggagcggtggctcacgcctgtaatcccagcactttgggaggccaaggcaggtggatcacaaagtca

SEQ ID NO: 149460 - DNA, 598 bp, Homo sapiens
tttcttaagtgatgcacgtgttttgtgaaatgtaaatgaggcgcaaatatattatgctggcgctccccgtagcgggtgtactgcgtaacattagccatgctcatctgaccaaaaacaggcaggatttatgcaggctgaatatatactttgcttaaaggacttgagaactgtgacaaagcaaatgttaagttcacgttccaaccgaaattaactttattaggagtgtcgttgtcgtatctctggccgtcctttcccttagaataataattgtcactttaaggtctttgcctggtgaagaagcacatagcgacctttctacatttgagataggtttgcgcggaacaaaagcaggcagacactgttttggatgtggatcattcagaaaaatagtccagcttttattattagtgttaaaattatctgcaaacctaggtttttgttttttatgttggggtggagaaatttctattgatgagcagattctctttgaaaaggaaaatgaaaggaatctccagagatgatttggcttactctcctctcttcaggtgattgtcaggttgatttgtgtcttaaagatctgtagtaagggaaacaaagt

SEQ ID NO: 149461 - DNA, 235 bp, Homo sapiens
gcatgcacggagaaagccatagttagatttatgaaaagctatatattgtcaaggtgggcacagcagaaggacaagaatgtgagggatctaggatgctagtgagaatgtggtttaattgaaggtcttggtcatgaggcccaggctaggtcgggggaaaaaggataaaaagggtgctgatagactaagggattgggaaggggtggagaaagtacaggtcttgctaagactggcaggt

SEQ ID NO: 149462 - DNA, 396 bp, Homo sapiens
tctcactaactagttagaggtctgggaatgcaggaaccaagagttttatctcctttggaaccttcttccattattgctcgcaaagcacaagtgttttggacataaataattgaatcagagagcaaaccatctaattcctcaaaattaatttaggctgagtacacaaacacatacataccagttatttcttttaagttctagggcactatattatcagtagctaaggttaacaacccttcttgttgagttgtcctaagtggtttattccatagtagttgctcccatacaatgtgggtagttgaactgagtgatcaccagttgcttcagacagtttttttttctatggcgttgagctattcacaggactgacttaaaaacaaaccaacagaagtttta

SEQ ID NO: 149463 - DNA, 443 bp, Homo sapiens
ccagcctgggcaacatagcaagaccccatctctacaaaaaatttaaaaattagctggaaacagtggctcacacctgtagccccagctacttggcaggctaaagcaggaggatcacttaaactcaggagtttgagacagcagagaaccataattgcaatactacactccagcctgggtgacagaacaagaccctgtctctaaaaagaaaatgcaaacatattatcaaataattcctgtttaaactggacataacaagcacagctacatgctgaacctcatcaaaggtgtcttttgtttggctcatgtacttttgaaaataaggatgaggcctggcacggtggctcctgtaatcccagcactttgggaggccaaggcgggtggatcgcttgagcctggggtttcagaccagcctgggcaacaaggtaagactccagctctacaaa

SEQ ID NO: 149464 - DNA, 494 bp, Homo sapiens
ggaagttacagtgagccgagatcgcaccactgcactccagcctcgtgacagagtgagactccatctcaaaacaaaaaccaaacaaacaaacaaacaaacaaaaaactgcccaagactccaacagaaattacttggtctccttccaggcgacactaagaagcccaatcctggctcttggaaatggtgtgggccaagaaaggaggaaatatttcacaggctaatactaataattgcttcattttataggtgcctgatgaagtgccaggcacctactatgatatactatgtacacacatgaatttctgttgtcatgcacagagactcacagattatatctattcaacaccatagaagccagtcaatctaggcaagaaacccagctggattatttccttgatatcatctacataaaatcagcctgttgactatttgatgcactccctctcacacttaaatttggtcaaccagtgttgctgtgtggctactgtaagcat

SEQ ID NO: 149465 - DNA, 220 bp, Homo sapiens
tcccctgcgtgtgtgctcgtgtgtgtgctgtgtgtgcgtgtgtgctgtgcgtttgtgtgtgctgtgcgtttgcgtgtgtgctgtgtgtgcatgtgtgtgcgtgtgtgtgccgtgcgtttgtgtgctgtgtgtgcgtgtgtgtgtgtgtgtgtgcgtgcgtgtgtgtgtatgaatgaagggacagagccagtatgaagaaagtaaaagttgaagattaggc

SEQ ID NO: 149466 - DNA, 281 bp, Homo sapiens
cttgaagttcattagcagagatgaggtcttgctatgttgcccaggccagtctcaaactcctgagctctagtgatcctcccacctcggcctcccaaaatgctggaattacaggtgtgagccactgtgcccggcctccatattgcttattttcttagataacctgtatgagttgataataagttactatttactgagcacttaccaggaattggaacccaattaatttcattctaacaataaattcatcagatggctatgctattgaaacttctaaaactagg

SEQ ID NO: 149467 - DNA, 393 bp, Homo sapiens
gtctgtggcttgcaggtgactgtcttctccccgcttcttcacaggggctcccctctgcacgtgtctgtgtccacgttgccccttatccaacaaggacacatttctattggactagggcccaccctagtgacctcattttaacctaattacctctttagagaccctatctccaaatacagtcacagtctaaggtactggggttatgagttcaacatataaactttgagggggacagaattcagcccctaacaggccttaaagctcagcccaggatgagccctggccagacagaaaaaaggccctaaaagccacttaagctactggcaacatctgaaactctcatttcctgatcctgggataaatcttcttctgaattaactgagcccagccctc

SEQ ID NO: 149468 - DNA, 461 bp, Homo sapiens
cacacacccaacacggtcacattcccaatcacatacaacacacacatgcattctcaaacacacacacggtcacattcacacgatcacatacaacacacacatgcattctcaaacacacctacacagtcacatgcacacacacacaaaacatacacatgcattctcatactctcacccacagtcacatgcattcacaacacacacatccattctcacacacacacccacagtcacatgtacacaatcacatacaacacacacatgcattctcatacactcttacacagtcacatgcaatcacatacaacacacatatgcattctcatacactctcacacacccacagtcgcatgcactcatacgccatcacatacacactcacataaacccagttaattacatgcacacaatcacatacaaaacacacatgcattctcatacactctcacacacccacattc

SEQ ID NO: 149469 - DNA, 410 bp, Homo sapiens
aattacatgggaggagtaccaggcagtcaatcatgagaaataataaacatgatcaaacttcattaaaaatgaaaaattaatcaagaatcacacatgggcaagcagcaggagccatgcaggaaagctctgaagggagggaggcggttgggttgctgagtgttaacacccctccagggaacatctccagcctgaccatatggatcagagtgaataacaccgagccacatgggtttggcctggcagggccgctgttgctggcaccgtttttgcctgttacctaggaacagagggggccaggattagacaacgcttcccaacatcaataggccaaatcacagcagaatcgaaagccaacttgaagataattgtccctgaacactgtcagctacattttttagagtttaaaactt

SEQ ID NO: 149470 - DNA, 366 bp, Homo sapiens
aaacatactaagtagccttgttttccaaggttataacatgctctggggacatgctcattagggggtcaggagaaggagccaagggcatttggaggcagccactattcctgactttcagattctcttctatcaaggaagaagaccaaaataaataatttccaggtagttttagcagaagtgcagcaagacccagggggtgagtacacatcacaaattcccaggaagatcaacgccatcccagctttgccaacaactgtttgagatgtttcgcaagtcagtgagcttctcggaacctgagtttcccttcttataaaatgaaggcatttgaatcccatctttttgaacaatactatgtcataattttat

SEQ ID NO: 149471 - DNA, 709 bp, Homo sapiens
ggagatgccagagagtacagaacttttcaaaagtgttcaggggaaatgcagaggaattaatttcttcctctgaatgttccttttttgtgtgctctgtgattcctgctggacagaaagtgtctggtaataggaaaagcaggagatttattatcaggcagaacttcctctgttccttgttatctgtgtggctcttgggcaagttacttccttacctaatttcttcatttgtagaatgatgaagagctgctttccaagtttgtgaggattacatgagataaggaatctcaaatgcccaagacctagtacatgctcagtaaacattagtatcttcagttttccctctttctagaaattagaacttttaataccatatcacagttatattgtaaaataaactctggggcaagtggattggctcacatctgtaatcccagtgctttgggaggccaaggtgggaggatcagttgtggccaggagtttgagaccagcctgagcaacatagtcggatccccatcccccttctaaattttttttttaaattagctgggcatggtggcatgcacctgtagtccgagctcctcaggaggctgaggctggaggatcgcttgagcccaggagtttgaggctgcagtgagctgtgatcttgtcactgcactccagcctgggtgacagaatgagaccttgtctctaaaagaaagaaggaaagaaa

SEQ ID NO: 149472 - DNA, 221 bp, Homo sapiens
agagttgtcgccaatgtcgggagccactccctcattcagtgagtgctgataagaccctcagctgagcactgaggatgtggggacgggaaggaggggaaccagatgtgttcccctcccccacaggcctgcagagtggagagagaaaaaaaatgctattaagagcacatgaaagctccaaatgtaggtaggaatcatcactgcccagaggggcagtcccaggg

SEQ ID NO: 149473 - DNA, 377 bp, Homo sapiens
ctgttccctggcttgttcatccatttgtcccctgctgtgagccagggacggtgctaggttctgggattgaaagatgaacaacaatcaccccagtgccccttctcctcttgtctcagcatcgagccttacggagcagtgtgcagagtgagagtctgaatggggggagcccagcgattggagaagagaaggtccaattttgcctgggctggggaaggaagagccttcatggagaaaactgagcgtccaagagaggggcatgtgctctgcacagggaacagaatgtgcgaaggcatgaggaaccacgcggctgtgtgcaagcagctggcatataccaggcacctcatggctgctagttaagtgtgggctggggattgtca

SEQ ID NO: 149474 - DNA, 277 bp, Homo sapiens
aaaattcactgagtgtcacgatgcttacctgtagtcccagctactgggaaggctgacatggtaggattgcttgagcctgggagtttgaggctacaatgagccatgattggaccactgaactccatcctaaatgacagggcaaggtcctgtttctaaagaaaaaaaggacattggaatcagggtcctctccatcctgaggtgcctacaaggcatctctctctgcaaacgagtaaacatcaccctccaactccttacagagtggagcagcaggaaaact

SEQ ID NO: 149475 - DNA, 281 bp, Homo sapiens
cctgtgaaaccatcaccataaacataaacataaacatcatctctaaaagtttcttcctttcctgtttgtgataagaacatttaacatgagctctactctcttaacaaatttttaaatatacaatacagtattgttaactatatgcactatgctgtacagcagctctctagcagttactcatcctgtataactgaaactatataccctttgatcaacaccttccagattctcccaccaccccagtctctggcaaccaccattctactctctgcttctatgag

SEQ ID NO: 149476 - DNA, 173 bp, Homo sapiens
cctacccttgtacttctgtcctgtactatcattacctctctacctccctcccttcctcccctgcccccactagaatggaagctcctggagggtggggcccacatcttgtcttgcccagcatctaacagttgctgaataaatgttgaatgaataaatgcaggaatggatgagaa

SEQ ID NO: 149477 - DNA, 394 bp, Homo sapiens
tcttggcatgtaataagaacctacattttgttatataattcattttgtgatttacatttctataatttattcaataagcctaataaatgttaggtaatgaatgaatttagtttcatgagtaaaaaatagtacatgaatgatctgtcattgtacaaaactgctgaattatgaatatggtttttgtgagtattttcttcccttcctccttgtcccatccctatgtcctttcttcttaaccctaacctcctacaaccagaggatagcacgttgagggaagaaatcgtcagaagttttaatataattatattcaggatgagagttctgttcaacacaacatcattggttaatttagtaatttctagaatgctgcccagacttgaaaatactttcagta

SEQ ID NO: 149478 - DNA, 174 bp, Homo sapiens
gaggaatcctgagcagagccccagctcctgtgactgccgtagcccttgcgtgcaagagggctggccagggcttgtgggtggacttcaaaccaacacttgagtgccctcaccaagtcttggcccctgtgtgaattcctgcctttcccagaaatgagtccagggtgtctgacctca

SEQ ID NO: 149479 - DNA, 204 bp, Homo sapiens
gttttattaaaagtgctgagtgataatcccactttgctgtcttggccttcttattccttggaagccgagtctggacagggagatggacaggtgctcgctgggttgggggaccctgcaagaccacagctgggaccagccccagagaactcttcccacctggtagctgcattccctgagctgggtggggatgcttactgcatcagg

SEQ ID NO: 149480 - DNA, 195 bp, Homo sapiens
atagaacaaacaaggtgcaagattagtagtggcagaaaacattaaaaccgagcctaaacagacattgtggagaagtcataaaatggaaagcttggataaatctattttaaggatggggagcatgcaaaatataaacttccacaggacgtaggagcagtagctacagggagaaatcttcagatgcatgcacaacag

SEQ ID NO: 149481 - DNA, 301 bp, Homo sapiens
atagtgattacttctggtgatgtgattatgagtgaattttctttttcgttcacatgaaatgtctaatttttctataattagaaaaactgttacttctataataaaaatagtttactataaccaacaaaacttggtgcttattttatgtgacagtctatgaatttgaatagaaaatggcatccatttgtgttctaattaatgttgtaatcctgttctttcactctcttttcaacttttttttgcttctcctcaattaaagaaattctcgtgtactgaagaaaccattggtgagaaacttgtc

SEQ ID NO: 149482 - DNA, 609 bp, Homo sapiens
gtatatcttataacttcatctaaattatttggagatggatgcctacaacctacaattggtggaatctaggtcatctgcctgtgcctagctgcaaaggaagcaaaagaagaaagtttcctgagttcttcctggagaggtgagcttcctacggctggaaattccccgaagatagcaaatgtatttaacagttgttagaaagccaaacaacatgagaaatatccactacactgtgaaacatccgttcctctccctaaaagaaactaataccatcttatagagaacagtattagatatattccttttctcagcagaaggatacacattaacatttttatttttagcttcaaagaagaggcaaaaattgagtataatttaacgtaagaaagcttcttcccagggcacctgttgctcttagaacattctgggagagagggtgggtccaaaaagtcactataaatagcatagaaagaaccaagggtatctgtcaggagtaggactgggataggggagcaagagctggaagcactggaggttctttctgtgagtttgacttttgtccccactattgcataggtacaacttgctccattctttcccacctacactagt

SEQ ID NO: 149483 - DNA, 186 bp, Homo sapiens
gtcttctaccacaggcccagtcacccaactgcttttttgaatcttctctgatatggatgattaaatgtagttctattttgctgtgaaaagtttgggagttttcagttcttttgtctttttccatcttcttgcaacagatttggaaaacagattcttaacctgtgccattttcagagtcagtcacct

SEQ ID NO: 149484 - DNA, 557 bp, Homo sapiens
ttgatgtgattattacacattgcatgcttgtatcaaagtatcttatgtaacccataaatatatgcacctaatatgtatgtactatgtacccccaaaaacttaaaataaaacagtacctggaacatattaggcactcagcaagtatttatttaatttgttgaataaatgctaacaactaggtaagattcttattagagatcagcagtattttgtgaaactatattcttattttcctagaaatgtgggttaggaaataaaatggcagttaaacttagggaagaacactaaagagaacagcaagcagaccaggcacggtggctcacacctgtaaccccagcactttgggaggccaaggcaggtggatggcttgagcttaggagtttgagaccagcatgggcaacatggcgaaaccccatctctactaaaaatacaaaaaagattagttgggcatggtgacacgtacctgtagttccagcctcctgagtagctgggactataggcgcatgctatcacacccagctaatttttttatttttagtagagatgaggtctcgctg

SEQ ID NO: 149485 - DNA, 706 bp, Homo sapiens
ttgatgtgattattacacattgcatgcttgtatcaaagtatcttatgtaacccataaatatatgcacctaatatgtatgtactatgtacccccaaaaacttaaaataaaacagtacctggaacatattaggcactcagcaagtatttatttaatttgttgaataaatgctaacaactaggtaagattcttattagagatcagcagtattttgtgaaactatattcttattttcctagaaatgtgggttaggaaataaaatggcagttaaacttagggaagaacactaaagagaacagcaagcagaccaggcacggtggctcacacctgtaaccccagcactttgggaggccaaggcaggtggatggcttgagcttaggagtttgagaccagcatgggcaacatggcgaaaccccatctctactaaaaatacaaaaaattacccaggcgtggtggggcatgcctgtattcccagctacttgggagtatcacctgagccctggaagtcgaggctacagtgagccatgatcttgccactgcactccaggctgggtgatggaagtgagaccctggctccaaaaaaaaaaaagaacagcaagtacaatgaaaagccagatctgtagctactactactacatgatgatacttaaaacgggaagatgaattcaatctccctttcttgaactcaaaaagctaaacttccaaagt

SEQ ID NO: 149486 - DNA, 264 bp, Homo sapiens
ggggaagctgggtgaaggaatacagaaactctgtgtaaagctaagtttatctacaatcattttaaagtaaaaaggctttttctttgttttttcttttataaatgagtcctcagataaaagcagcacaccaaatcctgagcaagaagatggagaacaaatccacacttaatttcaaatgattccaaacaaaagcatatatacatatacagagaaatatattaattgaataagattaaagagaatactcatgttcattgtactatt

SEQ ID NO: 149487 - DNA, 225 bp, Homo sapiens
ctatagaaataccagacacaaggaagtctctggatgctcaggcagagccttacaagtactcttagctcctttggatcttagctcctttggattaagggtctgggcctcaaaattgcaggcccagacattctcttttttaaattcacccgacattgatcaaggactgatgctaagttgactcgggttaattgatcccactttattcatctatagtgggaaatgtgc

SEQ ID NO: 149488 - DNA, 280 bp, Homo sapiens
gcattttgtttgccaatgcgtactatatccattatttatctttcccttgcacttgtagattgggtggtgataaaaatcttccatatttcattttcctggagaaggcgggtagagtcactagtgatgaattttatcttcaatctgttgtataattttcttaaagtatctcgccgtgttgtgagctgttctcagatttcaaattgttttgtgaacctatagctttggagcagccaaacctttgttgttagagcttcttagcccaggctatcattatcattgt

SEQ ID NO: 149489 - DNA, 833 bp, Homo sapiens
  misc_feature (74)..(74): n is a, c, g, or t
  misc_feature (226)..(226): n is a, c, g, or t
  misc_feature (228)..(228): n is a, c, g, or t
  misc_feature (637)..(638): n is a, c, g, or t
  misc_feature (661)..(661): n is a, c, g, or t
  misc_feature (676)..(676): n is a, c, g, or t
  misc_feature (682)..(682): n is a, c, g, or t
  misc_feature (684)..(684): n is a, c, g, or t
  misc_feature (689)..(689): n is a, c, g, or t
  misc_feature (693)..(693): n is a, c, g, or t
  misc_feature (695)..(695): n is a, c, g, or t
  misc_feature (706)..(706): n is a, c, g, or t
  misc_feature (717)..(717): n is a, c, g, or t
  misc_feature (726)..(727): n is a, c, g, or t
  misc_feature (729)..(729): n is a, c, g, or t
  misc_feature (740)..(740): n is a, c, g, or t
  misc_feature (742)..(742): n is a, c, g, or t
  misc_feature (750)..(751): n is a, c, g, or t
  misc_feature (766)..(766): n is a, c, g, or t
  misc_feature (776)..(776): n is a, c, g, or t
  misc_feature (833)..(833): n is a, c, g, or t
ttgtaggggactgactctcttctttaaccgccgaatcagttgaaacgcggtgtctgggcgttgaaaaagggcantaacagcagtgcggaaatcccggcggcgatagagataaccacaaaaaatccgctccagtgccaggtatcgagtactttcgccagcggccaaccagcaagcgacgcccccagataagcaaacaagccgacaaaccccgtcgccgcccctgccncntctttgtgggaacactctgccgccgccataccgattaacatctgtgggccaaagacaaaaaaaccaatggtgaagaagcaggttgcctgcatcacgtagctggcaaatggcataagccacagggagccgactgaaagcaaaattccggcggcgaaaatcaaattcatcggccctcggttgccgttaaacaatttgtccgagccccaaccggctaccagcgcaccgataaatccgcccagttgaaacatcgtcactgccgtattcgccgtgaccagatcgtatgagtttactaaggaaatataatagaagttttgggtctctgaaaccttgaacgagttgcatttaaatttaacaaaacgacactaattttcttatttattttttcttaaatgaaatttaaactccatgnntttaagccatttagatacatgantcactggatagctgntaaatntnaaccngggngngatggttgatncttttgaaaanaaatagcanngncaatgttctgnancagagacnnataactggaaaaggntgataatatntacaaactggtggcccatgaaaaaatcttaacggttaaatatttaaggttgacaaan

SEQ ID NO: 149490 - DNA, 494 bp, Homo sapiens
attttttttcagacagggtctcgttctgtcactcagcctgagtgcaatggtgtgatcatagcccactacagccttgaactcctgggctcaaaggactcttctgcctcaacttcccaaggagatagaactataggagcacgcaaccaggcctggctaatttttaaaattttttgtagagacaggatcttgctatgttgcccaggctggtcttgaactcccagcctaaagcaatcctcccgtcctggtctcccaaagtgctgggattacaggcatgagccacgacgcctggcctatcccttctttcaactgggctatttgtctttttattattgacttataagtcttttacatattctggatctgagtcctttatcaaatacatgatctgtaaatcttttctcccattttgtgggtggtcgtttgactttccagatggtgccctttgaagcacaatgtttttcatttaaataaagtccaatttagctatttttgtc

SEQ ID NO: 149491 - DNA, 896 bp, Homo sapiens
accatgcagataaatcagaaactagagattggttacctgtagggagtgggagggagaagaagggagtggagatctgtgtagcatggatgaaatgtgagtggcacttctcagagtatatttgtcagtataactctgattcttagaaccataggaatgttttaaatgcttctatgcaattgccaccaaccaggatgtgggagaccaaataagcaattaccacctacccagatgcaggagaacccaaaaaggaatagtaaaattcacataaaagaggatagggagggaaagaactcacctaagtaactgtagaaaatagtgtcttgattaaataacataaaactagaggcaaaaagaactgtacagtcatgctgtagtgttgagatcagaagtatgaaaataaactcatgttttttaatatttacacagacatacagaaatatagatgtgtgcatatgtatgagttaatttgaatatgtgtatttcctacctctatcccctgagagggcatagaaacaatgacaccccagtagcattgagaatacctagtgcttagatcttggtctccaaccattgctcttcaatgaaaggaaccagggctccttgagaagtagttccttacgggactggtgcagagaaaatacaaggtaagcctagatcatcttgtggtgccagaaagtaatgaagtgcttaaaaagatgaaaacctgttcaaagcacgggaacctacctgaaggagctcctaagaactggaccaattttagcaaccacaaaaataatgataatattgcattttcatccatagaataagtacacgagtccatactgatgtaaatagattgtccagtcatgtcactgctctacttaacactcttcagtgacttcccattttattctgag

SEQ ID NO: 149492 - DNA, 1775 bp, Homo sapiens
accatgcagataaatcagaaactagagattggttacctgtagggagtgggagggagaagaagggagtggagatctgtgtagcatggatgaaatgtgagtggcacttctcagagtatatttgtcagtataactctgattcttagaaccataggaatgttttaaatgcttctatgcaattgccaccaaccaggatgtgggagaccaaataagcaattaccacctacccagatgcaggagaacccaaaaaggaatagtaaaattcacataaaagaggatagggagggaaagaactcacctaagtaatctggtagcaactagaaacaaaaagatgaaatttttgccgtctatcgtcatatgtaataaatcacaacacacaagttaggatgctgattaatccacagagaaaactttttcctaattcaaatattgaaaagaatttttcatattattttttacattgggaatcaacataagaaatggtgtacttgatcatatttttacacaaatgatgataaaatgtacatacagtcatctcgcaatacaagtcaaaaacgtaatgttaaattatttaaaggtagttctggtgtgccagaatgatgtagcctggatatgataacttcattatttgactggattgattgttcccaacattgtcagttagatattcgttcctttttatttcttttagtttgtttttgtttttttgcaaacactgatatattagtagctggactatcaacatctattgaagagagaataaataatgataaaaatcttatgaatttattaacatttctatataaatttgtgttttgttaataaaagctaactcgtgttaaatttagcctaaagctgcctccgtatatattttaagttcagactaaaggtttctctataagtagtgaactgtaacctaactaaatgtataaacagactataaccaactcttataccactcaccaagttttggtcaatcaaaggtggccaactgttcaaatcctgttcaaataagacaaatgccaagctgtaaccaatccagctatttcttcacctcacttcctcttactgtctgtaaatcctttctgacttcatggtagcactgaggttgccatgaacctattctggtttgggggggctgcccagccgcaaatggttctttgatcggttaaactctattaaatttagttcaaagtttttcttttaacagatggtgtcagaaataggacctatagtagaacttccagcgacccccggaagcatagagtgaccaaatggtgtacccgctgggcccattgtgtccattgctctctcgcagccactggggatcgtgggtaagttctctttcagactttgaagctccacggctttgtgttctgagctatctgagtttgtttgagcagatttttttttttttttatctgaactgggtttggaagttgttacagaaactggactgggtccaggatcaaattaggtctgataattaactgacttagatctagttaaaggcctcagatgtctgaatcagacagaaactgacagtaaatggcaatattgtaggtagtatgaacttcagctttcagaaatttgcagggacttttgtgttctatcccctttgtttctttttcttgcactcataggtaggaaaaaagtcaatgactaagttgtgaggaaatctgagagccaaagccaagattcaacataaaaatgagatccttaatttctgaagaactgagtactccactttctggctacaactacctacaaacacttac

SEQ ID NO: 149493 - DNA, 164 bp, Homo sapiens
agctgagtgtggctgttagctgacagcgagcaaggatgtgggggtctcagtcctacaagtgcaaggagctggcttttgctagccatctgaatgcattctgaggtaggttcttctcacagcctcctgatgagagcacagctcactgactccatgattttggtttt

SEQ ID NO: 149494 - DNA, 309 bp, Homo sapiens
  misc_feature (10)..(10): n is a, c, g, or t
  misc_feature (47)..(48): n is a, c, g, or t
gaaaggaatnaagaagggggggagaggggtgaagattgagagtgatnnaggaggaagtctataatggggtctcactatgttgtccatgctgatctcaaactcctgggctcaagcaatcttcccacctcagcctcccaaagtgctgggattacaggagcacaaaggaaaggccatgcgaggacacagggagaagacaggcccctaccagtcaggaagggagccctcaccagaaactgagctggccagcacaatggtcttggacttgtagctccagaactgtgaggaaataaatttctgttgttgaagcca

SEQ ID NO: 149495 - DNA, 256 bp, Homo sapiens
caggctggaatgcagtggcatgatcacaacacactacagcctcagtcccctgggttcaagcaatcctcccaccttggcctcctgagtagctggggctacaggagcacaaaggaaaggccatgcgaggacacagggagaagacaggcccctaccagtcaggaagggagccctcaccagaaactgagctggccagcacaatggtcttggacttgtagctccagaactgtgaggaaataaatttctgttgttgaagcca

SEQ ID NO: 149496 - DNA, 517 bp, Homo sapiens
cgacagatggagagtgcctttctactgcctgtgtgtcctcaatactgctctgattggccttctccagtccactgctcatcccatggctattgtgcctgctgagtgcatccccaaaatgatccactgcatgaagttcatggaggaacaatgtggaactccactttgtgacgcctgtgttccagccagagggagccggtgcctgctatggaagaaaggtctgcctgtgctttggggaaaaagtagtccaccacgatctacctttgctctttgacctctcaagagacccttctgagacccacatcctcacaccagcctcagagcccgtgttctatcaggtgatggaacgagtccagcaggtgatgcgggaacaccagcggacactcagcccagttcctctgcagctggacaggctgggcaatatctggagaccgtggctgcagccctgctgtggcccattccccctctgctagtgccttagggaagatgacccacaataaattctgatgctggccggagc

SEQ ID NO: 149497 - DNA, 900 bp, Homo sapiens
ctcaacgctttatacttctcaacgcttgatacttgctcaacgctttatacttcatctttttccaaacaccccttaccacctgccatatacttttctttaactcgttgttgttgcctgtctcctccactaaaataaacctttagagggcagttctttgctgttgttttcctgaaaatacctagcacaaagtagatgctcaataaatatgtgttgtatgaacgaacaaaggcaagcaaatagaaaccattaaagggttttaccggggagaaacaattcattttgattcatttgattgtataagtacattttaaaattccacttcctccatttatcattacctagaaacttggggatttcacattagggaggtggctacatgcccaactggcccttaactttagctaccaccaattcatttctacaatgctaccatagtgatctttcaaacatatctactcccatctcctgtcctccactacctacctgccaaggctgcaacaagttccaggctcccacacactgatgccccagcctcacaagctgcttccacaccagactggctaactctccaactctccccattcgcctcttccaggaagccttcctttcctggaagtataaagcgttgagacattagggaggtggctacatgcccaactggcccttaactttagctaccaccaattcatttctacaatgctaccatagtgatctttcaaacatatctactcccatctcctgtcctccactacctacctgccaaggctgcaacaagttccaggctcccacacactgatgccccagcctcacaagctgcttccacaccagactggctaactctccaactctccccattcgcctcttccaggaagccttcttcctggaagtataaagcgttga

SEQ ID NO: 149498 - DNA, 882 bp, Homo sapiens
ggtgactctgaggatcccctcacgctttatacttcatctttttccaaacaccccttaccacctgccatatacttttctttaactcgttgttgttgcctgtctcctccactaaaataaacctttagagggcagttctttgctgttgttttcctgaaaatacctagcacaaagtagatgctcaataaatatgtgttgtatgaacgaacaaaggcaagcaaatagaaaccattaaagggttttaccggggagaaacaattcattttgattcatttgattgtataagtacattttaaaattccacttcctccatttatcattacctagaaacttggggatttcacattagggaggtggctacatgcccaactggcccttaactttagctaccaccaattcatttctacaatgctaccatagtgatctttcaaacatatctactcccatctcctgtcctccactacctacctgccaaggctgcaacaagttccaggctcccacacactgatgccccagcctcacaagctgcttccacaccagactggctaactctccaactctccccattcgcctcttccaggaagccttcctttcctggaagtataaagcgttgagacattagggaggtggctacatgcccaactggcccttaactttagctaccaccaattcatttctacaatgctaccatagtgatctttcaaacatatctactcccatctcctgtcctccactacctacctgccaaggctgcaacaagttccaggctcccacacactgatgccccagcctcacaagctgcttccacaccagactggctaactctccaactctccccattcgcctcttccaggaagccttcttcctggaagtataaagcgttga

SEQ ID NO: 149499 - DNA, 839 bp, Homo sapiens
ggattagaggtccctcagttcacctacactgcatatactttcttaatcgtgtgctgtctcctccactaaaataaacctttagagggcagttctttgctgttgttttcctgaaaatacctagcacaaagtagatgctcaataaatatgtgttgtatgaacgaacaaaggcaagcaaatagaaaccattaaagggttttaccggggagaaacaattcattttgattcatttgattgtataagtacattttaaaattccacttcctccatttatcattacctagaaacttggggatttcacattagggaggtggctacatgcccaactggcccttaactttagctaccaccaattcatttctacaatgctaccatagtgatctttcaaacatatctactcccatctcctgtcctccactacctacctgccaaggctgcaacaagttccaggctcccacacactgatgccccagcctcacaagctgcttccacaccagactggctaactctccaactctccccattcgcctcttccaggaagccttcctttcctggaagtataaagcgttgagacattagggaggtggctacatgcccaactggcccttaactttagctaccaccaattcatttctacaatgctaccatagtgatctttcaaacatatctactcccatctcctgtcctccactacctacctgccaaggctgcaacaagttccaggctcccacacactgatgccccagcctcacaagctgcttccacaccagactggctaactctccaactctccccattcgcctcttccaggaagccttcttcctggaagtataaagcgttga

SEQ ID NO: 149500 - DNA, 590 bp, Homo sapiens
ctcaacgctttatacttctcaacgcttgatacttgctcaacgctttatacttcatctttttccaaacaccccttaccacctgccatatacttttctttaactcgttgttgttgcctgtctcctccactaaaataaacctttagagggcagttctttgctgttgttttcctgaaaatacctagcacaaagtagatgctcaataaatatgtgttgtatgaacgaacaaaggcaagcaaatagaaaccattaaagggttttaccggggagaaacaattcattttgattcatttgattgtataagtacattttaaaattccacttcctccatttatcattacctagaaacttggggatttcacattagggaggtggctacatgcccaactggcccttaactttagctaccaccaattcatttctacaatgctaccatagtgatctttcaaacatatctactcccatctcctgtcctccactacctacctgccaaggctgcaacaagttccaggctcccacacactgatgccccagcctatctattgcttctcatcatcctgtttgttttattggatcaggaagtagaaattgct

SEQ ID NO: 149501 - DNA, 475 bp, Homo sapiens
cacccgcctcagcctcccaaaatgctgggattacaggtgtgagtcactgcacccagcctctctgtgaggtgtttaactcctagaagacaggggtggtccttgtacccgcttctttccaagcctccttccaagcctgccagtgggagcttggaatgtttctgtcagttttattcagatttcatgtaaaagaaatatgtagcactcattcagatttttgtgattatttgaaaaggattaaagggagataaattaatagcatagactttgtgtgaaattatggctctattgaaaatgaaatcccctgtgacagttgaagggattttgaggaaaatttcctttcaattgtctcttatattttccttctatgatcttttgtgctggctcacaaaaacagaaagccattaatttcatcttctagccgcatattttcattaaagctgtgaaaccccttagttttagaagctgtgaggggcgg

SEQ ID NO: 149502 - DNA, 306 bp, Homo sapiens
tgcagggaaacgcgcttaaaccctacagcagaggagcgggctggctgtgctccctacatccacatctcctgagtgcaggcctcggcggcagagttgcgttcagaaaaccagcaagcacatcccccaaccgaagaaacttggacgatctcagccttgtgcttgacaacctatcccccacctcccttaagtggttggggagggggatgagcggtggagtccaaagggatacagccacctcccggcccaaatgcaaattcatattcatgagagcgggataaataaagacaaatctccgctgtaatagca

SEQ ID NO: 149503 - DNA, 397 bp, Homo sapiens
tgcagggaaacgcgcttaaaccctacagcagaggagcgggctggcggtggacaccccggcctgtgctccctacatccacatctcctgagtgcaggcctcggcggcagagttgcgttcagaaaaccagcaagcacatcccccaacccgaaatccgagggaacgaagaaacttggacgatctcagccttgtgcttgacaacctatcccccacctcccttaagtggttggggagggggatgagcgtgggggaaattccatgtgtggagtccaaagggatacagccacctcccggcccaaatgcaaattcatattcatgagagcgggataaataaagaacgatagcgcgccgatattctatttgtgtttagtataataggtggtaggtacagtaatatatg

SEQ ID NO: 149504 - DNA, 428 bp, Homo sapiens
caaagtgctgggattacaggggtgagccaccgtgcccagtgatgtatttatataaaatggcaagcacttgttggtgactggaacttaggaacagtggggctggctgcttccctggggtctgaacctattactggataactcggggcaagaacccagtggacagtggggcctcatgggatggggaaaggagagccagtggcttacggacctcgtagaggtgccccttggcctttctgggggtctcgtcctatctgctgaagaatgcccgtcttgttctactgtaatggaaactggacatgtccatcagtaagggagtgattaaagaatgatatttggctgctttgcagtggcaaagtgaaatccacaatggtgtactgaatgggagtatccccacagtacaacactattcatgtagtggagggaaggat

SEQ ID NO: 149505 - DNA, 390 bp, Homo sapiens
ctgctccgcccctctctgggaacatgtctggggtatgtagtcacaggtctccccacagctccctgggacatgcagtcctctgccctttgatagggaagtttcctggagtggggccaaggcttctggcagttccgtggtccttggagagagagtggtgcagtggagactttgtgataaactctccctggggactggggtctctccctctacccctcacggacacctagcaccttgtagggtcctcataccacctgtccacctcttcttgtcctgattatacagtggtggttgttacagagaggctcggtgttctaaaggaaaaggggtggggaaagggagctaagcccccactctggggtcacttgttcattgaggggcaaggagacagcc

SEQ ID NO: 149506 - DNA, 306 bp, Homo sapiens
caggctgctctgagaccctcgatgtggggccaaggcttctggcagttccgtggtccttggagagagagtggtgcagtggagactttgtgataaactctccctggggactggggtctctccctctacccctcacggacacctagcaccttgtagggtcctcataccacctgtccacctcttcttgtcctgattatacagtggtggttgttacagagaggctcggtgttctaaaggaaaaggggtggggaaagggagctaagcccccactctggggtcacttgttcattgaggggcaaggagacagcc

SEQ ID NO: 149507 - DNA, 737 bp, Homo sapiens
tagaactacagaggatccagaacggcagccggtcctcactgggctgttcctgtccatgtgcctggtcacggtgctggggaacctgctcatcatcctggccatcagccctgactcccacctccacatccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggcttcctagttttgttgtctttttttttctgtcctcagtcttttagactcccagctgcacaacttgattgccttacaagtgacctgcttcaaggatgtggaaattcctaatttcttctgtgacccttctcaactcccccatcttgcatgttgtgacaccttcaccaataagataatcatgtatttccctgctgccatatttggttttcttcccatctcagggacccttttctcttactctaaaattgtttcctccattctgagggtttcatcatcaggtgggaagtataaagccttctcccctgtgggtctcacctggcagttgtttgctgagtttatggaacaggcgttgga

SEQ ID NO: 149508 - DNA, 293 bp, Homo sapiens
gtagagaagtgtgtgtgtatcttctataattagaagatagaaagctctttctccacccacatgccgggagaaatgtgaggcgtttgctttatcagctccagtttggggtttgcttctgctgcttcccagacctgaaagcgccttttcatgaggcgtctggaacacccagtccccaactgcagcttgagctactgcctgtgcttcaatgcctgccttgtgctggtgtggggagcagacatgcgctggtgctgatggggtggtccaggcaggagtctttgaattgctctcaggat

SEQ ID NO: 149509 - DNA, 344 bp, Homo sapiens
aacgtaggcgtaactagcagctctgatgactttcttacttgcttacagattgctgcttgaagaagagctgaacttagctggctgctgtgtctgctagatggggcctctctgctgcccgctgtaggagacaaactttgttgcttggcatgtgtggttaccaccctttatgcccatccacctgctgctcaggctgtctggttggcagccacagatcaagtgctccagatttctgatgaggggcagcaagggctgacctgggcagtagaccccacatgccatggactgggtcagctcatattacttacagacaagtgatggcttatggcactttttattaagccaat

SEQ ID NO: 149510 - DNA, 444 bp, Homo sapiens
tgatttgcactcaaactactcactggattgaattttactcctgatgaaagattctgaacactgtcctttaatcttacgatgaaaaaatttctctaacctgcctcatgaataagctattattttacttacaagaaattctcattttctagttaaaacgttttgaaattctacccaagggctcgtctatgtctctgccctcttggaaacaattggagtcaaatctgtaacttgctaatttgaccaacagtaattaaaataagtccatatttagggtcagttactaagatgtgatcttttgaatgttttcagaacttttcacaaactaaaaacaagcatagtaagcactcaaactgggtttggccaatgggaaggtaaaaaaaaaaaaaaagtaattttaagttttttttttttaaagttaaaactgattttgcttattttcttttt

SEQ ID NO: 149511 - DNA, 405 bp, Homo sapiens
tcaacacttgctattatttgtcttttattttagccatcctgatgggtgtacagtagtatcttgtggtttggatttgcattttcctgatagctaaggatgctgggtattatctgtcattttaaacatccattcccctcaggccagtgatcccttctgagatttgacagatgtgtttagcactggtgtcccctccttgtgagatcactgtgactacagacttacaagcttggggactatcgagaatgactgggcgttggttgggtcctcagggctccagagccatggtccttttgaagagcctgaatcaaggtatggggctctggagagttctgtgtgtgcttgtcacaggggtcttgtttattcaagagagccaacagcctttcatgaccccttgttcctcttcct

SEQ ID NO: 149512 - DNA, 390 bp, Homo sapiens
tagtaaatatatttacacacataataaacaaatgtatgtactgtctaaaatgctgacaataacatttttgtaaggttgtctttgagatggctttcacagcagtctacagaagtgtgaagtgtttatgtggaagattgcgtcctgccgtgccaggcttttcaagcagcctttagtacaatcttcttcacaggttattaatagctccttcaaggactgccaaggcttaaataatagcaggaaacacaagcatgtgtctctaggggaatcatagactacgcagccacactgagagaggatcacaagcaccagcaatcccagcagaagaacaggtgccctcagccacatcaggatttcaaaacagtcacgggacaattatcagcacacttattg

SEQ ID NO: 149513 - DNA, 346 bp, Homo sapiens
gctatgtgcccttggggaagtgactgaaactctcagatcctcagctggcacacctccatgattctacgtgagaatggcaaaggtggaggtgtgcagggtaccaggagcagtgctcacgcagacaggatcctcagctcaccctcctgaatcccacagggaggcagggcaagagtggatccatcagccagtctgggatctctctcctccaggggctcttcattgaaaccaactgtttcgtttcctgtcctcagctccaggccctgaacaggttgggaggcctcttcatcttcagagacactgcccacagctgttcagcctcttctcatccctacccccatccttgtcc

SEQ ID NO: 149514 - DNA, 436 bp, Homo sapiens
ttagcctaagcctctaagtcctctgggctgggctgatctaggatggttctggctgatggctctgctgatcttggtcattcctgcaactgcagctcagctgggcattggctggctgatctagaatagtcccagtgagggtggcttagctgggcccctttggctgtccatgtcttgtcatcctcctggctagcctggaatgttctcatgaaggcagaagagcaagtagaagtgagcaaggcctcttaaggcttaggctggaacatggtacgccctcactgcagcctcatcctattggccgagcccagagccaggagcagggatgtaggcagtacttgcccctttagtgggaggaactgcaaaatcacacagcaagcagtgtgggtgcagggaggggtgaagaattgggtttgataatgtgctgcaatagtcatgtcct

SEQ ID NO: 149515 - DNA, 551 bp, Homo sapiens
agagtcttccctgagcttggctggggaggagggggctgcaggaaggagctgtgagcagggcaggatggagattcgtgtggccctcctgggaggggctgggcagggctgggaaaggggtgggtgagatgttccggaactcagggaaaggaagagtctgggtactgccctgggggcacctgggcccaggtggcaggtggccagctttctgcctcctttccacctcctttctccagaaggcacccaccagctgtgtaaatagggcaggtgcccacggcccgcctcaggccccgtctcctccccacccacgctctctaatcgcggattatacacaatccagcctgatccctgggcagctgccctccctcccgcagccacctctggctctgagagatgggcttggggccagcctggggtcccaggagtccaggccaggatgagaacctgctctgaccccacctggacgcattaggcctgcctggacctgttgcctcaccccaagagagccacaggcaatgcaaaggctcctgttcatgtcagggcacctggaaggc

SEQ ID NO: 149516 - DNA, 419 bp, Homo sapiens
cttaaccactcagctggactgcttacatatagttacggagagaaaataggagagtcactgtaagaacactcatttggaaatggggagaagaggaagccctggccttaaagtgggttccatggtgagtcactgcttccccaggttctcctctgtgatcatcagcttacccattgtcttccatggctgcatgtaaggattcccattctgggggcgcacgtttgctgtaggctgaggggtctgaggactactctagagaagtctcaaaagcttgttgccaggctagaggtttctgtggcaacacccttaactagccagctacttgttgatctgactttgggtattgtaggactggtgagcaattccagcaaccttggaaatctgatccttgatctgaactctgctctttttttttttctctt

SEQ ID NO: 149517 - DNA, 788 bp, Homo sapiens
aaaaaaaagtgtttaaaaaaaatgatgctggtaccattggatgtccaaatgtaaaacaaaaacaaaacaaacagtcttctgcctgcttctggacgagcgaggagacttgtggtctggttcttggacttccctagcagcgtggcatccaaacgccaatctccactctcacctcaaaagaagaaatcaagaccacctcctgctctgggaccggaggagacattggcctctgcaggcttgccaaagtaggaagaaaaagaacagcaagaagccattgaacacattgatgaagtacaaaatgaaatagacagacttaatgaataagccagtgaggagattttgaaagtagagcagaaatataagaaaatctgccaaccattttttcagaaggggtcagaattgatagccaaaattccaaattttggggtaacaacatttgtcaaccatccacaagtgtctacactgcttggggaggaggacgaagaggcactgcattatttgaccagagttgaagtgacagaatttgaaaatattaaatcaggttagagaatagatttttattttgatgaaaatccttactttgaaaataaagttctctccaaataatttcatctgtatgagaatgatgatccatcttcaaagtccactgaaatcaaatggaaatctggaaaggatttgatgaaatattcaagtcaaacacagaataaagccagcaagaagaggcagcatgaggaaccagagagcttctttacctggtttactgaccattctgatgcaggtgctgatgagtt

SEQ ID NO: 149518 - DNA, 355 bp, Homo sapiens
cactacctggaacacggtgacgatggcccacagcagggagtcgaagttcttcctgtcaggcacggtgtctccggtgtctgtcttcaggctgaacttgcagccgaaaaggcgagagaaccaagaccagaggcgggacagacagagggaagccactctggatttgggtggcaactggaacctgggacacctgcctcattcagcctctctggactgtgaaagcccggcctgcctggctgcctagcctccagccgaccctgaccctgagctccaggctagacgggcacacagcaggcgctcagaacaccccagttggagcctggtgcctgcccccacccccggtattctgctcttgagt

SEQ ID NO: 149519 - DNA, 404 bp, Homo sapiens
ggaacatgttgatacatagtctatacatatcatgcactgaacttgtatgcttatactttaaaaatcaattacataataccaaaaacctaatgtgccagttttaaactctttcatttttgttacaattaaaataagttgtgttgggttcaataagcgtttatcttataactaactgaaaccacaatttaattcaactgtatatataataatattttatttttctcttaaaaacaatagtgacaaagtggcacaccattcttattccttttcattctttgggatttttctcatggcatttatatcccagtggcttttataatttaggtattttggttgttccaagtgaagaggaaaaggagcatttaagggtaacttcaactagagatcagatgaggataagaact

SEQ ID NO: 149520 - DNA, 584 bp, Homo sapiens
aagaattcctgtcacctccctgggaaatgctctcatccatgaggaagaacactgaaacttccagcaacacaaccctctgacctacccacattctatgatcgttcctttacttccatggctacctattaaactccaggttgcccagaattcctataaaatgtcaaactctgaaaccccactttggccataactcctatcctttggcctcttgatacccatattccaactaattaattaattatccagtccttggcactatctctaattcactcttctcccaaggatttggattctaaagccaatcatttaaattgcccttatcagtatcctgaattctctcatcctctgaagctctgtgaagcctgctgggccaccctctaactccataccaatcatgctctgttgggctccctaaaaatgcgggcttatagttccagtaaggcctctgatcaactcagctgcccacaccccatcaaatccctttcctgctgtcaggggagaagactggcagaatgagatgccatcttgggaaaaaggaaaattagaagaacctttttatcctaccacaggttcaagcccttatc

SEQ ID NO: 149521 - DNA, 376 bp, Homo sapiens
ctcccaggcaccagtttcagatcagcaaaaaatagcaaatgcccccaggcttgaaaagcaatctcacctctattaactcttctcccaaagtgctgggattacaggcatgagccactgcgcccgacatgcccgcttctgttttttaaacgaaagatgaacagttaagctggacttagccttggttttccattagcattattgctaagttggcaaccttggataaaatccactcttggaaacttttaagctgaacaaaagctgcactatgagcaggtgctatgataaagccaagacagcgctctaagtagaggggctgatgaaatagactaaggggagatcttcatttctctcctggacaatagcgagtaaaaaaaaa

SEQ ID NO: 149522 - DNA, 451 bp, Homo sapiens
tgaattaagggctacattttatagtatggttaagaaagcaaagtagcttatgtaggttttgttatttctcttgcagttatctatcattgcataacaaactaccctgaagcttaggggcttaaaagaacaacagttcattttttctcataatgaattggatggctctgctttacatggtgtgggttagggcacttgacaaggttgggaggtccaaatagccttattcacgtggctgatagttggtggtgctgactgctggttaggagtgtagctggggcttttggccaagggttttggttctctgttggttagatctctctgtaggctgtttgagttttactcatgttatagctgctgggttctaaagaaaatatattccaagcaaaggcaaataaatgtggcacaaatgatgctgtgtgatttctgagactaggtcatctgatgcctgata

SEQ ID NO: 149523 - DNA, 345 bp, Homo sapiens
ctctggatgcaagtgtctgaaatcaagatgtaggtatggccatgctctctcaaggttcgaggggagaatctgttccatgcctcttagctcgttgtgttactgccaatccttagcattttttggcttgcagctatgtcactccagtctgtgactctgttatcacaacataatccctgtgtggctctgtcttcagatggtgtgctccacttcttgcaaggatactagtcgtattggattaagatccaccctaatcacctcatcttaacttgattacatctgcaaagaccctattttgaaataaggtcacgtgcagaggtactggaattaggacttcaacctatcttt

SEQ ID NO: 149524 - DNA, 160 bp, Homo sapiens
atcctcatcactctacccttcttaaaatacctgtgatatcagagtccagtgggaaatgcagcatttgcacaatgcatgcttctagcccactgccagacacacagatgattctcaataaatgtcaatcctctttctgcctactgaaccttacacctaaatg

SEQ ID NO: 149525 - DNA, 531 bp, Homo sapiens
attctcctcacagactctttgtcacttctcacacctccacctcctcatcaggccacttttctcttcattcttccagctctcagcacctcatcctccctcatggtctaagacgatcccgctccccgctgaccgtccctgtggtaatagaagctacacagagtgacagcacccactcggcaacacagtctttcaccccagttactgtagtggccttctacaatgttccctggtccatgatcttgccccttcctattgcatctttcacactgttgccagcataattgttccaaaatagaaattccatcatgccactctctactttcaatcttttaatggccccagtggctttggggccattaacatctaatttggggataaaaatctaaattcttaatatggtatagaagcctgttccacctggacctgtctacctcggccctcacaggtgcccttcaccatccccatcccaaacaacttgcattttagcacatacaccatgctatttctcatctctgtcctggaaccccctct

SEQ ID NO: 149526 - DNA, 338 bp, Homo sapiens
aatgatggtcctcagctcacgtggtcctcagctcaatgatggtcctcagctcaatgatttgtcctcagctcacatgatggtcctcagctcaatgatggtcctcagctcaactgatggtcctcagctcaaatactttctcttccacgaagcctcctttgacttttatagtcatattgagacatgcttcctatgttcccacggtgttttatacctacccctttctaaaaacatgcattttggtgtctgcctctgcactcatggttagccctaagaagggagaggtgatgagtttcaacctttgcctggccttacaggtcaaaaatgggtgagctacaaat

SEQ ID NO: 149527 - DNA, 562 bp, Homo sapiens
taatgatcacgtcatggcaaatctaaatgcaagaatcatagcactgcttttgtcctgtgtggactctgtcttgcttcttctcctgtatttttatgttgctttttttttggacattgtgacagcattctaagtcctaaagcccacccatgtccacccatcacctccttttataatgcttattggtttgggtttcaagatatctttcatgagccatactcacattaccttcatgatattaatgaaatttcctacaattgcatgtagatcactgtttcttattattttgcatgaagtttagctgacacgaacctgctttacaaatgtacatttactcccaaattcacttgctttgcaatgctttagatgggtttacctaaaaaccttggctacaattgagagcacctgccagttccacaggagcaataatcagaagtggtttctgacactgagcaatgctatggtcacacagggactacctggaacattgagacaattaccttaagatcaaggcccctaaaccaaaagaagaaaaaaaaaagtttttttgtttttcaattgctgg

SEQ ID NO: 149528 - DNA, 456 bp, Homo sapiens
ccatcaagtaaatataccaaacactttatcttatgtgctcaaaaggcaaggtgtcatcatcacctttcacataccccatgagatttatttacagcttacattgactgtgaaactcttttatcccctgggagttctactttatttattccagataataggacacttgcaacctattaacagttgtaaacaggtctttcaagtacatctgacatagcaattacaaaatgtatttgttagacaaatatctagaattaaatcaggacaaagatgaagattagatgaccacaagaagtttctgcatagtttatctatttttcaaaaaaaaaatacaagtattatagaccctcagctacaaaattccagtgaataatttaatggatattttacttattatattttagaaaaacattatttgatgaatgtttatttaataaaacagccttacccttaatgata

SEQ ID NO: 149529 - DNA, 192 bp, Homo sapiens
caaaaaaacaaaaaaaaaagcagtcttgagcgttcagaaaatttatagaacactgtctgttctaagtcacacctatctaggagggcttatggagtttatttcagtaataatatagtagttccttctaaccttaagattacatgcatggctgagaatcttgagaaatttggattaagacttgataaaatattc

SEQ ID NO: 149530 - DNA, 392 bp, Homo sapiens
ctgtgtctgctcagcatcagggcctcccactgaagccctcccacaccctcacacccttgcctgcaccctgtgccctgaacctgccatgcacagccctggccaccccagcacatggggtccagtctgaagcagttgcccatgagggctgccccaggctgaagcccaggcccacgccacagctgaggtgagcgggatcttccaccaggaagccccagccttccagaagggaggtcttggagctccaggacagcaacccaggactgccagcactcacaaagcagcaagggggaggagctcactgggttcccaagggctgcgggagggtgaagaggtgacccagttgtggggcagggggagtttggctggcatggccacctcaggccctgcaggcc

SEQ ID NO: 149531 - DNA, 657 bp, Homo sapiens
gggtccgttacactctgcagctgcctctcacgcctgtaaggacagaactgacccaagttgaatttagtcccggaaagtggtgtctagaaagctctattttacttttctttttgtccagtagaagctctgttggacaagaagggcctgctgtttaggaatctagggaaatctgtttccctgagagacacagatgcagctgtgtgcagctcagcttaagtggacttgtttcttcacctgttaaaagagagcgtggagttggatagcatctaagaatccttctacctcagacattcccattctaaatatggtgggcctgacactgcaaaactgctaaagaagttccacacaaaaatgtgttttagccttaattacttattcagtttaaacaaaaaagaatttttttaaattaccagctcttttgttttcagttctcataaatacatctggtttccccctctctctctatctgataaaagtattctgaaaggcagagtccggagtgcagaggttagaggatctagaaggggaggtgagatggaggtggcaggggaaatgaggatggcagctttagtcgtaggctcctgctgctccctgctgtttctttttttttttttcttttggagatggcatctggctctgtcgccaggctggagtgca

SEQ ID NO: 149532 - DNA, 273 bp, Homo sapiens
catctataataccaccacgaggctgggtatgatggttcacacctgtaatcccagcacagcagagtgagactctgtcccaacaacaacaaaaaatccaaagtgaaagattaccagctagcaggcactgctagacttagaaacaacccatacaaatgggatacaccctggagtttattaccacattcttttgtattttttcaatgtcggtcacaattcacaacccaccaatgtttttataaacccaagggaaaggaagtttagaatggaatgtaa

SEQ ID NO: 149533 - DNA, 511 bp, Homo sapiens
agtgcagatctcagactctatttagggggctcaggtgcagcccagagaagagaagcgacttgcacaagagctgagagctccccgttaaggcagaattttcctcccccggcagcctccccagctgaggaggctgagccctatgctcatggaatagggtgggggcactggggtcacctgttcccacctctgggtagtggcttgccttgatcaggggccttccagagacagcatcttcacccagaatcagccatcaggaattgtagcccagtgccaggaagcaccctggggggagtaatgggaagttagttccgatgttgaatgcactttggcatgtttcaagcacctcaagtaagggcttgacttaattattcattcgtccttttagaagtgtttgtttattaactgtagacatcgggagacagagatgagcaggacaggtaagttctctgtccccatggagctgacattcccagggctatgctagcaacacagagagaggtggggaggcagt

SEQ ID NO: 149534 - DNA, 468 bp, Homo sapiens
tgtctacattgtgagaaggaaagtcttattcaaaagacaatgtgaggagagtcctatatttagttttaaacctcataaagtgctaaaaattgggattttcagtggcttgaccttatctcactgtaatttcaccattccaattacatgtatgtcctttaaggaaagtgattgatcatatttaccccagtcaaaaatattattatcaggagtctctgagcctactctggctgaaaaaaaaaaaaaaaagtctcaaggatggaaataattaatgtttgatttttaaataattagtaatgttcccccttagttagacatgtaaagaatattccctctacaaattcctacagattatctcttaattttatttaaattcagtgatgatttttctcttcagttcctaagaaatagcccatagggaagtagtttttccaggggaattctgtgaccaagtcactgtgaaatccaata

SEQ ID NO: 149535 - DNA, 380 bp, Homo sapiens
gcggccgcctactactactactgctcgaattcaagcttctaacgatgtacggggacatgtatgtcctttaaggaaagtgattgatcatatttaccccagtcaaaaatattattatcaggagtctctgagcctactctggctgaaaaaaaaaaaaaaaagtctcaaggatggaaataattaatgtttgatttttaaataattagtaatgttcccccttagttagacatgtaaagaatattccctctacaaattcctacagattatctcttaattttatttaaattcagtgatgatttttctcttcagttcctaagaaatagcccatagggaagtagtttttccaggggaattctgtgaccaagtcactgtgaaatccaata

SEQ ID NO: 149536 - DNA, 369 bp, Homo sapiens
acctcgcggagactggggccacagggtcacgctgcctcggcacggcgacctttcgtgggtaaccattcatctgagtgcagacagcaaatttcagggctcaaacaggagatcagtacctgcttctgtacatagaacagagtcagttacacgtggcggaagagaccctggggctgcccagggcggtgaggcagcccacattagagctgggagcattcgctgcccccccagagcaaggggacaaagggagatggtgaggtccctgcagcctgggggccagggccacctagcaggaactagaatcaatgtgggccacagaggggatggagagggagaaagggagggatacccacagcctctcttccccctgct

SEQ ID NO: 149537 - DNA, 402 bp, Homo sapiens
atgaatgtgaatcgggaatgagaaggaaccactagagaagcaagaggaaaaagagaaatggagaaaatgagcagcaatgaagcggctagaaaactacagagatagaaagggcaagagggaagagaaaaggtgggagaagtgagaaatggaacaggaggccactgcagtaccaagatgtcaagatggaagagactttgtatccaactgtcctccactgggacaacacctagtacgtgagtgtggtggccttaagaaggtaaagtgcagagagccactgagttactgctaccttcagtgattgacctatatccaatacacagaaccctctgctcattgtaagaaatgtgtctggggcatatcattgtgggtgttaacagtttaacatgatcaatatgtactggt

SEQ ID NO: 149538 - DNA, 565 bp, Homo sapiens
atcgtgaaggaggtgaagaagttggagcaggacccagggctcctccaggagtcctccagactgaggagcctcctcgaggagctgaggaccatcgttgaacgatggtcctcagctactggggtcaagtgattctcccacttcagcctccccagtagctgggactatagatggcatgagccactgcgcccagccttgccatttattctttttataatttaacaaatatttatggagcaatttacattaattggccccttgagacacaaagaagagccttcaaggcatcatcaggaatattctagatacaataaaatgacatgtatataataaggtatattttaatgaaatcataatggaatataaaacaattggccagcaatgatcaaaatggcctaacttctcttccacttttaatttcaggttaaagtaatttatattttttggcataaggaacaaattagggtttttagtcttgttttggtgcttattgccgataagtcattttgtgtcaggtttgtgtttgttttggtctcatctctactaagctgaggaccatcgttgaaaa

SEQ ID NO: 149539 - DNA, 134 bp, Homo sapiens
atgtaattatatccatctctttaattatttttagtgtcctggcttgatgatttttgtgcttatgctgggaatattgctctccctacctcacatggatatcaaaaggactaagtaattcttaatacttttttttt

SEQ ID NO: 149540 - DNA, 273 bp, Homo sapiens
aggggctagggggcttctgtgtagtaggtgacagtgtgtggcctgcgctgtgcctgctcgtgttgcctacatgtccctggctccctgattaaatgcctttgtggttgccttcctcctccttagtcgctctttgcaggccccctcttccctgcctacctcttacctgctgatttttcccagagttatagcccaagcctcattccagcctctttccattctagcctctgagggtgcggctactagccaaccgtggactagtagccaaccgtggac

SEQ ID NO: 149541 - DNA, 845 bp, Homo sapiens
atgtctgaaaacatttcatttcccatataaaaccttgtcatttaagcaactgggatactttgtaatctccttttgaactatgatagactctaaacccttatgtgaaaggcagttattgtgaattgctgtggtttttaggatgttgcccgtttccctgttcttccctgtttcttcagtgtcaataatgcgggggtctcttaagaaaatagctttgtaatttacttctccagacctagggaaatactgcattaaactgatgaaggtgcctcaggtgaactgcacttttgatttcagcaggattttctggttgttatgagtcagtatgtttctttctcttggcctaatatctttatattaggaaggagtgttgctgtaattagagaccattaggcattgcttgagccatttgtctattactttttgatatattggattttctggtaactcccaggttagagaagtggtccctccttctactctaatttctttgtaatcacagaatcagcatcttgtctctagagagttttgctagataattgggctgctccatgcctagcctagaggctttgggagtagaacccagacttatctaagctttgtcttccaaatgttgcatcactcaattactgtatgaattcttgccttgttgatgtgtcatttaagaaacagcttatatacaaatgatgaagtgtatatataaatcttcctagttgccaatttcataagattgaagaaactgcaagttttgagaacacttttaagcaatttatttaacctctaattggctaccttattcggtatgactggaagatgagatgtcacatcaaactgtgttatgaatattt

SEQ ID NO: 149542 - DNA, 489 bp, Homo sapiens
cggccgcagagctccaccgctgaggccaatcgggcaacactttattctataaaatagaatgaatgttttcagtattcacaattcttaacagttggctccacgctgacctcagagccccctgctgtgccaagtggtaggctttgattactggatggggaactggggcttgggctctaacagctaacctcaaggattccatcacttaccgaggcaattgaaaccctaaagagcaaggtgtaatgtcccaggaagccttttgatttgacttattaaattggaccaactttataaagttgctgatgggatgttctttgacctacaaaacattaatttcatatagtccaatgtaatacataggttcagtataagttcaaaactgacataaataacaattagactaaggagtcctgataccagtgatagattattgagatgtacttaaatagccatttttgctttaattatttatgatcttgaagtacttacaat

SEQ ID NO: 149543 - DNA, 197 bp, Homo sapiens
cccacaaccatctgaaagctttaaaaatataccttttaccaactatatatttgcgtgaggctaggtcatcttcttatcacttcttcaaaacaaattacagctcactaccagggtgcactattagccacgtaatacacctacacatgtactcactgtatctaaaataaaagttgaaattaaaaaaaaaaactaattgc

SEQ ID NO: 149544 - DNA, 400 bp, Homo sapiens
tgcccagtagacaagtagagtctgcctccatatcatcgaatggggagcttagcggaaggttctggaacctgtggagtgtggtgatggatgtggcaggtggcgtttgaagctgtccacaggcagccatttgcagtgtagatgctgtgttcctgaaatgcttaaaagcccagcgtccaagagtggaaagacagacctacatgtaacggagggagcgtgttcccagaaagccagaattcttagaaagcctctcattctgggctggcaggcagctccagctccaggcccccggggaggcaaaggagctcctccctccgcatgcggaacccacccggcccttccttccttaccccctgcatggcaagcatcccacaccgacggtggaaacacacgtgtgcacgca

SEQ ID NO: 149545 - DNA, 416 bp, Homo sapiens
agcttgatgttctgcattgctagggaggcctcaggaaacttacaatcatggcagaaggcaaaggagaagcaccttcttcacaaggcagcaggagagagaacccaaagctatttttatttgactttaaattacttcctggattttacttttgaatgtagatatcataaagtgataaaaattccactcaaaaaaataacttagttgtggccaggaatggtggcttacaactgtaatcccagcgctttgggaagccacggtcggaggataacttgagatcaggagttcaagactagcctgagcaacacagtgagaccccatctgtaaaaaatatacacatttttaaattagccgggcatgctggcgcacacttgtggtcccagctactcagaaggctgaggtgagaggattgcctgagg

SEQ ID NO: 149546 - DNA, 845 bp, Homo sapiens
  misc_feature (25)..(25): n is a, c, g, or t
gctaagcgtgactgactctcttagnaaccaccgctacagaaatcctttggctgaatgtggaggaaaagagcggaaggacttggggctgttgcagcaaaggagccccacctctgcaggttttgcccacactatgaagatgctgtgcagcccggggtgagggtgtcctggcttccataccgactaccatattcccctgtcccttgcaacccagtcttcctgctgtggctactaaagtctttgcctccctgctcatcaccgctcctcacacacttgaggttttggaagttgtcatgctggatctggatattgttaagttgttgatccttccaagaccagctgctgctctaccatttataaaaggccaagaagcctccatctccctttgtccagcacattctgattgtggtcaatctcaacagaaacacatgtagtgaaatgaaggccgggtatgtgggtcttttcctacgctgcaaaatggattcattgttctgcggaatttgagcctgaccagaacagcaggacttataagccccaggactgaaaataaactccacagtctttcagattcacaggggtcaggaaaggaggagacctagaagaatctcatgttccaaagacaaactctcctgctaccaaatacccacattctcggaagccgagaatatttggacatctcccagtgccagacttgcttgcatttcacatctgggcatggtgttgccctagagccaagataaactcacggtggggaagtccagggacacccaagtgttcaagaaatggcttttctcattcaggaatccttcccctgtcaaatcccaggaattatcttgggggtcagacag

SEQ ID NO: 149547 - DNA, 485 bp, Homo sapiens
tgggcagtgccccacagcagggatgcctgctgtcttgcgttctgaaaggacagttcccggcacctcgagacaggaggttttctatgcctatgtgactttgtatgttgcgtttccttctaaattttgttttatttctggggtgtgtgtactggtggagaactttggatttagtagaatatctgaggtgaatctaaatagattcttcccagtctcctggcttgtgtacctggacggttggagttgttgtgtcctgagatgggccaggccacaggcacaggaccaggggtttggtgtgaggcaggtcatgtgtgaggtacctgcttgatagccaaacgggcatgccaagtggttgagtaggggtctggagttgaggggagaggactgggctgaggtctagagcaggccattgttcatacctgcatcctctcgcaagcccgagacaggatgagattaccaagggagtgagagtagagaaggggagggga

SEQ ID NO: 149548 - DNA, 406 bp, Homo sapiens
ccactgacggttagagctttccgtgaaatttgtcagaagtgcatgtacaaacaatccacatgctcaaaactagagaaatgcatgtgaagaattggaggagaatgcatgctgccctgctttcacctgacagtgtgaagtcttttcatagctcccctatgcctgagcctgtatttatgggtccatcctgccatatatttgatatatataaaatgataaagcagcctgttaactggatttagtttacggcttttgagcaaaagtaccaaattgaagtcagagttgggtccttcatagttaaagccacccatgtaaggtgaagagaggggtttatcctcctgaaattgtcagtatggccatgttgatccaaatctagatgcagcaatggattctcagcccattcccattc

SEQ ID NO: 149549 - DNA, 397 bp, Homo sapiens
ctgtctatagaaggcgtgcaccgggccacagttgaggggatggggaggtgaaagcgagggttccgaggctcccgtgattgcggaacggggtgactatctgtcatgggaagcttgtacctgcctgccgctcactggatgcactccccaactgcgctttccaccgcctgtgccagggtctgtgctctttgaccaagatcagccactgcatgcttactcatccttttaccacctctccgtcgagagccggggggaaattaagggctgaaagaagcttggctagagatgcggggtgcctagagtcgtaggggaactcttgtgcgatgcggtgctgaatccgaggggatgcataggtggcagctttaacagctgcagccaggaagtaaccatgaatcaaatg

SEQ ID NO: 149550 - DNA, 436 bp, Homo sapiens
agagaggaaggaacagtgggagggaaacacttcagatagaaaacacttggacgctctttggataaatcagttgtgttcaacacactttccaaggtttttatggtaaagtggttgggatgtttggaaacataattttgattcaacatcctgaagtcattaaggaactgggagagggctgtagctcataccaaactgaatgcagaacgaggaaggctgcttaagtcagcatataatcactggtcatgaaaaatacccgtttaaactgtcgacagaattagttactcaaaagtcagattctggccggcttaatagaaatctgtatcttgttctgcggacaggtaaggttttttggattcctctagataacccaagattagaaccaaagctgtgtctaggctgcttctacagaggccactggtctctatcagaagcaccc

SEQ ID NO: 149551 - DNA, 446 bp, Homo sapiens
tatgagcttccagtgtgccacccccacccaggcaccccaccttggatagccaagagggctacctcggtaaaaaagagatcctaagacagacttgtaagctcaacccagagggtaatcctaattcatttccccctgcccaggggagacaaatgttgctatatcaatgactggggaaaaggcccacatatttttcatgtctcaccctcagactggagtggcgtctcactgcttctagaagattggaactattactgacttggtattcatatggaccaaaggtacctcctgttggacattccttaggcctgtcacatatggtccaagaaagcagtaagatggaaaagagagaccagctaagagctactccaaatgcccacaccatcagatgatcatcccaagtgtcagagatatctgtgaatcaagtgctcaaagctacacacattggg

SEQ ID NO: 149552 - DNA, 402 bp, Homo sapiens
tgcctgtaatctcagctacatgggaggctgaggcaggataattgcttgaacccaggaggcagaggttgcagtgagctgagattgtgccactgcattccagcctgggcaacagagtgagactccgtctcaaaaaataaataaataaataaaagaaactggagctgctaattttgttttgttttgttttttatgaagctgctaatttttaaattaagggacataaattattgtattcaacttttcatttactctatctgggcctgggaaatatcataattacactgaaaaccttgtaaacaatagcctgacctgcaacatcatcttagatgatttctgccccccttcttgcccccccccccccaagggcataggggggggggaactcctttaaagtcaaccttg

SEQ ID NO: 149553 - DNA, 406 bp, Homo sapiens
gaatcgagctcgcccgctgttactaaatagctgtactactgctgagtactaatgctgttggcctagcaaaaactaacccaaacagtaaatttatgccaagcattttcctcaggaaaaaaaaaatgtaggcatggtctacctgttgtattgattagtcccagaaatgtagttggtaaagttgggttttgctcaagtgtctggctttgtggattagctcagtcttgcatatagttttccataattgcttaacctaaaagcattctatttgattagtacaattagtttggctttctccctcttaccaatatcaattcatatgcattccctcctaacgttgctcactttattttgtaacaaagaatgaagacagcagaacttcctgttacttatttccatattagaagaa

SEQ ID NO: 149554 - DNA, 129 bp, Homo sapiens
aaattaggtctctggcctctgggctctttggattctacgatatatttttctcccttctgttcctttaaaggagcaaataagagggaccctgaagtcaccaaggggacttgagtcactgagtttatatcc

SEQ ID NO: 149555 - DNA, 409 bp, Homo sapiens
gaaactatagcatcacacagatttaaaatatgctagactgagacattcctggagtggcctaatgggaaaagcacagaggaggaagacctcagttcaatctgccttgactgtttactagctctatgtctaaagctgtttcctcatgtctatttattgcttttatcgtaagattcaaatgaaataacatctggtcagttttactttttaacacttgttttcaagacacaagattttattagagaacattttgagcataacacgaatttggggttgcttatgcactgtttagtctatgaaaaacactagggaaacacagaaaattgcacacacctgaacccagccaggtaagatgtacaaaacagacatgcacgtacctgaaacatgtcagctacctcagtccaccaccctc

SEQ ID NO: 149556 - DNA, 130 bp, Homo sapiens
aattgaacaggaatgtaccatgctgactaaggaaggaggggaggaaaaggtggtgcctacagaggtactagcatatgcaaaggtgagtagcagcaacatatgtaatttgacattgctatagcataaagtt

SEQ ID NO: 149557 - DNA, 474 bp, Homo sapiens
agcagggcctggtctgcccaatggaaccttctccagaggcctcccttgttaacattcacttcagctgcaagtttgacaactactgtggtttacatctcccaggacgtccttctgcccattcttggaaaggccatcccccttattctggctcatctgtcgtgtcctcccgggcatgtcttcaccctctcctcctgtgtgagtctctgggccccttgtttcccattctgccttgtgatgattttccttgctggtttcctggtgttttgggtctgctattgctgtagggcagggtctgcatgtgtgtattcactgttgccctggcactgaatagacaccagtacgcagttgaatgaggggattcccagcttacagatgagagggctgaggcactgaaaggtctggggggtgcgcagatctctctggcttctgtcctgtctgaaaggtttgggaggtgcgcagatctcgctggcttct

SEQ ID NO: 149558 - DNA, 546 bp, Homo sapiens
  misc_feature (23)..(23): n is a, c, g, or t
  misc_feature (59)..(59): n is a, c, g, or t
  misc_feature (79)..(79): n is a, c, g, or t
aggcggacattagcagcaacganagcacaaggtcccctcacactgacatccaggccgcntgtgcttttcccagcagtgntgcttgtgtgtcctccctctcatatgctcctgctagtcttctcattctcagctgatggcaactctttttagtcacagtctgacatttttggtatcctttactcttctttctcataccccagatttagtccattagaaaatgtggtataaagtgattggaaatagtaggaatccaatcacgtcccactatttccactgctcacaccccagttgaagtaaccgacatctccagcctgaaatactgcactcatttcctacagttttcccacctgccttgctcatcgccggcctttggattctgttctcagcagagcagctacagtgatccttttaaaagagaagttgtggcatgtctttattctgcttaaaactatctcattcaaaatcaaaatccttcccacatacttgagccctatgcccacatgatctgaccaaacccctgaccttatctcagtgactctctgctct

SEQ ID NO: 149559 - DNA, 192 bp, Homo sapiens
actcttcattttcctatcagtttattgttgtacatatgaggtaccatgctactatcagaattatatctaggttttttattttaaaaaactcagagaaaaaaatgtttccagtaattttcattcaatgtgaatgacaagaatattacagctataaacattgaaataaccatttcatttcttcctgaggaagtt

SEQ ID NO: 149560 - DNA, 332 bp, Homo sapiens
caagagttcaagaccagcccaggcaatatggcaaaaccctgtctccaccaaaaatataaaaactagtcaggcatggtggcgtgcccctgtggtcccagctacttggggggctgaagtgggatgatggtatgagcccaggaggcagaggttacagtgagccgagatcacagaactccaacctcggtgacagagtgaaaccgtgtctcaaaaaaaagaaatttctagaaatggacaggggtgcacctttacaagtttttaaatacaatggttaattaagagcttgtactaagagtagaaagaatgttggttctgcaagtctatagcctttattc

SEQ ID NO: 149561 - DNA, 327 bp, Homo sapiens
cagagcagtatatggcaaaaaccatgaagctagtccaaactagatgcctaagaaaggaattttacattaatttgcaagattgtttggttaacctctgtttctcccaaagtcgcacacttgcctcgcaaggtgctgaaaccgtcacatattagcaacagaaacactagcagctgattaccccttcacttgtcagttagataagaaaagtgagcatatactacatgccaagaactgtgttaggagtaggagatactacagagatgagcacagtgcctgccctcagggagctcacaggctggcagagaattttttaacaattctgaagga

SEQ ID NO: 149562 - DNA, 499 bp, Homo sapiens
tggaagacggggaggaggggcagaggccacacccagattttcagacctgagccaacagaaggaggaacaggcagagaggccacagctttgcacccatactccctgcctgcccagacacctggggcagctcgctgttcacagcagtccccaaaggtccaaagtcctgaggctgcagatctaattgaaaggtctgagtggaagagcttcagagatcaggatgtcactcccaacccactgccccaagtgttctaccagtgtcaacccaatcaatcttaaccaccccagaaggcatctcattttacagatgagaaaaccgaggccaagagctcacagccactcaaggtcacagcgaacagtagatgcaggagccagaattccacccgcggtggcagtcacacactttcaaccacaggctcagtcagcgtgactctccccagggcctggcagcaggtcaccgtgccccggccacactctcacaactgtccgtaacagggcccct

SEQ ID NO: 149563 - DNA, 437 bp, Homo sapiens
tcctagagatggggggtttcacgatattgcccaggctggtcccaaactcctggcctcaagctatcctcctgccttgacgttcgaaagcactgagattttcctctctgtcctgccgccatgtgaagaaagatgtgtttgcttccccttccaccgtgattgtaattttcctgcagcctccccagccaagctgaactcgacattcctctaagccggtcttacccaccagtggctgaaaagctttggaagatgaagatgatctggccaaaagagaagatgagttcatggacctaggggatatgtgacctgtttattgagtgattgtgaaagaggaatgtgggagattgggacagctgatccccggattcatgtcacgctgcagctaatgctggctggatccttagcctggcactctgttggaataaacctgggtctttggg

SEQ ID NO: 149564 - DNA, 671 bp, Homo sapiens
tccctcccctgctatgactctgcatttcacctctccaggaggctaggcaggtccccagtccacaggccggagcttctgcactcagggcctctcacagctccgtgactcctgggtggtccttagggtgtgagtgctttacccaggagcacttctactccatttggatttaggttatccttggagttagttgggctaatggttaaaggacagtttatgggatgatgccccattccacctttttgaacaaacttggcatggacagaagccagaatctccatctctctcatgctctcttccctatcaaatgtccctacctctaaataagtttcctccaggaacagcatctctggttgctttgtggaaggaaacacaaaacaatataactctccatttaaagtactctctacatgcccaggtctgctaacttgtgggataaggtattctgattgtgccctggggaattaaactgctctttaagtaaacccagaagataactaacaaataatcctgcaaattaatagtgcctaaaagatgaaagttatcagtttccttcatacatccggtttattatcagtggtgcaattaaattctattttctgctgtggtttgagcacttcacagcttgggaagcctctctcctgagaccttcacagggacaggccgtcacttca

SEQ ID NO: 149565 - DNA, 144 bp, Homo sapiens
ttacggcctccatgtctctctaggccactcagcccacaaatctcttcccactttggtcactataaagctgccaggtgatcattctaaaatgtacatttgatgcttttattttcctcagtgcatgagaatgaagtccattcaccc

SEQ ID NO: 149566 - DNA, 502 bp, Homo sapiens
gccaagaatccctaagtagcaaataaaacctttcaaccattgaagtagagttataacttccagacactaaagctggagttcgtcttttgcctatttaatctatatattttttattttttagagacagtgtcgctctgtcacccagcctagagtgcagtgacatgatcatagctcactgcagcctcaaacttctggactgaagcaaccctccagcctcagccttctgcatagctgggactacaggtcccagcacaccaccatgcccagctaaattttttacagagacgaggtctcactatgttgcccaggctggtctcaaactcctgaccacaagcaatgctcctgcctcagcctgtcaatattttacctgtatttctcatcagcttggttttttggtcatggttgttaatttttgaattatatgaaagtcctacatagaaggttctctcctggtgttttggcagatgtaagaaaattgatttcgtttgtagctgttaatttg

SEQ ID NO: 149567 - DNA, 511 bp, Homo sapiens
ggttattgccccccattttgggggtttgagaacccctctatttttctcccccagaggtgagcacagtacccacagtaggtagtatttcagccctcgctcattccctttctcctccatctagtagtccccaatgtctattgttctcatatttatgtccaattagcatttgttttttaaaaagggtggttgaagaaattctcagtgcttgtcagtgtctctcagtgcattcatttaattcatgagccctggaatgatggtttcatttgggcagaactctacaatcaaaaagaagtaataaaagggaaaaaaaagtgaaagccatcaactacaggattgaaattcccaaagcatcagaggtcctttcaaaaaatagtatgttgatttttaatttttatgacttattggctttgttcatgaaaatataaacatgttatcacaaaggattttttaattcaactatttctcagttttctctttcaccttcaaaataaaatatcataaattatttaaa

SEQ ID NO: 149568 - DNA, 243 bp, Homo sapiens
tttggactagtgcagcagtcaggatgacagaaagaaaagcagatgtacaaaaatgcagaaaaataaagtgtgaagtgtttgtaggtggagagatagaattctttgctatttgtattgaatccttaatatattctagtgcagaaagcatgaagcatggctaccggaagcacacgtgtcacacatcaaagggaagctgcagaaaacagcagcgttggtgcaattactctttcttatatttcccct

SEQ ID NO: 149569 - DNA, 400 bp, Homo sapiens
aagacacacacaaaaaaaacactgtaccactggctaatcaaatattagataaggcaaagtttctctatagctaataaggaataaaattaaaaactatcacaattttacatccctttcatgaattaataattaatgaagtatgcaacaacacctgttaacagaaagccataaatagatttcacatgtacctgatggaagaccatatattacctatgaagtcggtttttctgcctaagggagagaacaggggatcagacctcaatctgatcaagcctctggctccaactaccaatttataggaaatacaaaggacagaggaacacatgaaagtacaacatagtgggccaggagctgtggctcatgcctgcaatactagtactatgggaggccaaggtgggca

SEQ ID NO: 149570 - DNA, 133 bp, Homo sapiens
ctgacagtcctgggggctgggtccttacgacccccactgtgacttaagcagagagacagggcccagcctgtgcaccaaagccccacaggaacccagtctccgcagtggctccagccctcagcccctgccccga

SEQ ID NO: 149571 - DNA, 542 bp, Homo sapiens
tggctttgaggatcatgtgtatcatgatatataaatgacttaaatttaagtgctatgagatctgtgaattgactttgtaaactgtctagaaacaaaatgagttgttgcaaaaggtcaagtaagatcaagagtgaagaagattcattgtctttctagtcaggaggccatcagtggcctcattggaagcattgtcagtgaagtggtgaggctagaaaccagagtgcagtgaatcaggagtgaagaagtagatttagcatatatagcctattcttactagaagcttagctaccaggaaaggaaaaacaaaaggacactgactagaagtgaatgtagggttgaaggaaggttttctcaggtatgagtgtggggtactgataggaaggtgcaagtggagaggacaagtcagagatacaggagaggtggtgccaatcagagccgggcctccacagaggctgctgtaggggtgggaaatctggagctcagttctcttctttggtttgggaagttgagtagcaggtggagacagggtgcctcacgcagga

SEQ ID NO: 149572 - DNA, 367 bp, Homo sapiens
cgttggggctggtggtctggggcaacacagatctgccatcagacagcctgtgtggcttccgtggctcaccgtgcttccctgagcttccctggttcccgctgatgaaacagagaaatcacctaccataagagttattgtaggctggggacggtggcacacgcctgtggccccagtgacttgggaggctgaggcaggagagtcacttgaactcgggaggtggaggctgtggtgagctgagatcgcgtcactgcactctagcctgagcaacacagtaagactgcatctcaaaacaaaacaaaacaaaaatgctgcaacctatatagttcagagatctgaattgggttttctttgcaattctggaatcagg

SEQ ID NO: 149573 - DNA, 243 bp, Homo sapiens
gtcagcggcacaaatagcacagagaccttagcttcccgacctgtccgaaaggtgtttcctgggctgaggtcaaggcgttggcggccggctgtacctccggaggctccagggaggctttgtttcctgccctttgctgcccacattcctgggctcgggcccatcctgcctccagccgcagagcctgtccccatcattctctctgcctccacccatggtcatggctgcttccttgactcagccctt

SEQ ID NO: 149574 - DNA, 354 bp, Homo sapiens
tgaagaaaagggaaggctgactgaggttaaaaacaatggagcttgaacaggaacacagaaacagctctgactagaaagacaggtgtgtgtgtgtatgtgtgtgtgtgtcagagacagaaggatagagacagagagagagaaaatttgagagtgggaaccacagagcacaagaagaaaaatgagatagaggtttggagaatatgagcctgcgaacaatgagagaggtaggagaaagtatattattttcttttctgaggtgtgattcccatagagaatatctcccttgggggtaggttagatacctacgagatgcaaaacacaatgtgctctcagttctgccaggtacatatttaa

SEQ ID NO: 149575 - DNA, 280 bp, Homo sapiens
tggggaactagttttagcagctggtttcaggatcagttctgctatactcagtgttaataccaagctccagttaacttcctcacggagctgaagttcagcgctgggttgagaagatccagttctttttgagaagacacgcacacacagacacgcattccctgcccttcttttgaaataactcacttcacaaaaatggtcacttttcataaatggggacaatggggaacaatctttccaagtccctttggaaatgcagtcactccctcaaggcagagcctgc

SEQ ID NO: 149576 - DNA, 375 bp, Homo sapiens
caggcatgtctgctgcagtaggaatgtttcatttggtagagaggaaacataagaaaaagtaggattggtacccaccattattattaaaaagtaggattgctaccagccattattattaaaaagtaggattgctacccgccattactattaaaaagtaggattcctacccgccattattattaaaaagtaggattggtacccgccattattattaaaaagtaggattgctacccaacattattattaaaaagtaggattgctaccctccattattattaaaaagtaggattgctaccctccattattattaaaaagtaggattgctacctgccattattattaaaaagtaggattgctacctgccattattattaa

SEQ ID NO: 149577 - DNA, 297 bp, Homo sapiens
catagcctcatccagtggcatgccctcatccagtggcatgccctcatccagtgggggggcttccccagtttttggtatcgtatttatatcagcattcagacttcatctccggaggcagaggtttcctgagccacagctgcctggtggcagaggctgtaccatccaccacctgcactttgcctttgcaccctggggaacccgttggaaatgagcactatgaaaaggtggtggccgaccctctgccagtgtgtgctgcctggaggcttctaagcctggggcatctggagaggtgctttg

SEQ ID NO: 149578 - DNA, 430 bp, Homo sapiens
tgtgcacagcatctgggggcactcaggtggccctgctgtctctgggcctgtccctgacactggcaggggttggggcaccagagttcaaatgggggccgcatatcttgtctaaatcttccagagttttaagtcaagccagtgcactattgatacaatatgttgtgtcttcttctttgacaactacatcttcaaaatggaaaaaatatgtggggacctatggtttttatatgaattaatgttggcaaaatatcaaagaccactgaatttaactgttaatttaactgttatctaggtgttctgttcagaggccactcatgtttgaatgagtaacaggatcaagacatgatttatcaataagtgcatatatctcccataacattgattattttgtttttatttctgcaaatgactaatcatgttttatattaag

SEQ ID NO: 149579 - DNA, 186 bp, Homo sapiens
cttgacagtcagtagcagggtgattgtattttctgttactctttttattcagtgtaaggttttcttctcctttttatagtcctctactgagtccctggttatccttgacttagagcaattccatatcacatagatctccaaattccccagactagaaaatgtgctattgaaacttctaaaactagg

SEQ ID NO: 149580 - DNA, 311 bp, Homo sapiens
ctgggtttcagtctgtggggagttggaggatgagatggggaaggaacagcaggaagatttagccaaagctgggattacaggcgtgcgccacagtcttcgcctgatatcaggcgaagactgtggttgaaagaacacttggacggggtggggtcaggtcctagttcaggttgttctctttctatgtaagatactttaagtctctgggccctacatccttttaaagtgaagggatcagactggatgaaaaataaagtcaccttaatctaaattcaatttttcttatctctgtccttccacagtcttcgcctgat

SEQ ID NO: 149581 - DNA, 414 bp, Homo sapiens
catcatcctctgtccgctacgatccccagacacttttgcatggctgtttagacagaattttcctgcagctcttttgggagtagctcttgaaagtttaacccctgacagttgatgaagaacagtgaggcttaggaggcaggtaggcctttgagcaaataactctgagcaactggttgccattgtcagttcccctaccaagtatgcgtttgatttttaaaaggattccccaaagttctatttaggactacagagtctctaagaatgtatttctgttgtcaaggtcaggagcaagatcatctctgtggacctgtcggtttgaaggagttgcaagatattctcatcattcattgatttatatactcaaaaaacatatatttgcatgtgccaggaaaaggtaaggaaagggagccttca

SEQ ID NO: 149582 - DNA, 269 bp, Homo sapiens
cttaagtactttgagatactttagtacttaactttaaatacttcaacttaagtacttctctcagctcccctgccagggagtctgtgctgagactaaggtgaagctgcacaaatgctgctctgaagcagggctgcttttgagaaacatgcagccctcggccctatttaaataaaactgtttcaattagaaagaaattaaggctcttctcagtgctgctgcttgaattacttaataagctttaaacctcagccccacgccttccatgcagg

SEQ ID NO: 149583 - DNA, 159 bp, Homo sapiens
ccaccttggcttcccaaagtgctgggattacaggtgtgagccaatgtgcccagcctaagattttgacttttgggactcaagggcccagtgaaataggagtcaaagatccggggaggaggctggttttcccctgaagacacaatccaaattctatagcca

SEQ ID NO: 149584 - DNA, 405 bp, Homo sapiens
ccggtaccttccgggctactcacatctctgattccatgggtctgaggcggggcccgggaatgtacattgcaggacgcacttctgtgccgctctgcctgctcaggggtgataaccgcggcctcacacctcctcactagggggattcctcagggcttatgcccctgagctcacacatacccctgcacccgcccttccaggcccctcctctggcagttctcaggccagtggcagctgagacctgacactatctcgggctgtgctgctacagggagaggagcagagagcatggggacgtggagaagggagacgccatcctaaccctccaggagacacccaggctggtatcctacacatcctccctacagcgtaacgaaagctaacaggcagcacttagtgtgtgcagct

SEQ ID NO: 149585 - DNA, 777 bp, Homo sapiens
gcagatcaggaggtcaagagatcgagaccatcctggccaacatggcgaaaacttgtctctactaaaaatacaaaaattaattgggcatggtggtgcatgcctgtagtcccaactatttgggaggctgaggtaggagaatcacttgaaccctggaggcagaggtagcagtgagccgagatcatgctactgcactccagcctggcaacagagcgagactctgtctcaaaaaaaaaaaaaaaaaaagaaagaaaaagttgttcccccaagttcaaagtaaatgctaattttgaacaaaatcaaaagcaaatatagtcagcttcactataatctgggaacttacatatgcagcccataaatatgcctcagagtacaaagagcttaggatttgaaaggagaggacctgcgttcaagtttgagccccgacaatttctggttgtacgactgtgcataagaaatgtccccctatttgagctttagtgttctcatctgtaaaaatgaggataaatgaatccaatcttaggatagctttaacgtttagataatatatgtgaaagtgttttgagaactgtaaaataatactattatgtatgcattcttcagaacgaagtttagtagcacattcattttgtgttcaaatagcttggctttaaagaagcatctctttaagaataatctttgttgtggctttatgttacagatgggaaatgtattttaaaatttatttatgccctgactagttgattttcccatcttttaatcaagaccaaacagactttg

SEQ ID NO: 149586 - DNA, 599 bp, Homo sapiens
gtgggaggtgagctgaatgtggtactatttcaagaaaaagttggttgtgaaacagaagacatgtgcaccaggagagaaatataatgcattttgttttcttcttttactgtaagtgcttatctaaacccctcaatgaaatatgcagggaaacagacatatactgctggtaagactacaacctggaacatcttcaaagttcaataatgcagaatttatgaaaattaaatttatagataccctcagaccaagcaattccacttttgcatatttagcctataaatatatatttgtctgtaactgaagtgtgcaaggatttacaataccacattctttttttttttttttttttttttttttttgagacggagagtcagagctaagaaaaggccaaaagacagcaaagcatcacaaaatttcagaagagagtatcttaagaatgatgacatggctaactcgtcaaatactgctggggagtcaagtaagactggaaaaaaatacattagggagaaaagtccattggacttaacaagtaagaggctaacggccttgctgagggccgtttcagtagattggcaggggaagatgccagattagttgac

SEQ ID NO: 149587 - DNA, 657 bp, Homo sapiens
gtgggaggtgagctgaatgtggtactatttcaagaaaaagttggttgtgaaacagaagacatgtgcaccaggagagaaatataatgcattttgttttcttcttttactgtaagtgcttatctaaacccctcaatgaaatatgcagggaaacagacatatactgctggtaagactacaacctggaacatcttcaaagttcaataatgcagaatttatgaaaattaaatttatagataccctcagaccaagcaattccacttttgcatatttagcctataaatatatatttgtctgtaactgaagtgtgcaaggatttacaataccacattcttttttttttttttttttttttttttgagacggagtctcgccctgtcgcccagcctggagtgcagtggtgtgatcttggctcactgcaagtccgcctcccgggttcacaccattctccttacaataccacattgtttctaatagcaaaacactggaaccaacctaaatatccagcaaaacaggactaaacaaattactaaaaagtccctgcaatggaatactcatttcacaaactttgtaagtttaagttatataactttaagatcaaacctgtccgtaacatacaagaaaagaaaattaaatctgatctcattcatgcagaggcaa

SEQ ID NO: 149588 - DNA, 815 bp, Homo sapiens
cacttcggagcctggagcacagggcgagctctcctccgccctgcagcctcaggtaaggatccggaccttcactgctgccccaactggggctcctcagctcggggcctctaggggcttgggctgctggtctgggtggaggcgcgttgggggtgtcgaggagcttgggtgcaagccccatgcgggaagctcagggcaaagcgccttgaaaccctctctagtgaaggaaggtaaaatggctccgggaccccaggcggggaaagaggtgtccaaggaggagggctggagagtaaggcggggatggcagagggtacgcagaggctgagaagtgggaccagtgtctcaaggggcgccagcctcttcctccgcccaacatggccaccatttttgttgggatagccttgggctcctgccagggaacagcagggcagtgagggagtcaggactttgggctggtggggaggccgagaatcaaggctctggggagtcaggactttggggctggtggagtggctggggactgaggccctggggggtcaggaccttgggctgctatggaggctgggactgaggctctgggggagtcaggaccttgagctggtggggaggctgggaattgaggccctggtgtgttcaagaccttgggctggtggggaggccagggcctgaggccctggggggtcaggaccctgggctgttggggaggctggggacttaggccctggggggtcaggatcttgggctggtggggaggctgaagggtggggactgaggctctgggcagtcaggacctcacggttggggtggactggagacca

SEQ ID NO: 149589 - DNA, 837 bp, Homo sapiens
cacttcggagcctggagcacagggcgagctctcctccgccctgcagcctcaggtaaggatccggaccttcactgctgccccaactggggctcctcagctcggggcctctaggggcttgggctgctggtctgggtggaggcgcgttgggggtgtcgaggagcttgggtgcaagccccatgcgggaagctcagggcaaagcgccttgaaaccctctctagtgaaggaaggtaaaatggctccgggaccccaggcggggaaagaggtgtccaaggaggagggctggagagtaaggcggggatggcagagggtacgcagaggcctctgatgtcggctacgacacgatttgttctgtactcaggcgggggaacgtgacttccatccagacgcactggccagcagccccaggctgggctctcccagtgccaacttcaccctgggccctgtgagccgctcctacggcggccagtaccaggtgctaccgagtgcatcacaaactctcctccgagtgcgtcggcccccagtgaccccctggacatcctgatcacacggacagcatctctgacaccgtctctctgtcagcacagccgggcccaacagtggcctcaggagagaacattgacctgctgtgtcagtcaacggcggtatttggaacactttcatttctgtaacaaaagaagggggacagatccaagtccctcaattgacgtttgatcatccactgttccggagctcattaacgataccaggccgcaatttcccccatgagttcttgctgaccctcagcccacgcggtaacctatcaggtgctaaccattccagacagctccaaaccacacc

SEQ ID NO: 149590 - DNA, 463 bp, Homo sapiens
agagaacagctttcaagcaagcaatgaggaactccatatgaagcacctggagctcagcatataaaacaggcagacaagaagcagggaggccacttggcaggctgttatcattgtcctaatcagacataataaaccctgacccagaggaatgggtaggaaatgaagattgagacagcagtaaaggatgatagtattttgaccagaaaaactaggaatcttgttgtggccctgccagccctcctactgagaaaagcatcagacctttaagcatgtgcagttactcactccttccaccagcctagggggcctaccacagcccccaaatttaataaatccagggatggaataaagaaaactggggctaaagggggccactttcatgtggagacccatcctgggcatctcacacctgtttcctagctagttgatgcctccactcccctttgatctctaccctcaatgt

SEQ ID NO: 149591 - DNA, 879 bp, Homo sapiens
  misc_feature (417)..(417): n is a, c, g, or t
  misc_feature (646)..(646): n is a, c, g, or t
  misc_feature (657)..(657): n is a, c, g, or t
  misc_feature (731)..(731): n is a, c, g, or t
  misc_feature (770)..(771): n is a, c, g, or t
  misc_feature (842)..(842): n is a, c, g, or t
ttctaggcaagccattttacttactttggactcattttcttaatccaaaaatggaagtaaggcttgtcatctgtcttattcatagtcacaggtgaggagctacagtctaaatgcatacgcatgttgggaaccgaagtcagccatcttccctaggacaaatctttactcttctaaagaaggaccaagaataaggtctactttcagctaaccttttataaggttcagttttcattggatcaaaggagtataatctaatactttttaaatggggtcaaaacagtattataaggaaaatatttactgcaaatatttataattgtgtaaggagaatcattctttttaaaatcaagttgtgttttagctttagaatcttttaaaatcacaaggatttgagaatcccatccccaccaaaattanaaaatactatattagttattttaaaccagattcattacttttactgtttatggtataataaacttatgtatataaacattgaatatgcatggacaaagtacaagtccgaacatggataaggagtatgtgctgtatgttgggggggcattcgcataaaatatgagaaaatttacttatttaaacatatatataataaggggcaggaagaaaaaaaaaaaagaatggcctncgtggcctacnggggggagcttgcgggcccttcccttagggggggtaattgctgaacctcgctccctgctcgcgcgcttcggttncgggtgcgcgaggcggatcagcgactcaaggcgggagtnngggatcccgaagtcggggagcgcggaagaacagggagcgaccgccgtagagcccagacccggaaggcgggngcggcgcgttcctaggctgccacgccgcgacatgaag

SEQ ID NO: 149592 - DNA, 334 bp, Homo sapiens
gcagttatactgaggtataattaacatataataaactgcacaaaaagggtacagtgtggtagtcttgacctaggaatacacccatgaaaacacctccacaattaaaatagcacatctgtggccctcaaggtttcctcctgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacgggatata

SEQ ID NO: 149593 - DNA, 162 bp, Homo sapiens
tcactacattccacaaggtgctcatgtgtcctaaaaacattacttcattttaaccatttcacaacctacacacaaataagtgcacaaagaaaaccaccccgaggggcagatggctctgacagtgcttctcccaagacagggtgagacggcctcactctccag

SEQ ID NO: 149594 - DNA, 321 bp, Homo sapiens
cctaaatgtattgattacttgtccccttcctcctttgtgacaactcagatgtattatatccacatactacttactcctctgaattcctccagggtagttatgcttttgcaagatgtggtaagtctatattgacaaagaaactcccagttatctatcaatttgttcctgaatgaatactgatgaggacattgttgatgatatcctaacgtatcttttgtatggggaagacctttgtctcagttgggaaagcaatgaggcttctcctaatttggcaagcctttttatgccctaaactcaccaagtcttcccaatctttcctct

SEQ ID NO: 149595 - DNA, 400 bp, Homo sapiens
tagcgtggctgctaggagtacaagttttgtgaatttttgtaatcacataatttgtcaatgggtgggagtaaagttttgctgatgaagttaatcctgtgataaacataaccatctgtcatttttagagaagcaacagcaggctctctgggataatatcctttgccatatggcatattgttctctatgaatatcttatacgttgaaagtgatattctcattataattcaaatttttgaagctgtaaattgcttggatttttgagcagttatgaacctctgctcttgtacacagaactttgaaaatgatgatttatgaacagcaatgactccatcttagaacaataaagacccaaggtacattttcataaggcacaattagatgccatgttgggcattgataa

SEQ ID NO: 149596 - DNA, 325 bp, Homo sapiens
ctagtagtagcccagctgagatgcaaagccctggtccagctccagagtccaggcttgaaccaccactgtacaggagaaaggggtcagatggccaccaggagtggccatcagggccttgagggccaggcttgggtcaggcagatgaagactctgaaatttcactgctcccagcccagcagcaaaaggactggacagagagactggtgccgggggatatgcatttccgaagcctgcgcaccaaactgctacttatgtcccgcaatgaagaagctaccaagcacctagagacaagcaagcagttggcagcagccaaccgtggactagt

SEQ ID NO: 149597 - DNA, 261 bp, Homo sapiens
atacagatctgaatttgccagtttgccatatccaggctgtccctgttgcctctggtccaccttaagctaggtgcaaacccagttggaggaaagaaaggaagttatgtgttctctcttcaaggaagaaaccagataccagcctcaaactcttgttcttaggtcacttctttccttggtccatttcactcctcactctccattcaattaaaggacttgcagattaggttatttgcaagtatttctgtaatttattctcctact

SEQ ID NO: 149598 - DNA, 288 bp, Homo sapiens
attctgctgagtggcaagtaaaaacaaaataaccacaaccacaaacgagaagtctgtccaaagtaaggggcccaagcatactctggacacagaaggggtccaaacaaagatgctctttcctggtcagatatctctggcccatccattctagaacattgtctgggcctcacttcagggctggcattgaaatgagaggagtatgtgatctcaagtctacgaaatgagcccatataacagcaactctaccaccccagagttcaataaaatcccaggagcacaggtctcaac

SEQ ID NO: 149599 - DNA, 160 bp, Homo sapiens
ctgtcttagaggaggagggagatgcacacctcatttctttctgttgcatctttgatcccactcgttcctgcctctttgggggccttccaccatccattgccactccctactttcatctcttcttttccactagattcttctcttgagtctgtaattaggg

SEQ ID NO: 149600 - DNA, 443 bp, Homo sapiens
cagccagggcgacagtgagaccccatctcaaaaagatgttgggacaagtgggcaaaaggaagattagagacttgctaaccgcaggtccctgccctgctcaacaagtgaggggttgactcctccacacggtgctggccactggggctgcagagacagataaggctcgtctggaatgggctgactctagagagagcatggatttgcagaattcatgtcataaactgccaagtcagtcaggagtcttacttgatgaggttgtgtagacagccatctgttgaggccgtgggaacccatccatcatgttcatcctagcacagggcttgacacacagtaggcatctgtaaatgatgttaaacaagcaggtggatgaaccgcaggaatgaacaagaaccattctctttaccagcatgctgtgtcccaggctttgtcagacagctctcctg

SEQ ID NO: 149601 - DNA, 288 bp, Homo sapiens
tctttgttcctggtattctttagagcaatagttttcatagcgggggatattctttttaagagtaccctagctactaccttcgctccctgtttgagaagtgctaaatatgtgtggttcagaaaagatacctcgatgatgtctatataatccttcaacctattccacccaggctgaaagctataggggaagagcaatacagttgacccatgaacaatatgggaattaggggcaccaaccccactgccatacattagaaaatctgcatataacttttgactccttccaaac

SEQ ID NO: 149602 - DNA, 487 bp, Homo sapiens
ttaaaatgatgagaacattcaaataatagaagcagaatttcaaatttgctacagttcctgtatttctatgctgtatctatgatcgtctgtactaccctttcagtgccgtatacagggttaaaggaaaagcaaatgtagaataagcacagttcgttattatctttcttttttcttgcagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagaggtgagcaaaggatcatgagccatgtggcat

SEQ ID NO: 149603 - DNA, 262 bp, Homo sapiens
gggccatttttcatttccttgaaagtgccaggtttcccttgtctcagagtcttccaagatactgttttccctacctgtagttttccttccctctcctagctaatgctcattcaatctatagatctcaactaaattatcacttgaaaaagccttctctgagacttttcagattaggtaaaattcttctatgtaagctcccaaagcaccttcctgttatttatcattagattagtttcagtgtttcatgaaagcaggaactaag

SEQ ID NO: 149604 - DNA, 225 bp, Homo sapiens
aggaggctgaggcaggagaatcgcttgaacctgggaagtggaggttgcagtgagccaagattgtgccattgtactccagcctagggcactaggagagacaaggaaaagacaaggaaaagagggaagtctgagtttcttataacctttcaaggaaatacctctacctaaaaatcccaagaagggatgacagaacataaggctcataaagatggcagttcagtacaa

SEQ ID NO: 149605 - DNA, 420 bp, Homo sapiens
gctgttccaataagcacttccatcagcaatgaatgatagttctgttcttccatatccttccctacatttggtgttgtgtgttttgactgttagccattctaatagatgtctagtggtatctcattgctgtttcaatttgcaattcctgatgacacatgatgtcaagcatcttttaatgtgattatctgccatctgtacatctccttaatgagttgtctgttcagagcttttattaattttttaattgggttgtctgttttcttactgagttttaaaagttcttagtatattctgagtacaagttctttacaagatatgtccatggcttgtcttcattgtcttaacagtgtctttcacagagcagaatttaaaaattttaacaaagttcatcttgtaaactttttctctcacagatagtgc

SEQ ID NO: 149606 - DNA, 241 bp, Homo sapiens
gcggggcggagagacctggccttatccctagaagctctctgcctgggctctcatgacagatgggatgggaacccagtgggtcttgtgaggccaggtctctgacactgtccttcccaacagtcccttactcttgggtcttgagttggtgtcctaggaagtccatgtctcatcctggggtaacccagggctcagctttttggaagtaggaagccagagacagcagctctgtgtgcagcctgca

SEQ ID NO: 149607 - DNA, 112 bp, Homo sapiens
atgggttaagaattaaaagtaccaatagcggtactacattcatgccacttagcaatgaacaatcctatttcctccaaaagaatgatacatcattatgacatagggctagaga

SEQ ID NO: 149608 - DNA, 377 bp, Homo sapiens
tgggtgctgactcagggggagtctggaagcccaggccaggagggttcccagaaccagctgggatttgggggccgtggggaaccacactcattgaaaggagtaaggggatgggtgcagggaagttgaaatccttgtgctggatgataattctgatttatatgcaaaggatgtgcaaaaactattagggtttcagatgagattctcttctttccttctcatttcctgaggcatctggttagcccacagtctccactagttgcccttaatgtgtaaggccctggagaccatgaagtgtgagggagatggatgtaaagcccctactgacgtgatcatgaatcgttacaggtgtggtaactgatgcgagcaggggctggtac

SEQ ID NO: 149609 - DNA, 686 bp, Homo sapiens
aggtataattgagacacaataaactctacctgtttaaatttgataaattttaacaaatatatacacagataaaaccatcaccacaatgaaaataaaatccacatgcataacccccaaattcctttgtgtcctttggaaattctcttctcccacctatggctcttcccccaacccaggcaactactgaactgctttcttgacctagacaatagttttcatctattagtattttatataaagaatcttttttgtctggcttctttaatggaacataattattttgaagttcattcatgtcattttatgcatcagtattcattccttttcactgatgagtagtgtcccattgcattgatgtgtcatggtttttatccatccatgttgatcgatatttgggttgtctctggtttttggctatcacgaataaaactggtatcaacagtgaaaaaaaaaaaaaaaaaacaaaacaaaaacacaaaacaaaaaaaaaaacacaaaacaaaccataacacaaacaaacaaaacaaaaacaaaaaacaaaaagcgggcggcgacccacaaaaagctccccacgggggggaccacactgactgcacacacccagcccttctgtcacacagaggcgcccactaagcggccagatataacaagcgagcgcggcgccagctcatcaaaaccgcgcgagt

SEQ ID NO: 149610 - DNA, 373 bp, Homo sapiens
gggcagaccggggagagggaacgggacgagagccagagggggtactcgtggaaacccatgcgcatatggtgcgacaagagcgtggccagggtatctcaactacaaggcgtacaagctcctcgtaagtgaacccacgcggagccagcatactcagggtaagtcgttcagcttcagtgcctcaatttccaaggtcctcagcatcctacaacagaaattaaatcttcccacataagcagccacatagccctctcactgtttcttagtttcagctgccatagcagagagtaatggcctatgtatttatttgaggtgcttgctcaagactctgttccctccaaagtgaaattcatacatgccacacagtctacatttt

SEQ ID NO: 149611 - DNA, 311 bp, Homo sapiens
ctgggagacttatggatacgaggagttcgtggcgtgtgttcaaacgagctgggagacttatggatacgaggagttcgtggcgtgtgttcaaacgagctgggatacttatggatacgaggagttcgtggcgtgtgttcaaacgagctgggatacttacggataccaggagttcgtggcgtgtgttcaaacgagctgggattccccacaggaatgtggggaaaatgcacatggtcagtttgtcttaattgtaataagacaagcttaatttccattttcatcgatgattttaaacctttttcttgctactcttc

SEQ ID NO: 149612 - DNA, 410 bp, Homo sapiens
acaaagcccgaaatgaaacccctgtgtatttgctgcagattcccaggtgcctcttaagtgtgaggataagctcagaaaaggcttaataggtttattaagttgtcatccattaaaaggttcacatgctccttgtgtgttgcataaggacaggtgtctgccacctcattgcatttctcactgagcattgcctaggagagggtaagccctaggatttagatccctctcagatgttcaggcagaataattttgtcaggacaaaagtaaggtcacggaactatatgaaaatggattatgaatcctaagatatcagcctattctcccctatgtctaagaagaatattcctcagcttatgactggaatgtcttgctaggggtgctgggtaagttttgtggaggtccccaccagcaga

SEQ ID NO: 149613 - DNA, 206 bp, Homo sapiens
cctcctaatacctctgtacccaggggaaaatgttgtcagagactcaggaggcaatgatctcatctctgaaaatgaccaagggaggaggaactgtgtcaatcacaataggcaactggacttgagaaaaggagaaatttgacctacactctgcatgtgctgggaagcttctctgggtaaagggtgggtggcttagaaaaacagtacaa

SEQ ID NO: 149614 - DNA, 468 bp, Homo sapiens
ttctcagtgagtgagattttaacattgtaacgtatcaccaaaaagtaaagtaatgcactacagactcttaaattgtcactatttcccttaaaccccctcaaaacacagacaaaaaataataatttaggaaatacgagaagtgtgggcgaggggtctgggcatgttacttctatcacagatttggagagatgttggccaattgtcaacagtctgtttctgggtcctgtggtctagagtcccccaagagcaagccaggggtctccctgagccagcccagcctcaggtgtgtttccaccaggttccaggccaggccagtcttcctgggccagtgtggaccatgtacttcctgtggttagctggggttctctaactttcccatctgagtcccctggggagctggtgaaaactccctcagggtttctgatgcgataggtctggactggagcctgataatttgcatttataatt

SEQ ID NO: 149615 - DNA, 536 bp, Homo sapiens
atggcatagccgattcctgagggaaaaacgacggtcagtgaacctgtaaaaatgtctataggtgattcccgggggaaaacacctgcaatcccaacaccttgtttggctgaggctggttacttgcttgaacccgggcggtgggggttgctgtgagccaagatcacaccactgcactccagcttgggtgacagatgggtgatgttggccaggtgcggtggctcacgcctgtaatcccagcactttgggaggcctaggtgggtggatcacaatgtcaggagattgagaccatcctggctaacgcggtgaaaccccgtctctactaacaacacaacaaattagccgggcatggtggcgggcccctgtagtcccagctactcgggaggctgaggcaggagaatggcatgaactcaggaggcggagcgtgccgtgagccgagattgtgccactgtactccagcctgggcaacagagcgagactctgtctcaaaaaaataaaataaataaaaataaaataaaatttaaatttaacttagcatc

SEQ ID NO: 149616 - DNA, 424 bp, Homo sapiens
ctccattcctttgtgcagacccattttcctctgatggagctggagctcatacaccctctacctggctggacctcacactcaccagtaccacatttaactcaacatatcagggccacttgcttatgtaactgcctcccagcacagcacccggcacatagcacagaaaatgccagaactacttaaatccaggctacagtattttacagagaaatccagtatttctctccaacaaatacttcttagttatctgtcacagtttcctccaaactcatatatactagtctctgaaacagggtgttgtgctatcatcactcttaagacacctaaaatatcctggtgatatcaggttaagtgatactgaatattcataccaaaaccctcagtcttgagaactgccccttcctgcaacacagaccaccagctc

SEQ ID NO: 149617 - DNA, 354 bp, Homo sapiens
tgtcctcagggtttgcctctctaatgataaagatattgataatacatctcagcagtttttaaatggaccaaggaagacagtgatgctgccattcttttttgattaccttgtgagtttcttggaaatatagtttcttctgttacttctccagaggaaatatgctgtcaagtcaacagcctgatctcaactgcaaaaccttttgttgagctgtatcctccttgacctctccagtactgacactgtcagaaggctgcccctcctccatggaactctcacctttccaggtctttcatggctctgtaccatcctgggcttcccttcccttccctctcccatctcaatgcctctactcct

SEQ ID NO: 149618 - DNA, 238 bp, Homo sapiens
ccagtttcccctcctgggatatttggtgtgcgacatgcccttcccccagccccagcgcccgttccctttggaagcctgggtgctcctcagaccacttggggactccctgcttcaccttcctgcatttgcaagagcttgtctcctgaggtggagagggggcctctgaagaaaggggctcccagcccaggccatcaacaaactaacgactctgtgtgaccttgggcaagtcactaccttt

SEQ ID NO: 149619 - DNA, 466 bp, Homo sapiens
gggatctggagttgaatctggcttagtagctgtgaaagattgggcaacttatttcacgtttaggagtttcaatttacttaactggcaaatggaataacaatgtctacttcacagcttactgcgatgatcatataagacataaagaacttagcgaagtgcctagactgtagatcacagtacgtgttagctttttgtgttttatacatcaagcgtaagtcttattttttacatctgtcatattaccctttccccagtattcagagtatttgagtgtatacgtacgggtggtaagtgttgtttttcattgaaagtgcagatcctaactttttttttcatgcagtaatcctcaaaaaggtagacgtctaccataattcagtctattgctccaattggaggatgtacagttgttttaggagttaaggaattgagttttttcttttttgcttttcgtctttttttttttttt

SEQ ID NO: 149620 - DNA, 233 bp, Homo sapiens
tagggaggaacatggatcgagtattcagagtatttgagtgtatacgtacgggtggtaagtgttgtttttcattgaaagtgcagatcctaactttttttttcatgcagtaatcctcaaaaaggtagacgtctaccataattcagtctattgctccaattggaggatgtacagttgttttaggagttaaggaattgagttttttcttttttgcttttcgtctttttttttttttt

SEQ ID NO: 149621 - DNA, 277 bp, Homo sapiens
acattctagcagtgattggtcaagaagaatgcggctgacagctgacacctggcttctcttcaggatgttgtgaattcggattggaccagcaggtctgccctgctgttagctctctagggcatccaaggacagaggatcattctcaaggcattcttagttgttctaactccattcaccactacaagagcatgggctttggaaacaggcagagttgggcctgaaacctgtgttcagcccttgatagcagggtggctttgtctctactgatcaatctctc

SEQ ID NO: 149622 - DNA, 712 bp, Homo sapiens
gtaaagccaagtcggggaaaggaactgcaagtagtgaaaaggccacaactctaaaccccacggatgctttctcccaccaacctcaaaaccacccgcaagggctttggctgacacctgcccatgaacagatgggctcgactccccccacccacacactcccaaggagactttcagctttctcaaggcctcatagccaggaacctccattctgagaactgtacctaaccacccaaacctacagaccctattaaaatgaagaaaagacctctcggcccccatttctggggctgcctcagcagcagcctaaacgtcatggtctcttgcatgtcacatgaaagcagccaaaatagagaaggcactctctcctcgtcctccaaaatgttctttctcaggaagtcctttcaagtagccaattatagtccatttagaaacaccagtaactggtgacaagccgatcactagcaacaccattacaaaacaaaactaagcagaggtatggtcacgaccttgtctcttacgcttctgagagaagatgtgatactcaaataccaatgtaatcaactttgcggtacttttgtttaacttgctaattattttttctttctgtgcaatatccaggcaacaactaaaaacaaaagcaaaaaacctggcctttttctggcctggagactcagtctctctcccccttcactctgctgtgcagagccatttc

SEQ ID NO: 149623 - DNA, 520 bp, Homo sapiens
gttccatgtgatttgccatgggctaatatatggaatgtgagagaaaaagaagaaacaacaatgcttccaagattttggggcagaggtactgaaaaaatgaatttccatttatcagaaagagaaagactgtggtaaagcaagttgggaaggaaacagcagctcagttttccacattcagtaaccctcccttatctagggtttcactttctgcagtttcacttatccatggccagccacagtctgaaaatattaaatggaatattccagaattaaacaactcgtaagttttaaattgagcactcttctgagtagcgtgatgaaatctcatgatgtcctgctgtcttctgccctggatgtgaatcatccctttgtccagcatatccatgctgcatgttgtacctgcctgttacttgcctaagcaagtggatggctacttgcttagtgtccatctcagttatcagattgaaaaagcagtacatatacatagggtttagtactatctgcagtttcaggcatcact

SEQ ID NO: 149624 - DNA, 348 bp, Homo sapiens
cctacgcttggtcgcagtcgatgctctctctcctgggctactaggcaggactcctgaccagctttctgcttccactcatgcctttctgccatccatcttcatagcagcagaacattgtttttaatataaatctcatcatggcactcccctccttcaaccctacaattattcccattgcatttataaaaagtccaaacccattgccctagcctgtaagtcttcacatgatttggctccaactaatattttggacctcatcttgtacctctctcctctttgctcacaacactacagccacaccggccttcgttctgccccctgaatgtgctaaagtcattccccccttag

SEQ ID NO: 149625 - DNA, 230 bp, Homo sapiens
ttcttttcgcaatctagctgcttttagaggacttttcagagacctcagttaattgttttttttgtattttgttaagagtgtttggttgtaatcagtgagggagatagtgtgcaatgcatgccttccatttggttggaactagaagttgagcaacacagttggaattcatcttttttggttagtgcttccccaggactttcacggacagaatcccaaaatagaacctgtat

SEQ ID NO: 149626 - DNA, 104 bp, Homo sapiens
acgaaactttgcttcctgaagaacaagtcgatgcaggcggagcacacgaggtgtatgacttctcagcggaggccccactcataggtgacccctcctcctcccac

SEQ ID NO: 149627 - DNA, 961 bp, Homo sapiens
acaagatatgaatataccagagtataatctgtcataggagaggtcaagccaagtcttaggtctttcagttagaatttcatacaatagtacatttcccttttgaggtgtgtatcatactatctttagtgctagaagtaatactttagccaaggaagtttaagttcttttgaagcattcattttaaaaaatagctttagttcttctgatctcagagctatacagatggtttggaccaagaggttttagtttaatgaacatgctttgcatgtttgcaaaggattttacctataaagtgagtcatcattagagtcttgcagtggtacaggggaaagatccataagcttttgttgttgttgttgttgttgttgttgtttttaatagagacgggctttttaccttgtcacccagactggtctcaaactcctgggctcaagcaatacgcccacctcggcctcccaaagtgctgcgattacaggcttgagccaccgtgcttggccagtccatacacttttgttgagagttatggcattggtcttctggcaagggaagacttaatttaactggtaaacttatagactattccaaaaacatattcaaaccttttaagcagtgaaaatgaaatttatttataaatgttcaaatggtagattatggttattacatatgagttttcaaaaatgttgagtctttctggaaagatttattcttcagtatctgtgcaaagtttgaagtaatttgtctttgccatttggtttgtattttgttacataaatacatactcaagtctggagatggtttcaggcaacatccagtagcctaagaccattttaaggtagctggtgatctttttctgttttgtggggaccttttttgtaatgaacattttttttaaattcagaatttagattaatcggttgtcaagagaggagagaaagcgataaaacagtttaggaatagtaaa

SEQ ID NO: 149628 - DNA, 548 bp, Homo sapiens
acttatgaaacatatgaatgccatccattcacccatccatccgtctatctctgcatccatctgtccacctaaccacccgttgttcatccacccgaccacccatccatctacccaatcacccaaccacccatccatccatccatccaccctcccaacctccatccatttatccatccatccacctaatcacccaaccacccattcatctgtccatttatccaatcattcattcattgatgcgttcattcatccattcatccaaccagtcacccaaccacccattcatcatccatccatccatccatccatccaattacccatccattcatctatccaaccaaccacccaaccacccatcctacagccatccacctacatttatcaatctacccatctacccatatccatccatctgccgtatcactaaattgcccatccattgactcagtcacccaaccacccatccacatttgtctagtccatctgtccatccacccagtcacccaaccacctatccatacacccagtcacccaactgtccatcgcca

SEQ ID NO: 149629 - DNA, 175 bp, Homo sapiens
ggattccgaaatggtgtaaaacacgaatgagcagtgcccggcatgctgcgagggctcagtaacaccagccattgcagtgccctccctctctttacccgatggcaggtgggaggtgctggatttgtgaggaagaaggcctcacggccttgcctgctcccacactggcacagcatca

SEQ ID NO: 149630 - DNA, 252 bp, Homo sapiens
aggcagtcaaagagagtaatgggtgacgtctagtgatttgctttgacgtctagtgattctgatcattcccagggctcagccagagagagacctgtttcacccacttgcccacacattaggttggtcttttccagccagccagagaaagagattctctatctggaaataccatcagaaatggtcttgaaccccattcccaatttttacagctcttaaattgttgtcactccagtctgaaagctggaaggcagc

SEQ ID NO: 149631 - DNA, 634 bp, Homo sapiens
agcaagctaccctgctgtgagcagccctacatgcagatgaactgaagcttccagccaacaggcatgaaataactgaggcctgctcagaatgacatgagtgtgtttgaaagtggatctctggccccagttaagccatgagatgactgcaaccacaagagaggccctgggccagaaccacagctaagtcactcctggatttctgaccctcataaactgtgagacaataattgttgttttaagcagctaagtttcaggatactttgttatacaacaataaataaatagtactctctgagagtgattttaaggcatggccctatcaaaggagtagccttactttaacacctaatccagtggatctcagaggtattaatatctaccatttgtgattgtcttatattacccaaaagacttaagcttttaatgggaaggaagattatatgaacttttttgatgtcctaaaacagcacagtgccaagtgcatgtaagtactctataaatatttcctgaattgattttttaaactacattttttaaactagaattcatgggactgaatcaaactgcattttaacagagcatactattgcatgttcgttcatcttgatgcagttagaaattattccaggtactg

SEQ ID NO: 149632 - DNA, 443 bp, Homo sapiens
tgactttgtccctcatgacggtaggctcagttcacttcctcacatcagccctcactggaactagagatctgctagtcagcccccttcctccatgtaaaaactctttgacaattgggaccttggcaggactgtctgttagggtaataatgacaggaaaatcctcatacggtggaccaggtcatgttctcagtgctctgtgtttaattccatttcacagcaacccttatcaagtaggcattactatcatccccactttacaggtgagaaaactgaggaacagagagattaagtaacttgtcaagggtcacgtaagtactgaatgacagagaagggtttcaccctgaggcattctggctctaggatccccttaaccactgccttcagctgactctctcaggttcacaatattctccttaggacctattttctagctccttcttcaa

SEQ ID NO: 149633 - DNA, 450 bp, Homo sapiens
gaaaaattttagctttaaaactaagaatttttgaaggaaagaagcatttccctgaaagtttagaagtgagacacaaatgtcatttcaatagtaaggaataataataatagtagtgctggcgccccactttgcacatgaggaaactgagatataaagagaggctaagtaatctgcacgaagtcacacagctactgaatggtagagtcaagatttcaggctagttctagaatccatgtgctttaccattttgctatatcaatggtgtcaaaaaaaaaaaaggtcagatttaacatgcaaatttcaggtcacttttggagccagtttaacttgattaacttatagtaagtagttaatgttacttttaaattggtacacgttaactcgaaggctatttctttgaaatctctagaatcttctggtaggcaaagactgtcaccaagctccagcttt

SEQ ID NO: 149634 - DNA, 363 bp, Homo sapiens
gctgtgctcaagtgatccttacaccttagcctccgtagtagctaagactgcaggctgggacaattttcttaaaaaaatattttggggccaggcgcagtggctcatgcctgtaatcccaacactttgggaggccaaggtgggcggatcacctgaggtcaggaattcgcaaccagcctgaccaacatggagaaaccgtctctagtaaaaatacaaaactagcagggcgtggtggcacatccctgtaatcccagctacttgggaggctgacgcaggagaattgcttgaacgcggcaggtggaggttgcggtgagccgagatcgtgccattgcactccagcctggacaacaagagtgaaactctgtc

SEQ ID NO: 149635 - DNA, 810 bp, Homo sapiens
agcacagatttaatgacaaaggcattgagtcaacacgtgtgtggttaattaatctggtcaccctccgctggagagagcagtcctatgaatgatcaaaagccagtcttaggaccacatgtgtaaacaagctctttagataaactcccttacattcctttttacctactctgagctgttaactcaaggtaagagaattaggctgctttcagccataaccctatccagaggcttttgcaaaaccttccggccttccaagaaggtttgcttttttcctgtaattttataatttctcccaccaccctgaccaagcccctacagcaaacccttacagcaaagcagacaagagacatgccaagtttataggattacagaccaagagataatgtttgacttttagggtttgattctgtgccctgcccccaacttcttaggctgtataaggggtttgctaacctttggcaaatacattaagcattttttatatgcaagctacaaggggttgtgagatgcatcaataggttcctttctttgaagaaactgatagccttgatggatacatagatcattataaagatagcaagataattggaaataagtggtatttaaattttgtctttcatatataaactcttaattgaaattcatatggtgtcactcattttcactgtgttttgatacttttgtgttcccaattgaacttggtttgtattatgttgttattcttttgatttctcatgcatttcctgtattttcacccattttaaataagatgtggtctcatagaaaatagaattgctgagttttagtgag

SEQ ID NO: 149636 - DNA, 636 bp, Homo sapiens
agggttctttggtccaagcaacttattagttaggtgacattgaaaaagaagcaatatatatagatataatgttatttatatttctgatttatctactcctactagactttaagtttcctaaattgttacattcgaatgttatttgatgattacatataagtagttgtttatatgttggttagcattctaagtcaaacatttacagatttattaaattatggaatacaaatagaatataatgtcataaaagcatcaatgattaaattgcagaaaatatttagtgacagaattgtgtatgacatgtgttatgcatagaataaatagaccctaagagttgttatgcatagaataaatagactataagaagttctctggtattcctgtcctttaggaaatggaactggagactggacgctgttccagtgactagagttctgctcctgtgcctggagcctggtgccttcccgcctgtattctaagatttctgggactgaaagtccatccacatgtttgtgtttctctctattgattactactggattcacacgtaccatgtaccactattttgttggaatatcacagaaccccccacccccatccttataacactctctacattgaaacaaagagataaat

SEQ ID NO: 149637 - DNA, 359 bp, Homo sapiens
ctcagcctcccaaagtgctgggattacagcattatgccttcttaagtctaatatcaagccatatttaattatgattgtcttactgtaaatacgcgggattaattggaaaactggattcttgcttgtatgacaacccaggtatgtaatgtggaaatgagcaaacatatttgtgaactattaccatattctgtgcagttattaaaattgaatttatggagttctgacagtatacgcttaaaactccagagatagatctgttctctcatacctgatgcaaggaaaatgaacattcacgtttacaaattcagcatgataattttgtgcctttaggtagggcttacacacacaccacaattcta

SEQ ID NO: 149638 - DNA, 211 bp, Homo sapiens
tccacttctccaaataaagttttcagctgctctctgcagacctatctggaagtgactttcccctctagatagatgctcacctccaatctgtaacagacttagaactgatcattgatcaatccagtattataaactaatgctttcagggtagggcatagggaaccatgtagcaatttacaagtcaaattcctttcagtagctggcaatcttt

SEQ ID NO: 149639 - DNA, 277 bp, Homo sapiens
tctgcacagggttggtccaggcccgagcctgtttctccagtacgtcatgagaccaaccaaactgagggtcgggaggagacagggagaacacccatctgaccctctcacactcagaaaaccctttgcaaaaccagctgggttttttagtttatcattcaaagttataggataggaaagttatatcttgaatacagcactgggtttaagaacatctttgaaacaacattaaaagaaaagggtagaggagctaagagtaaaattcacatgtgattcctta

SEQ ID NO: 149640 - DNA, 396 bp, Homo sapiens
tgctcttcccccagatatctgtggccactcgcttcagtctttgcttagatgtcaccttcccatgaagaccttctctggccctcattctctggtgcccccattgttggggcactgtctgcctccttccttggttcctttttctctgttgcaccccaggctagctggtatgcatttgcctggttttgtctgtcttccacccactgccagagtataagccccttgaaggcagggatttctgtcttctctgtttattgcttgtgttcccagagccttcagcagtgcctggcacctggtgggggcttcataaaaggtttctgaatggatcaaggctctgagatgtcctcagtcctgacctggccagctcccaacctggggctcatggctgcctgcctggca

SEQ ID NO: 149641 - DNA, 344 bp, Homo sapiens
ttttgtctctgggctctgaagattgaagtttattaattgctgagaaggaaataagtgagtatatttctttttaaaaatttaacaacaccatcagtggtgcatatttatttaaggacatttggttataattaagcaacatggctgccttaagattattttagggccaggtgtggtggccatgcctgtaatcccagcactttgggagactgaggcaggaagatcacttgaggccaggagttcaagaccagcctggggaacagagcaagacctttatctctacaaaaaaaaaaaattaaaaattagccaagcatagtcagcacacctatagtcaagctacttgggag

SEQ ID NO: 149642 - DNA, 141 bp, Homo sapiens
gagcctcacttccctgttactccatcaacctctgcctgttacacacgcacatcaaatctacccactcccggccgggcacggtggctcacacctgtaatcccagcgctttgggaggccgaggcggatggatcactggaggtc

SEQ ID NO: 149643 - DNA, 550 bp, Homo sapiens
tgctgcttcgttcagtgctggagtaggttacaaagtgtggtcctgctgaacggctggagaatgaactagatgtcctctcaggatgactcccggccctataatcccatgatgtgcttataatggaatttggctgtccttataattagaaatgtagcttgctggtcacacatctggatcagataaatctgcacaaagagcatttcaccagaagcagaaatgccaagcatccagcagctgtgtcgttacatcagccttgcaaataacaaggaatactatttgtccatagaaagtaaatgactgggtcaggcaggaataaagctaagtttattcacattatttggggacaggaaaaaatgtttatgaaaacatatattggtcagacctccacattaatgaatgagactgatgaggaaaataattcatatacacaaaagaattcaaatgccaaaactatatccttatttcctgccaccttaatgatgagtttctttttactgaacttttataaatgtaataggctcccctgacttgcatctcaacatatcacaca

SEQ ID NO: 149644 - DNA, 335 bp, Homo sapiens
aagcaggccagtcatgagggtgcatgcctgcagtcctagctactcaggaggctgaggtgggaggctctcttgagtccaggagtttgaggctgcagtgagctataatcgtgccactgctctccagcctgggtgacaggaaaaccctgcctctaaaaaaagcgggaggggaagtggacttgaacttcttgagaatttggagtcagtaaataacttgatggagacagcaaggtagaagaaaaggttaaaacaatattttttttcctggtaagtttccctgaagttcagcccctacagatctgggggttcttggggcaccttgagtaagccaagcaaag

SEQ ID NO: 149645 - DNA, 192 bp, Homo sapiens
taagatttattttatagttacactattgtatttattgaaggtagcttggctgatactgttccaaagtcacttgccactttcctctctgcataattaacatttattctcctcattatttgtcaatgaattcccttctgtttatttatagtttctttatgattctgcatatcagaagataacaagcacttatca

SEQ ID NO: 149646 - DNA, 471 bp, Homo sapiens
agaggagacaataaataagtcaaatacataactcgtttagtagtgataaatgctaaggagaaaaataaagtataaataaactggtatatgatccctatcacactaacagcttttttttagggcaaagtctgatgattagcttagtgatttcacgctttttaatctctgggatctttagtttatcccacagtttttagttctatcttgaaagtaacaaagcaactgaacattaccctgagaagggattggggatgaggtactaggagttttggtcaagtgaaaataaaatcagtttcctcactgctaagttgtgttacatgtgacaatttaaaaatggaatctaatagccattctaccaatgcaagaaatattttaggctgagaggtttaaaaacccaactttatttaggcttctgccaaatatttgtatgaacagattatttgtatctgtttatttgagggtttggttcaa

SEQ ID NO: 149647 - DNA, 525 bp, Homo sapiens
  misc_feature (9)..(9): n is a, c, g, or t
  misc_feature (19)..(19): n is a, c, g, or t
tagctgttncctgagtgtnaaaggccacacttcccagaatacataccatggcaatgccaaaatatgaccatgcttgttaatatttaggccaaggcattaaatgtttataacataacacaaatacttgtaatctaaatttgaatgaatgtcttcaattttcagtaaaataagaccctattaaagccctaccattaatatatattcattcataaacatactgagtacctaatgaatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggcctcttttctgaagcttgcctaaatcatcccaggaatgctaaaattgggtgttatttaggcataaccaaaatgaaataacaaagtaagtaccccaaataaaactagg

SEQ ID NO: 149648 - DNA, 537 bp, Homo sapiens
tacgccatggctgactctagaggatacacttcctctccacacttcccagaatacataccatggcaatgccaaaatatgaccatgcttgttaatatttaggccaaggcattaaatgtttataacataacacaaatacttgtaatctaaatttgaatgaatgtcttcaattttcagtaaaataagaccctattaaagccctaccattaatatatattcattcataaacatactgagtacctaatgaatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggcctcttttctgaagcttgcctaaatcatcccaggaatgctaaaattgggtgttatttaggcataaccaaaatgaaataacaaagtaagtaccccaaataaaactagg

SEQ ID NO: 149649 - DNA, 440 bp, Homo sapiens
tctcattcattccatacacaaccttcgttcaagattaacattattattcacatgttatggataaggacactgaggcccagaaatataaagtaactcactcaaacttgcacatatagaaaggaggtttcaacccagatccggaagccacttctacacaacaggacgccccagtgcagtttatccttttacccctgtaaaggacacatcactccagaagaaaattcacactctgcccagtggaatttgaagatcctgaactctgcactttcccagaagtaggaggcgggacagtgagggtgacaactcgtcttggtgtgtctgaaactttccgggttttagcactaaattcctgtgttccaggaaacccctcagtcccaggtgaacagaaacagttgacctccctaagtgaatgcagccatagccagagaccctgaaaactc

SEQ ID NO: 149650 - DNA, 208 bp, Homo sapiens
ctcccaatctgccaagaaactctctcaactgagttaaagatgtttaaaagtcaggaaaacaatcaccaccttataaaagcagaactgccaagttcataattggaaatatcattctataataccactaatatacccacatgaacttttcccccaactccaaaacacccagcagaggaggtggaataagcacaaacaccacctccacatt

SEQ ID NO: 149651 - DNA, 401 bp, Homo sapiens
aatcttccgacagtcaagagggaattgtcaaaacaagatatccgtaacagagttcctgactgtcttttcaaagacacttgaatttctgccagactccagacagattcacattcccaggggtaacacacagcacaatgaagggatatttcttagcaaatattgacgtgccagagaattggcattaaattattggcttgacaactcctaacctgctgctcttggtggctgatatgaaggattatctatttacaattgaattctgcccttgacttgtggcagttgctgagctgagcttatttcagggaagggaaatgaataacaccttaagaacacagatggggcctacaaactattcagcactttctgtgcaggaagcgacaatagcggcagagtttttacac

SEQ ID NO: 149652 - DNA, 295 bp, Homo sapiens
cgatgtcatttggtggcttgctgactgtggcatcgattcagggcctggacacagctctgttcagggagcatgcaagccagatggcataaccaagacagtggtgataatgtgtctgcgtgagtgtgggggtcccgggatgtgcacagggcacagctggagctaaagtcatgctggatcccagggtgatcaccactggagcctccagcactgctgggtttgggtgacctggcaaaaatgtggggcccgatggggtcttctgactaaaaggggtctaatggtcccactatagccatct

SEQ ID NO: 149653 - DNA, 110 bp, Homo sapiens
gggtcactggagcgaggttctagagccagcaaccatgaacacaaaattcaagtggccgtggatttgtccaagcaggggcagcaagatgaagcatgtgtttacaaactgtg

SEQ ID NO: 149654 - DNA, 793 bp, Homo sapiens
tggcttgaacccaggaattcaagagcagcctgaccaacatggcgaaaccttgtctctactaaaaatacaaaaattagctgggcgtggtggcgggtgcttgtaattccagctacttcggaggctgaggcaggagaattgcttgaacccgtgaggtggaggttgcagtgagccaagatcacaccactgtactccagcctgggcgacagaatgagactttgtctcagaaaataataataataataaaaattaattaattaaaaagagccagacatgatggctcacacctgtgatcctagctactaggaaggctgaggtgggaggatcacttgaggacaggagttggaggctgcagtgagctgtaatcgtgccgctgcaccccagcttgggaggtagagcaggaccctgtctctaaataaatgaagtgagttcacctgttctttttaaacatgggtactagaagattttaatttgtgcgcatggtttacattccattgcttgtgcacagcaatgggttcctgtgtgcattgcgcttagttgtctgttactccaggatctggttctgagtcaaggcatttgtgaaaatagcttactgtcgaaatttcctctgaagattccttgaatcacccaataaagtgcaatgtacttgcttgtttaaattgttagaaattttttattgtgtagaaacaaggtcttgctctgtcacccaggctggagtacattgtcacgatcatggctcactgcagtctcgacctcctgggctcagcctcctgagtaactagaactacaggcatga

SEQ ID NO: 149655 - DNA, 246 bp, Homo sapiens
caacctgggcaacagagtgagactccatctcagaaaaaaaagaagggagatggaaaatggcacttgctggtgagacagtcagagtgggtcaaggcagtgggaagccaggagatggggaaagttatgagctaagagagttctcaggacaccctagtggccgtcctctttggtttcttccagcctatcaatcataatctgctccccaggatgaacacatcctggggagaattttaaggtttcaagaaa

SEQ ID NO: 149656 - DNA, 604 bp, Homo sapiens
cacttctcaagctccagtggcaagaactcagacactgggtcacacccaactgcatgggatcctgggaaatgtagtctcatgtgtgctcaggaagaggagaacaaggattttggtcagcaacacagtacctgccacagacttcatgcctatttttaaatcaccatatgtacccttcttcccacatatagaacacacttatgctcctttcctggggatgcattaaagtcttatgttatatcagcttaaagttcagggcttctgagtgatagacagttctgtttaccacttccaaatgtagtccctcgtggtctgggaataaatgaaaacaaaaaacacaagatatatatatcttcacttcaaagtataaagtggatgattaggggcaggctgactggcaacaataaactcctcccatttagaaagaaaacaggaggaatacaatggtagattggccatagcagtgacaaaccttccttgataggctatgtggagtcgcctgccctggatttacagggaagttcctgattagtccctgtgtctggactctgggagaaactcccttatccatcattttctgaggatcctggctttaccctctggatgt

SEQ ID NO: 149657 - DNA, 400 bp, Homo sapiens
gcaagagggccctctctagccataacacagggcaagtggacactgcccagaagacgctcccagtcggagcaagaggtctacaaacaattcccctcataacctatatcagcctttcgaagcctcagatctggccatgtcttttctagtctcatgcttctcttaataaaacaaaatgaaaagtacagagtaccatgtaactcagaggctaattgttactagctttcacctctagaagactatgaatttgtcttactcaacaatgtttattaggctctgggcttcttcttaccctagggattcatacccaatcaagaactaggcatgtttgttacaactccaagaaagattgaccaagctgcagtgttccctggcatgggccaagctcaaagctcctcaaaag

SEQ ID NO: 149658 - DNA, 355 bp, Homo sapiens
agtacgtagcactgagaaagcaatgtggcaataacgtttcaaccatcccaaacttttctgaccctttggtacccatcccacttctttaactttatcccaagaaaataatatataagatgcaccagccaggaatgatggatcacgcctgtaatctgaacactctgggaggccgaggcgggcgcatcacgaggtcaggagtttaagactagcttggccaacatagtgaaaccccatctctactaaaaatacaaaaattagctgggtgtggtggcatctgcctgtagtcccagctactcgggaggctgaggcaggagaatcgtttgaacccgggaggtggaggttgcagtgagccaag

SEQ ID NO: 149659 - DNA, 154 bp, Homo sapiens
tcatccacccaagaggacacccctagggcctcatccacccaagaggacacccccagggcctcatctacacagtggaacacccccagagcttcctctccctcacgaagcacccaactggataaccccagaacctcttctacccagcaggacaacc

SEQ ID NO: 149660 - DNA, 184 bp, Homo sapiens
tatggaagtgcaccagatcttactttgcttaggtgagagagatgggtagaggagcttaagaaaacaaagttctaatttagactagactggacattttaaaatttataaaggtatttaaagctatgggtttcatacaagatgtcacccagaaataacagtgagacatccacaaaagcagtagagg

SEQ ID NO: 149661 - DNA, 399 bp, Homo sapiens
aaaataatgtatgttacttagatcccaggtaaaaggaaaatactactacctggtcaaatacgctacccgaaaatagatgtctcagtataattttgacaaatatggatgcatttcttctagcatttctcccgcaaattcttctagcatttacttctattaaaacacaatctcggtgccaatttgaatgtgcttggagactgctgcacacttcaacagaatgatgggaatctccaagaaaataggaattgtatttattgcattgatgatggtagtggtgaatacttccaaaaccattcctgggggaaggaggacaagatgaagtgtttctctggattaaggagtgaaggtctttgaatatgcatgataaaaccacaaccaagtcattttgatgtaggaaaa

SEQ ID NO: 149662 - DNA, 393 bp, Homo sapiens
tttctgattgttatcttctcctggaaagtgataaatgaagctatctttgtttcagtgaataatagaatatgaaatcctgtaaagccacataggttattagatgaatatcacagagcttattatgcactatggcttaatgttagattatagatgtgaccaaatggtaattaacagagctggagctgtaattaaatactattatgctgctctgtgatctctccttagatttctgttgcaaagtaaatggaaaatgaatagttcaaacccataggtggatttcgtcgcttctccccatccctgaacatctcttttaattaactaagtaattaaataaagtcatcttcatacaacagagatgccaaactctgcctagtaactctaatcagtaagggt

SEQ ID NO: 149663 - DNA, 500 bp, Homo sapiens
aatatcagctcggtaccgattgaatcaacgccgctgactgcatccaagcgccgtactgcatccaacgccgccagcactgaggtagacagaggcctcctctcaccaggttaatgaggaggcccctcggtgtcctgaaacttggcaggttttgggttgtgagtttttggtggtggaaattcacagtgtttcagtcactaagatcagggtttttacaggatgccaggcactgagaccctcagaccctttggagagcctggtggagctcagagctggggcccagcctctcctgcacctgcatgtggaggccatccagggctggcggtcaggggcttgatggccttggaagctgggggcccaccttccccacactgtgccagggcagtgtttgtcaccctgtgataaaggaggggatccagcccccctgacgttgtgcagctgtgtagtgacttcccacagtaaagagtcaaacttcttcactccagtgagcggttgctgccacc

SEQ ID NO: 149664 - DNA, 488 bp, Homo sapiens
caacgatggtcctcagctattactagaaaccaaaactcagagttgttgaattagaattaaaatatataccaaaccccctaccttggagcatttataccataaagtagatgagaccagaatccatgcctgataaggtcaatctaaaataagaatgagctgatatttgcctttaaaaaattctagacttgaaacccaaaggacttaacagcagttctgttccatcaacctcctaggtctcaaagagatacattagaaattctacgaatatttaattcaaagatcattttaaaaatattttttaggccaggcgtgacggctcatgcctattcccagcactttgggaggccgaggcgggcgaatctcttgagcccagaagtttgagaccagcctgggcaaaatggtgaaaccccatctctatgaaaaaatacaaaaattagctgggagtggaggcacgcaccagtactcccagctcctggggaggctgaggt

SEQ ID NO: 149665 - DNA, 146 bp, Homo sapiens
attcctatcaatatacaagcatactgttacttttttcatcataaaaatatcttccctcaattgctctttcttgctctctttctgtagaaccccttaaagcattgtctaaatgcacttgtcctaatttctttctcatgttctctctt

SEQ ID NO: 149666 - DNA, 229 bp, Homo sapiens
gtcatatggtcatgcatctaaaagctaaggtatattaaatcactctgatttttgaacaatctagtctagtaaatgtttagccttacagactgaaagtcatttttatcatatctaactaattattcatttctaattacatttcaatagatattatactaatgggtaaaaaggcatttcattgtgttattatttgtaatagtaaaaaactgtaaacgattattaataatat

SEQ ID NO: 149667 - DNA, 310 bp, Homo sapiens
ttttttttctttttttgagacagggtctcaccctgtcacccaggctagagtgcagtgacacaatgatagcttattgtaacctcaaactcccgggctcaagggatcctcctgcttcagcctcccaagtagctaggattacaggtgaagagaaatgaagctaacatgttgaaatgagtggccccaaggattaccagaaaagaagttaatgttcagaaagagaaaataaaagttctctgtattttattcccctcagagataacaaaagttgacattttgttgcaaaaaaaaaatattgggctcgttggcctca

SEQ ID NO: 149668 - DNA, 521 bp, Homo sapiens
ccagaagcatgtattatagatactatttgatattgaatctttattaaaaattgttttaatggttaatagatattgtgaactgccactgtatgttcagttggttaccttttgccctcatttattctactccaacaaccggcctaggttctgttcttcaaacctacaaggcatgctcctatctcagtaacctttacaattgctgttctttccatctggaatgctttctccacatatctgcataactgacttcctatctgccttcagatctttgtgcaaatgtcatcttagggaagtattttctgatcgccctagttataattgcaacttaaatctcctacttcttgtccctcttttctacttaattttctccttagcaactatcactatctggcaggccctatatttcactgcctcattgtcttcctcccctttcctagaatattagtttcatgagagtaggaactgtatccacctagttgcctactcaatacattatacctaagacagtacctggagtaaag

SEQ ID NO: 149669 - DNA, 384 bp, Homo sapiens
aggaagagacctggtgggaggtgactggatcatggggacggttcccccttgttgatctcatgacagcgaatgagttctcaggagatctgatggttttataaatgtttgacagttcctcctacacacacacttgctctctttcgcttgctgccaggtaagacggacctacttccccttccaccatgattctgtttcctgaggcctccccagccacgtggaactgtgagtcaattaagcctcctttataaattacccagtctcgggaagtttttttgtttgtttgtttgtttttgagacagagtctcggtctgtcacccaggctgtagtgcagtggtacaatctcagctcactgcaacctccacctcccaggttcaagcaattctc

SEQ ID NO: 149670 - DNA, 163 bp, Homo sapiens
ctgtgggggccagggacggcccggatgccaaggggaaccgcaggggagaatgggtctgaagaggaaacaggagctgttaaagtggggatgcctgtcagacaaattcttcactcgttgaaagctaacaggttgaccaacggaaccacctatggtgctgccagcc

SEQ ID NO: 149671 - DNA, 247 bp, Homo sapiens
tgagatgtcattctgcaaagtgataggtaattgaatgtaagccccagatatcaagggaaagcctgagaattatggacaatttgaacttatttagattttagccaagcggttggcatattaaatttgcattttaataaattaggtttggtctcagtatggagaatacactagggaaggaaacactggaggcagggcagctggccatttacggaaaagaggcggggatgagggaggcctagattaaatg

SEQ ID NO: 149672 - DNA, 525 bp, Homo sapiens
cgagctcggtaccagttacaacagctctagaactacaggcatgtgcctccatgcacagctaattttttttaactgttttgtagagatgggatctcaccttctttcccaggctggtctcaaactagtgatcctcctgccctagcttcccaaaatgttggactgcagttgtgagccaacacgcccggctgtgcatgtcttttatagcatgtattcattttttcatgtattcattcatagggtgttgttaagtgcatatcctgtgccagacactgttctaggtacttgtgaacagcagggaacagaacaagcttctgccttcatggagcttaaattctggggttgcagggaatgtataggagatggatttttaacaaataaatatggagtgagtcagattgtgatcaattctacagagagaaataaagcaggctgcagagatagcaagtgtgtggttgtcagtgtggggagttgttcgccgtggtgcacgggtggccagggatggctccacggataaggtgccatttg

SEQ ID NO: 149673 - DNA, 569 bp, Homo sapiens
ccccctcaactgcttaatcccttccactatgccctgaaactcatgtgtcaccagcagaacaccctctagttcctcaacctcttctcagaatgttttctggagcctgttctgatgaaaacctggctgtccctgacggatgctgcctcactggagtcttgctggtggtgcctgttttctctcataggccccagcgctgggccagaccattctccctcctccagaaacctctagctttgactcccatgtgatcagaccacaccgcccctactccttcctgttcttgtcatctaccaacccaggtcactggccctcagctcctggctcactgtcactgcaacactcctcctcgctcctgattcttggtgattacatctatatcaacgatccttccaaaacaatgaccttttgatcctctgccctctcctccagcgactctggtcttcatccaatttcaaagcactccctcctctggtcgcattccaccctgcctttaacccaagaacacttggtattagggcaccatgtcttggtcacggctgctacgtgtatctgatgtagttaaccatggc

SEQ ID NO: 149674 - DNA, 233 bp, Homo sapiens
caaggagaaaatattctcttttccaagaacagttcagccctgtagaagataggggcaagcttcttctacaatctgatttcatctccatggaataccacagcatctcagttatttgatgaagcatatccccatactaagggggcaaaatttgctccattccaatgaaatataacctttaaaatttccagccagttttcaaattcttctcctttagtctcagtccccaactcgta

SEQ ID NO: 149675 - DNA, 138 bp, Homo sapiens
atagcaaaacaactgtacagcttaaatacagtgaagatccaaaaattacaaccagaactttgcaactgttagatctgctaatcaaagcaaaatgccgtctgttttgtgcatacatacaataataagaataaggaaatg

SEQ ID NO: 149676 - DNA, 319 bp, Homo sapiens
cggagttactatatgtaaggtgctggctggtgtctggcttactggaactgcttaacaaaagttcgctttccttctaatgttcatctgtatttttagaacagctgggaaagtacacatatacacacctaacctcactctggtgaatgggagtgcctgttctatacagacacgatctttgtatttccaaataggttaatgactgaagggctctggaaaggggataagaggccggcttccttccccagatcgcactccaacacccagaggactgctatttctcaggtggcagctatgaggaaagaaagaaaatggtgccctg

SEQ ID NO: 149677 - DNA, 434 bp, Homo sapiens
cttgtgaatgacttcttcttggtggcttgtcttgtgcccgtctcttcatatttgagactttctgtcgcatccaccagtgtatcagcattaacatgttggcagataaattgaacactgaaaggtggattgtaaatttgattagaaatgcaagactggatgccaagattgattctaaattaggtcatgtggttatggaccctatcagcaagtgattgaaaagaccaaaagcctttcctttagaagccagatgttggccatgaatattgagaagaaacttaatcgctcctaactgggcaactcaagattctggcttctactgaagaaccataaagaaaagatgaaaaaaaaactatcaaagaaagatgaaataatagacttacattttggaaacaacatattacgtatagattttgaagaattggaataaaaattga

SEQ ID NO: 149678 - DNA, 783 bp, Homo sapiens
gtcaatgaacagagattgtcagactagatttttttaaaaagtcaagatccaactatattttgcctataagagacacattttagactcaaagacacaaatcagttgatagccaaaagatgagaaaagagagattaagcattcaatcattttaataattcaaaatgaattaatgtaagagctgagaccataaaacttttagaagtttatggcccacttcttggtatatatccaaaggaaataaaactagtatctcaaagagttatctgcatccccatgttcattgcagcattatttacaatggcaaaacatggaaacaacataagtgttcactgatggatgaatggattttaaaaaatggtagattcaaatgaaatattattcagccataagaaacaaggaaattatttcatttgcgacaatatggatgaatctggaggacattatactgagtaaaataaggccagacacagaaagataaaaactgtatgatctcacttttatgtggaatctaaaaaagttgaactcacagaagcagagaacataatggtggccgctgggagctgggggttggggtaaattaggagatgttggttaaaatgtatacactctcactcagaaaatgaataggttctggggatctgatgtacagcatggtgactttagttaataatactgtattgtttgataagagagtagattttaagcctcctcacctctcctcaaacacacactcaaaaaaacgtaactatgggtgatgaggatgtgtttatttgattgtggtaa

SEQ ID NO: 149679 - DNA, 189 bp, Homo sapiens
gtatgctgctcctataaaaagtaaggacacttccttccattgggagtttataaatcataatctcattagcttataaataaaatcatagggaagctacgtgctacatgagggacagataagggtggccaagggaaactttgaggaagtataactaaattaatacacagggatcagggttgaagtatttta

SEQ ID NO: 149680 - DNA, 248 bp, Homo sapiens
tggcaaaagagctttatttacacactggcacaaggctcgtggggtgtcagctgaagaagtaggtggaacgcttcacctgctccaggtcgaaggcccctggcttgggcaccgcctgcagtgtctccttcagctggctggcctaaaagatcttctggggctcagagcagaaccgcttgaccaggaacctggacaggtcctgcaggatgggctcgctgtgcaagcggacaaactgctcccggcacacctgg

SEQ ID NO: 149681 - DNA, 497 bp, Homo sapiens
ctatcgagctcggtaccagtttcgacggagactctcgtatttggccctggacttgcctcttttgcgtaacatttattctgttttatttgccaaatacgagagtctaagctgttcactgagggggcagtgagacgtggggctgctggtcctaggagctcttccatgacacctagtgttacctgggagccccaagccccagtcccccatccctcaggaaatccagttggaacccctactttgcagggccatctttggcctgaagccaccaggaaagctgtcccactgactgacccctcttaaggaagctgcagactgctgggcccattttcagatagaggaacggagagctgcggcagcccaggagccctgccaggcttccttctgggtgcagccacctgtgggtggggcgcggcctcgtctgagaccaaggcagggcccatgccttactcagctgtccttgctgagagtctccgtagcatcttcctgatggtctttct

SEQ ID NO: 149682 - DNA, 531 bp, Homo sapiens
acttatctatcatttttatggttattttgtacacatttaaatctctaatccatctgtaatttacttgggggctcagagtaagatgagtaatttacttttatggagtttcttccctccataaatgcctagccagattttcctaatgacatcttttctgcagagatttaagatacttttattatgaagtaacctctgacactgtacttctaggatctgttagtggttattaactctcattatcattgtcatgtttagctatgtgttactggaagcctgataatggaatgacggctgttttactaggtctgagagatagggaaggaaacccaagtttttcctactgtctcctctcacttgacacaacacttctgacaccatatgtaatcccaggccccaggctgttccctcacataccaagcagttttccctggacaccagctcggtgtgctgtgaagtcaattccattctgacaccatctacctggagttagcgtgagctcccacaggttgagggcttagtcccacaagactg

SEQ ID NO: 149683 - DNA, 202 bp, Homo sapiens
gtgctggggttataggtgagagccactgtgcccgacttcttttattttttcaaaagagtaataaatttaaatatgcttgcttcaagattcaaagggtacaaaggggtatacagtgaaaagtcttcctcccactcttgttcccagctacctagttccccttcacataagcaaccaacttgtgtatctttacagagacactttt

SEQ ID NO: 149684 - DNA, 290 bp, Homo sapiens
cttcctgagccccccagcctgggccccttcccagaaagccagtccccaaatcatttctgtggagcactttggagctgcagtgtcaccaggttgcaactcagttttcacatggcaccgtgccaatgctcttgaaggcccagggatagccagagagaggccagtgaccaaaacctgggacatcattccctccagtgaagggaatccaggtgagggcgcaggcgccctagcacaagcacgtatggacactgagggacggggcctgcagaggggcggggccagcgtttgacccg

SEQ ID NO: 149685 - DNA, 261 bp, Homo sapiens
catggttccagtcagagcttcttgaaagtagtcccactctgttcaaaagcctcccatgccccctgctagcctcaggctaagagcccttctccttcgcacagcctttggacctgtctatttttatggtctggaaacttcaggaacactgatagctgagcatctggcacatattatgcactcaaaaaccatgtatttctttctccttccctttgggacccgtaaaccagggactggacatttttgcaagagacaggagctgtg

SEQ ID NO: 149686 - DNA, 551 bp, Homo sapiens
tgtgttacgctccttaatttgtccctgcacaagaaataagcatatggatccgtgaatgtacccttcctcctctgctgcattctgaaaggaaagtcagaagctcgtcaaacttagaacttgaagctaagctaagacaccctcggcaatgcaggggaaaagtaggaatgagaacaaaatgaaaaatcctgaagaaaccactctgggggaagaagtcaacaaagaaattataccactatgaggctcatgaagcccgtgcaggccaaaaaccttgttcctaaaagctccccatgtgtggctgctaatgcacaggaaatgtgattagctgcctgagaaaggcctagaattactcccattctgactagattactggataattagattggtagcgctcttccctgactgtggctgtcagattaaatctggctggttctctttagataactgtcatgccccaaaataacaaacagagactgacacagcgaggagccttttaaaaagtgttccaagaatcaaagtgcctattttttcttaataataaaacatgaacaatg

SEQ ID NO: 149687 - DNA, 855 bp, Homo sapiens
tagggatgtgaaccacaggaccctccctgttctcaaggtatagggatgaggttagagaatacctgtgcacttctctgtcccttcctggaagaagagagaagagtatctaaaggagggtgagaatgggggcaggtggggcaatttatccaactccctgcccaagaggtcagagacttcagatcgcaccttactttcctccttcttaactcttccccttggctactagggctccaggtggggtcctctggcctagagggaagaaaaggcttagggtttggcagttggagctgaagactattccctccctctctctacccagcctctctgggtgtacctgggagcccatgtcctccaaagctcaggctgtggtagggtgccaagcacaagctccctgtagtaactccaagagggggacaggtctctggggatgtccttcacaggacaggcaagggccctggctggccacccacagccgggaccccaggagatccagcaggtactgtagctggaacacagcagttcccatagatggtccctcctcaaacccaatcacagacagctccaacctggagcagcctagagtctcagcaggacacacagtagggacaaagtgacctggtatctatgggtaagggcatgagtccaagtccccactcccaagatttcttatctgtgtcctggaacaaaccccttcagttctctgggcctcagtttcctcatctgtaaatagggctctggataatcccaaccgtaaggcctgacactatcccatgctgtacttatgtgcaagctagaaaaagacactcagctgggcacagtggctcatgcctgtaatcccagctctttgagaggcca

SEQ ID NO: 149688 - DNA, 174 bp, Homo sapiens
gaattgtgaattaaggaagggaagagatggttggagaggaggtgggagaaggcagagataattgaaggagcaaaagcatctggagaagcaaagccactgaaagatgaacagggctctgaaagaaatgcttgattgctatctttccaaatgactgcagttcccagtgacatcatt

SEQ ID NO: 149689 - DNA, 430 bp, Homo sapiens
aaaaaggataactggctaccccatactttcatacattgaccatacttcactgaagaattctttatcataaccatgtagaaacttgtgttgttccaaaagcttaggctctttttaaagggactttgttttcaccatcagcttcattcagtcattaaaaaaataatgcactaagttcctgttacctgctgggactggtcttaagtggtagagaggggattgcaaagatgaataacacacagtccctgtccttggggaggttaggtccagtgggaagtagcaggggatatttcaggtgttagaggagtgaatcagttgttacacagaaacagaagaggcaaggactgcatctgcttgggtagtagtttgccacatgtatgaggacttcgcacgagaatagctcacttcctcagatgtaataacacagccctgt

SEQ ID NO: 149690 - DNA, 305 bp, Homo sapiens
acaggaatgagacaccgtgcctggcctgttcataactttaatcttcctttttacctcaaacagggaattgaaatgaacaatgtaatcaaccacaaaaggggcatgtttcatctcttgtcttttaacaacatggctacttcacttaaaaaaaactttcttatgtagtttattctttattctaaagattcattatattttagaaagtatgatataaaacatttaatattcctgagactggtctagagccacaaaaaggttatattttaatgcctgaattaaaatgcgctgtgtatcgctggtgtatt

SEQ ID NO: 149691 - DNA, 553 bp, Homo sapiens
gtctattgagatgatcatgtgatatttgttctttattctgttgatatgatgacatattaattgattttcttttcttttcttcttatttttgagatggagtcttgctctgttacccaggctggagtgcagtggctccatctcggcccactgcagcctctgcctcccaggttcaagtgattctcctgcctcagcctcccgagtagctgagactacaggtgtgcgccaccatgccccactgatttttgtatttttagtagagacagggtttcaccatgttagccagcctggactcctgacctcaggtgatccaccttcctgacctcccaaagtgctggcattacaggcgtgaggcaccgtgcccagccttattaattgattttcaaatattaaaccaacctcacatccctgggataaattcctttaacacacttaaattaatactttgattaaatcaaattctctatattgttatgacttggaaaaatgctgttgacagctgagttatatagtatattatgaacactttttctttcctgcataatatatttttttt

SEQ ID NO: 149692 - DNA, 758 bp, Homo sapiens
ctttttttttttgtaaggggggacttgtcattctttctctgattacctcagtggaatgaatagttgcttgtttttttcttaccaaataataaaagcaaaggctagctttttatactcagagttttggaatcacatctaaaggctttgatatgttgaattctgacttttgtcagtgtttaaatccatataggcacgctcctttccatctttaattaatatctataatatgcaaggggtaaggtcaaaaagcaataagggggaaaggccattaacataacacaaaaatcttctagcctaaagtactatattgtctggctctttagtaaagcccaacctaaaaagcacatctcttaaccatagaaaacggcaaaagaatggatgctctggcagttaaacactctctcacaaactgaatcatttccaaataccaggtgttccagtttcactgtgttttgatattgtcagaaaggctagccacttttttttgctccatttaagcattcattgcctttatttttaacataattaactcgattataaatttatgtgatttaatctttaataatggccaagtttaacaactggttaacaaatttcctgaaaatttagcaatctgctcttatgagccgacagttttccttttccatttccagacctgagtgttctattccacccttttggaggttctagtcccacatgactcagtgttggtcttgttcctgtatctgtttctagtctagaaccttcacagtacttga

SEQ ID NO: 149693 - DNA, 342 bp, Homo sapiens
caacctctgccttctgggttcaagtgattctcctgcctcagcctcctaagtagctgggactacaggtgcccaccaccacacctagctaatttttgtatttttagcagagatggggtttcgccgtgttggccaggctagtctcgaactcctgacctcaagtgatccacccgcctcagcctcctcaagtgctgggattacaggcatgagccactgcgcctggtctgggtctgtctatctaattgtgaagtgcagataatggacactggggaagacttggggaagaacgcccataggaagcccaccaagtggtaagggtggggttaggagtaggaggccagtggg

SEQ ID NO: 149694 - DNA, 602 bp, Homo sapiens
caccgggtgaaatgggcagagtggcgcttacccgggatggcggtgaagcgggaccgggaggtcatcgtgacaaagggtggcatgaggtacctggccttgacgccctccccggctagacggtccagattgggggtgtccacatcctgatcctagtcccagcggaagccctggaaggagatcagcagcagctgtgagtgctcttcctccctgggacggggtggctactcagtaggacaggcggcagcagctggagggccccgaaccctgtcatcccatgagcacctgtcatgcactcctcacagagatcgtgggcttctccctctttaatccgttgttgaacaacgtccacattaataattcagcccagctctgttgtgggacaaacaacccggagtgtagcaaggtgccgcatatttgcaggacaggatgaaagcgttctggagatggatgggggacatggctgtacaatgtggtggatgcacttaacaccactgaatttttcctttgaaaatggctaaaataatagattttgtatgtattttaccacaataaaaaaattaaactggcctggcgtggtggcttacacctgtaatcccagcact

SEQ ID NO: 149695 - DNA, 340 bp, Homo sapiens
gtagtgtctgggagggtagcagtgagtgtggtgaagagggatcaattttgcaacatattggcaaagatgtgcaactgaatatgagtgtgagggaaagaaaggagtgaaggatgactcttaggtttttagtttgaacaactgggcaggtgttgctgccactgacaaagatgcagaagactaagggagaaacagtctgtgagatgaacttgagaaaccaagagttccagtttgggcatgaccagtttgagatgattagacatcaaatggagacatttatatatacattcatgcaagatgcacgcacatataacataaagaatgatgatgtcactgatgctat

SEQ ID NO: 149696 - DNA, 269 bp, Homo sapiens
tagtgtttccctgacctgcatgaagcagttttaatcttgtgtatcctgcaggagctaaggtcctactatcatcactcactgcagactcagagcccagcacatctgagacttcagccttacacatggattttaggtttcagttctgtttctggtccccagagtcctctcttgtttctcagtttatttatattgtttttgttggctatttatatattattattgtgtgtttcgagtggaggagatgcattatgtttctaatttactgtaga

SEQ ID NO: 149697 - DNA, 498 bp, Homo sapiens
ctcagaaacactgggcatttgcaggaaatgaatgtatgctgttgctggaatatcctctgtctgtctgaagtagtcctgcttttgggcttgccttttctctgtcttcaacattacaaattactcttcgtgcaaacagcactataattcagataaaagttttagaacttgaaatgcagatttgtatttcaagtaaataatgttctagttctaagtatgtatcattttacatgaatatccagactcctgtctaatataataactggattcttttcaaggttattgttcaccagggaaagtcacctctcttacatttttaccattcttgcaggtgtgtagcctggacatatacacatgtctgcttatttgcaacatctcttcccagagaaacaatgaagtacacttaacttcgttcatatatagaagttaaagaggattgaagattataggaaatgtaacaatgtgaatagattgcggtgtttggggtacgagctcgaatcg

SEQ ID NO: 149698 - DNA, 406 bp, Homo sapiens
gattataaaggatactagagaaatatggagtcatcgggtgtgactgttgtataaatatccagaatgcttcctagacgtgtttgtctactatgtgtaggagcaagctaatccaacctctatatcattttgaattaatactgcgtactgctgaaataattgttatgtatccccatatttttgtcctgtcccttttctgcccctttgagcaatcttgaacaaattggctgtggttttcttagttggttggaattagtatcatttacaaatttgaataattctagtctgtactctattcctccgaattatttataatacagctatatggctaagactcagagaaccccaatactttcattctttatctagagaggtgtttagaccacgtcttcaaaaaaaggtacccctc

SEQ ID NO: 149699 - DNA, 1035 bp, Homo sapiens
aaataaggtggatggatgggtggatagagggaaggacaggtggctagagctgagataaggcaactagagtcaactgttcattgtggaatccgcatggtgggtgattgatgttcactgcacagttctttcaagaacacaacatctggggacaactgtaggttccagggctgcagcacagccttcctgcattggaatgtctgggggtgggaccctagaatgattctggggcccagccctcccctactcagtgacaagcaaacttctgctctctcactcacagagtatcaccaggtcatgtgaaagtcgatgcatcttggcctctggtgcccctttttctccacttcacgcaggcccagggctgggctcaagggagcatgggtagaatagggtaaagtcacacctcagtgcctgatgactgacactctctagccctctgcaccagtagtgatttctgctgtccacggcacactgccatggcgtgaacagaatgtttgtgccctctcctcccaaattcatatgttccactgtatgtggttaactataatttattgtatagtctcaaaaaactagaatactctggattgctgggattacaggcatgagccattgcacccggcccccagtggcttttcaacaagggccaacaaggtcattccatgggaaaataatcatttaataaataatgctagaacaataagaaaaagaagaaagttcaacctctctgtctatgtatagaatggaccaaaggccgaaatataagagctaaaactgtaaaactcgtaaaagaaaacagaagggtaaatgttcacaaccttgggtttggtgatggatctttagagatgacagcaaaagcacaagcaataaaagaaaaaaataaattggactttataaaaagtaaaaacttttgtgcatcaaaggacattatccaaaaagtgaagacaattcacagaatgggaaaaaatatttgctagtcatatatctgatgagggtctagtatctagaatatataaagaacacttgcaactcaacaacaac

SEQ ID NO: 149700 - DNA, 625 bp, Homo sapiens
gaatactctggggaattttttttttggaaatacaggttttatgaaaacacacacatacacgcacacaaattttgaactgtatttaatgaaatgcctgccaaagtatgcaaaggggcagtggatggatgtctcttacttactttggatgcaacttactttgaaatgcaacaagtgctgggattacaggcatgagccattgcacccggcccccagtggcttttcaacaagggccaacaaggtcattccatgggaaaataatcatttaataaataatgctagaacaataagaaaaagaagaaagttcaacctctctgtctatgtatagaatggaccaaaggccgaaatataagagctaaaactgtaaaactcgtaaaagaaaacagaagggtaaatgttcacaaccttgggtttggtgatggatctttagagatgacagcaaaagcacaagcaataaaagaaaaaaataaattggactttataaaaagtaaaaacttttgtgcatcaaaggacattatccaaaaagtgaagacaattcacagaatgggaaaaaatatttgctagtcatatatctgatgagggtctagtatctagaatatataaagaacacttgcaactcaacaacaac

SEQ ID NO: 149701 - DNA, 788 bp, Homo sapiens
caaatggtaaaaaactttgtcgctaccttagttcaccaaaatgcttcagcacaagcatactatataaatcactatcgatctattgcacaaaaagacataagtagcaaaaataagagtgagaacttcccctaataaaaagtgagagtctcaaatgggggaaatgagggaagagagagaccctctcatattgttttatattgttttatactcagtacctgttttaagaaaaaaacaacaagaaagtaaaaccaaagacaggcagcccagcaccaggcccgaaaccaggcctgggctgcctggcctaaaccagatttcatttgtagattgcattgttcatgcttggctaaagcagaacagtattatggtgcaacaggcactaaaaagaactataggaagatgtgagtttggaggagtacatgggagcctcatcatatagtaacttgtgaaccacagggaaaccttcacgttttactgagtgagataggtagttgaaaattagttaaaaatcaactcataacttagaaaccgatgttattcatagattccagacattgtatagaagaacattgtgaaactccctgccctgttctgtttctctctgaccaccggtgcatgcagtccctatcatgtaccacctgcttgctcaaatcaatcacgaccctttcatgtgaaatctttagtgttgtgagcccttaaaaggaacagaaattgtgcattcggggagctcagattttgaggcagtagcttgccgatgctcccagatgaataaagtccttccttctccaact

SEQ ID NO: 149702 - DNA, 500 bp, Homo sapiens
caatttctcagatggtttctactctgtataaggatatgagagtaatgtctccctacacttagtgaatggttgacagtcccaacaccccacccctttcttaaatatgtgcttcctgaataactagactcttgtgcaagctaatttctttcatcttttagttcttgtaatgctatttgaatttagtgggacctcttggaagtagtctgtccttgtgtgagaggtggcccaccatcaccatggatgagagctgatggagaaaggataactgagtccaaagaactgtggaacttccctcagggctggaaggtccctgctccttgctaactgcccagggccccttccataggttagaatgtgggacaacccacccatagctgacttaacatgtatcaggagttcatgccttctttatactgaatggtaacccattgtatggatataatttgtttatcatctgcctgttaatgaatattacactgagggagagaaaccagaccaaa

SEQ ID NO: 149703 - DNA, 396 bp, Homo sapiens
aaataattgttcaatactttggggcaaacctacagcactgtttggggctgccttcaagtaactactcaggtgtcccagcccaccccatggactaagaatatcaacagctgtactcactaggcatacctgttgggaagctttgcatcagaggaccacgctagtaatagaagttgttggaccagccaacttttgagggttccttgcacgtttagagactatacccaatctgtggaaaagctcccttgcaaaatatgttccatgagttagaaaagaactcagtgaaaaaagatagatttgccccaactttattggaaaaagaattccctgttcatttgcccttgatcaagtatcatcatcttcttagaacaataaaattataatcccagaaatggaatt

SEQ ID NO: 149704 - DNA, 405 bp, Homo sapiens
cgataaagtaaaatgctataaaacaaagtattcttgcatttgtttgtttttaattcataggtttaacatttaaagtccttttaatcaggagtgtgcgtttgttgataccatggaaatttaattcaccaagatttatttatgacttaaaggtttcttttgaataattatacatatccatttacataaaatctgtctttttttggaaaaatatgattctatgtaagaaggataacaatatattctagagcaatttagtgttgacagatacagcataccagctgaaatataatttattctagatttttggataatattttccttaggaaaccatcttttgaacattgagcttaaggtaggtagggattgatgtcacattgatattttaaaaatgtaaatgatgaaatt

SEQ ID NO: 149705 - DNA, 1163 bp, Homo sapiens
gaaaattgtgaagtcaccactttaactgagtcaaaattttgtttgaataagctgatgaaaatagacatgtaccctagaagtagatactctaaaattatacagacatgaatgtcttttttaaaaggttgtcattattgacctaatattgagtaatctttctgcgttattccaaattgaaatttgtttgctcttcattgtaacttttatgtaaaagtcctttaaaaggggattcaattataaggctatttgactatagggcagatttttataagtaaacattcccccaattccacttatgctaactgtctcatgacagtaaagtttactcctttttagaaaccctttctcagtattttaatttctgtcattgaatcatttaaataataaccttttgtttttatagcaaagaaatcatctgacttttctgtgtgatgtttcttggcaaaataagcacttgatgtatggtcatgtacataatggatattcattaattttgtgattagtgctgagttttctaaactactatcttaagctcttaggcaccctattatggatctaattcaaaccaatatgtaggaaatggagaaagtaggacttcagtttgcgcttcccaataactttaaatatatccaccttttccaagtgtttaagccctaaaacatctatctttatttttttacctggcatttttgttagaaaatagattacgttttaaagtaacattaaaaaaattcttcagtaagataattgcttttaataagtatatttttcttgctcttggctctatacatttttgcataatattttagtcttgaaaagcttttcattttcttaactctggaaaataatagtttggaactaaattagtttgagaaatctgaatcatctctctttaaatctgttcagttagtctcatgtattctcaggggaaaatgtctttattttactaagcggaagtagtagtcatattgaggcagaaatttgtagcccaaacaaggtaggtcttcgctgaaactaatttgaactattcctatttgaagcaaattgaacactattataaatctagactggctaattagatggaaactttgatggttaggttctttaagaggcatacaatccgttatgagaatgtttatgtttatgttttaatttttatcaaa

SEQ ID NO: 149706 - DNA, 1008 bp, Homo sapiens
cagagacacacagaagacacagagaaaaggtggccatctacgagccaccttctacaagagaggcctcagaatgaacccaaccctgctgacaccttgatcttggacttctagccaccagaatggtgaggacataaattcctgttgcttaagccacccagtctgtggtattcgttacagcagtcacagaaaaatagtacacaggccttgagaaacagacgtgaacactgctccaatccctggagtaacagggattcctgtgagctgcctgactgcaggcagcactgtcagcatccccatcccccaggatcgcctgggacctccctcttatcacatcgctccacctcagctccttggcagccaggcctccagcgggaggcagagggcatcctcaagctgggcaattggaggagcatttaatgaaggggctctttacaaaggtgtgggcagggttttgggaggtcagagaggaatgatgcagcccttctgcaacctcgcctcaccccaggcctgcaggcatgcggagggagtgcccgctggaacccagggccaggacagggcctgtgcagaggagtccaccttcagcaagacggaccaccaatactctgcgacttagagaaggagactgaggaataaatgcccagaccgtactccgctcctgccctcctggtttcctgccagagtctccccttgtctgaagccaacctgaagacaccccttgaggaccccttcactgtactgggaccatggggggctgagcctctgggatcagtcacctccctaacctcctgcatgaggaacaacttgacgaacacacatttcaacctgtaacagggtggacaagcagaacccttcttcagaagcacatttatgaagttcccgcagtaactggctcagagagaaatgctgctgtaacagctgagagaaaactgataaccctgaaaataaagtgtccatggaaatctcatatattgcctattgtttaaaaacaatgtctcacataaaagaggt

SEQ ID NO: 149707 - DNA, 273 bp, Homo sapiens
gaaaatttcctaatggtagcttagaagttgctgaagtttatgcataaagaattaagggataaagatatttagaagagcttagtcccatataatgtattcagaccagagccatttctgaaatgagtaaggttccaagatctcagtattactgggcagagacttccactatcagatctatttctatgcttgagcccagaagtttagagattgcagtgagctatgatagcgccactgtactccagcctgggagacctacagcaaaaccctgtcgcc

SEQ ID NO: 149708 - DNA, 199 bp, Homo sapiens
ccttctctggctccctactgccccaagacaaaacctacatgccttatcttggccttcaagcctttcacactcagaccctgcccactgtccagcctcttctccttctgttctccccatacgccaacccatggccaatgggccacaggccactcgagtcaggcagtgccacaaacagccttcgttctccctcacccttccc

SEQ ID NO: 149709 - DNA, 338 bp, Homo sapiens
aattggtcgtgtgaggtcaggcccagtggctggggcaaaagttggtatttagcccataggtcttgactgagccttggtaatggaaagccggcagcaggaagactgtcccttctcgcacctgctgcatggcacagagaagctgtgacaacatgcttcccaccctttatagattcaggaggtgggggtggtgctcttggagcatttctctaaggatgaaatgagagagtagaaagtgccgtgctagctctggtcagtactgcccacaacccattccccctgcagggacccttccttgtgcatgtcagtggagcttcctggagcaaacagatttaaagact

SEQ ID NO: 149710 - DNA, 352 bp, Homo sapiens
gagacagagtgtccttgctcagaaaactgtgaagcaggggtcttgttagttacaaagccagtcctagttgcatgtccaagggggtagattttcatcaccctactaaatgtggtatgtcactgctgaagccttttcctgttttagtaatatcttaggcactattgtcttttgtcttccagagtaacatatctgggcccacctttcttgcacactgtgattatgtgctaagaaaagggtggagttgggaggacaatttcacttgaacaggtttctgttcttctgaggtcagggtggggaggatgtccaggtgacttttatggacacattgcaagacagtaagccgcggatggac

SEQ ID NO: 149711 - DNA, 292 bp, Homo sapiens
ttaaatttgtcagttgtaattaaggaatataagtttgctttgagatcttatatgcagtaaaactctgtagttcgtacgttgctgtatgcttgtatttaaataattcctttcaagaaactatataaattgcatataaataattgcatgagactgtatttagttatgtcttttcattttgtgttcttataggtatattaatataactgtaaattttaagcctctcattaggtagaacattagaagtatttatttccttaattatttttagtggtgtttttataaatgcatcaat

SEQ ID NO: 149712 - DNA, 411 bp, Homo sapiens
ctccctcagcctcctgagtagctgggactacaggcgtgtgccaccaagcccagctaatttttgtattttagtagagacagggtttcaccatgttggccaggatggtctcgatctcttgacctcgtgatccacccacctcggcctcccaaagtgctgggattacaggcatgagcccaccatgcccaacccaagaatttacatttctaacaagttcccaggtaatgcttatgctgctggcctagaaaccacacttgaagaaaccactccttcagaaaatagttcttgtctcccaagaggagaaggaatgcgaaagaggattttaaagaaagcttccaaattgtggccaactctgatagaagatcatagacacttgaaactcagtgctgaagaggatgctgtagtcatgcccag

SEQ ID NO: 149713 - DNA, 561 bp, Homo sapiens
agacaagggtgccaaaatcattcaatggagaaaggtcagacttttcaacaaatggtggtgagaaaactagatatccatatgcaaaagaatgaagttggacttttaaccttatatcatatataaaaattaactcaaaatgaatcaagaacctaaatgtaagagcataaactctaaaactcttagaggaagacatgggggaaatcttcatgacattggacttggcaataattccttggatatatcaccagaagcacaggcaacaaaagaaaaaataaataagttggacttcatcaaaattaaaaacttttgcctatcaaaagtcaccaccatgcccaacccaagaatttacatttctaacaagttcccaggtaatgcttatgctgctggcctagaaaccacacttgaagaaaccactccttcagaaaatagttcttgtctcccaagaggagaaggaatgcgaaagaggattttaaagaaagcttccaaattgtggccaactctgatagaagatcatagacacttgaaactcagtgctgaagaggatgctgtagtcatgcccag

SEQ ID NO: 149714 - DNA, 565 bp, Homo sapiens
ttcagttgtccagttgacatctacacttggatatctaataggtctaataattgaatatccccaaaacagagctgttgaaatccacccccagcaaacccatttcttttgcaatcttcactgtctcaatagatgggtactccattttccagttgtttagttccgaaaccgtgatgtcatccctgactcccctctcatattccatagccagtctttgggtaaacccatcatctctactttcaaaattcatctagaaacaatgacttctcgttacttccattgctacaccctagttcaggccactgtcacctttccccttgattatcccagtagcctattagatatccttgcttccagcattgttcccctacagtgtgtcctcaaaatagtagtcagatggttattccaagagataagtcagattttgtcacttctctgtgcagaaccttccagtggctggtcatttcacttgggttaaaaatgcctacagcaatttgtagggaaggccctatggaatcttgccacctcttctcatctagcttttcctgtctccctaaacttttgccag

SEQ ID NO: 149715 - DNA, 412 bp, Homo sapiens
ggaggtcgaggctgcagtgagccgtgattgtgccactgctctcaggctggcaacagagtgagaccctgtctcaaaaagaaaagaaaagaaattatcctggagagtcgcctgcattgccctggactttgtgagcatgagaagtaccctgtgatatgtgaagccatggagagttaaggttattgtctgtatgcagacttacattcctgccacagaacccagcccattctgactacaaggcagagtttctgaactggagttagagagggagggagggctggattcagggatctggctggtgtgatcctagtttgacaggctcagggtcatctggtcaacccctgcctggcacccacagcccctgggccatcccctcctctctgtgtgccagacaaggtaggctgtcgtatggggt

SEQ ID NO: 149716 - DNA, 175 bp, Homo sapiens
ttcctaggcttctctggccatctaccctagagcccaccatggggcccggagcccctcctctgggtcccctgatattccatgttagctctcgcctggcgtcctcaccttcaggtgggagttcatctgtctgcctgtctgcctcccctgttagctgggcctctcaattttccatccc

SEQ ID NO: 149717 - DNA, 235 bp, Homo sapiens
tccaaactatctttgtaatgctttctgtagctctactaccttcctgcctgcaaaatgggcagcaaaccactccctgtcttaccgtagcatgtcaccaagcgtggatttgcaatcccaaaaatgatgctaggtggatacatggacataggattaagtaaccttcccttttaattctctttcaatcctgattatgccaaggactcagtctctggttgctgctaatgtgtcttttata

SEQ ID NO: 149718 - DNA, 326 bp, Homo sapiens
cacagtcctctgggtcttctcccatcacagctgtcacactctggcctgtgctttccaaggtcactctggtttgtcactgcctagtaccatgtctgtctccctcactgtattataagctccatgaaggcaggacctcagcctgacagggctggactcagaggaggcaaaaagttactatcaacaaaaatgagtgaatgaatggcaagcatgacaaagatactaacagctaaggctcattaagaggcttccacacactagcttctacgaaggctttgcatggatgaaataaccctcacacaattccattttacaaatggggaaactga

SEQ ID NO: 149719 - DNA, 150 bp, Homo sapiens
actatgctattatcaactgttgacaacatacagtcaagcccaaggttctagagagaggaggaaggcattttgatttggtgggaagagttgagggagggagagcaaccagtagtactaaagagagagtaggtgtggatgctcagaaatggc

SEQ ID NO: 149720 - DNA, 428 bp, Homo sapiens
aagcagtgggtagaaaatggtgactttcccccatgttcctggttgtaaggacctgagaagaaaacagagtctggaagctctgtgttgaagggaatgaagtggtacaagtggctgctctgtccatgagctgagtgtgccacagggcccggtgtgcacatgtgcacacctcttcccggccaggttcgggggcccatgtttggctggtacaatctcaatggcttcttttcttttcttttcttttcttctttttcttttctcttgcttgcttgcttgcttgcttgcttgcttgcttgctttttgagacagaatctcgctctgttgcccaggctggagtgcagtgacgagatctcagctcactgcaacttctgcttcctggattcaagtgattctcctgcctcagcctcctgagtagctaggattacaggtgc

SEQ ID NO: 149721 - DNA, 437 bp, Homo sapiens
tggccagtgtatttctccagcctaacccagcctgctgtctcacgggcatccttgctcaaggcatggtattaatatctccaatagattgtatcccctaacattctaatacctttaaacaagctgctgttttagatgctatctttctctactctagaccatctaggaattgaacccatatcttagtctacctgtgcactccgctttcatctaaaatgtctttcttgacacttctcacagggaggaattaaatactcctatcctatattccatgacactccaggcatattttttcagagaatgtatcacattataattgcaactgttgattacttgtctttgtttcttgtaggagatttgtagcttagtccctagaataaagtaggcatctactgttgaattagaccatttttacactgctggaaataaaaaatacatat

SEQ ID NO: 149722 - DNA, 357 bp, Homo sapiens
gattacaggcatgagccactgtgcctggctgtcaatagttgtatttttaaatattggtactgctgaagatctgtttctggtgactgatgttttaatgagatggatgattgccaatgatgtatttttagtatttataggcatccctattttttatttttgataagttgaatctcattggtggttataaccttttaaaaatcttttatttcctttaataactggttacgttttatgtttgattcggtgtgttcttgtaagtctgagggacagctcttatctaacagtgttgagtcatcttaagttgaaactacatctaggctagtttcaatttgctgtcttcctgccagtgaaaaataa

SEQ ID NO: 149723 - DNA, 513 bp, Homo sapiens
actgagacactctctcacaaaaagatgttttatattctttgtttttgcttaagtcttcaaaagctgatgtgtatcttacatttatagcatgttcaaattcaaactggccacatgtcaattagctagagacgaatttatcttggacagcgcagatctagactttgtcactaccagagagcacacccactatctcaatttccagcatcccagtccaggactaccatcacctatctttttagctcattccaatcagtatctgtgatcctcagaaagtctcttaccctataggacctccaatccattgactcaaccatccttccactctcctttaaaataactacattacctggcttggatttcttacaccctcaactctcttggcccttccccagtagtactgcaaccctagtaaagcaccttcctgctttacaccagtactataacaaccctacttgaagagtctcactttaaattcatggccaccaatttcaggaagaccagcaatcccaatac

SEQ ID NO: 149724 - DNA, 355 bp, Homo sapiens
catttttgttggagtaattatgaaagaccacagtcattttcagtaacaaggtaactccgggtaaagacagaactctctgaaactttggatttgctggagtcttccttcctcagttgcctttgctaatatgagcccgggataaaggcccagagaccagatattttgggaggctactatcttgcctgaatatcccggatctcccagtgccttcattggggcctaatggacataatccagcacatctgagagagcactgctggggggccagttttgcattaattgagatttggggtctggagtcagaagctctggagtataggctcgagagggacaggtgcagcctttgaagctgacc

SEQ ID NO: 149725 - DNA, 479 bp, Homo sapiens
aatggtgcctcccaaccatacacaggtgaagtcaaaaacaatcgactactagaatggaaagactacaagaacccttaaacagaaagattaacatcattttggggcaaggaggtacatttttttaaaagattactcaactagatggctccactgaaggaatccacatcacctgacttcatattctagtatctagacttcaaggaaaataagttcacttttctgactcttggtttctttaacagtaaaatgaaacgtacagactttcgttcattctaatgccctttcaaactctaaatgacctaaccttgacaggagccatgacagtaaaaaaaaggcaaggtacgaaagtgttgagcttgcccaggtttggaggtttgccccatcatttaagccaaataaatcaagcttgaattgcagattttcccatcatacagagctgagagagggactcaaatcatactactaggaagtggaaattc

SEQ ID NO: 149726 - DNA, 374 bp, Homo sapiens
gacaagcagactcccaagctggaacagagagaagggctttgagggagggcagaatgtcaggtaccgaaagcaggaatccgtgaagaaacccaaaccggtttccatttacaagccctaacactgggacaatgagaatccgtttcacatggtagagcagtcagccaggtacaccacgctgctgttcccccaaggggaaaccagaggtaggctctgttaccagtggatttcgagttgactcggggatccctcctcgccaccggaatgggggaaccaggaagttgtggagcagctgcgatccccgaaactcaattcgcaatctacgcaacacccacccctttctggaactcagaggttctcgcccagtgatcgcaggc

SEQ ID NO: 149727 - DNA, 735 bp, Homo sapiens
agcacacccgagcctgagacaacagctctgctaagtgcccttgagagggcacggtggggtcagcaccaaagtcagaccactaaagagaaaaagagagaaagacaggattgcagaggagaaatgagaatggcagaaaaaataattttttaagccaaaaggaatcagagaagagcagaagtgcctctaggataaagcgtagcaggcagttagggaaaaagggctgttaactaccttgaagctctgactacattagaaagcctcgcaagacagtcgttgcttgcacgggcaggtagagaacttttcctgtccattgttcttctgaattataaatcactgacctctttatgatttctaaagggaaaatgacttcaagcttcttagagttcccctaaggcattctctatattcaatataatatgggaagccctgggtttgtctttgtatgtttcatctgcagtgacctgaaatcttcataaccctcttcctttctccacttatcaactaaggggtggttggcaataaggatgggtgggagagaaaaaaaaacagaatttgaggaggagagcatttaaaccatcagactgtgtgttctgtgacatcaaagactggcaacattctaaaggaaaagcagctgtgaagtcataattatgttcacttcccactggcaactggcaagccctttatttttgtgcattcggaactcaccaagaataaataaagtccattccctccttg

SEQ ID NO: 149728 - DNA, 221 bp, Homo sapiens
acaggtttccgagtgtatactcgctaccttgaataagagcctatctggccgttaggatacagtacaaaaaaagtatgactcttccttttttctctccttttactttaggaaaagcagctgtgaagtcataattatgttcacttcccactggcaactggcaagccctttatttttgtgcattcggaactcaccaagaataaataaagtccattccctccttg

SEQ ID NO: 149729 - DNA, 210 bp, Homo sapiens
tgctgggattatagtcatgagccactgtgtctggccagaagtaaattttatctgtacatattattaaaatgaattttcaaataaatactataggaatacacttattctttgttttcttccaagtcttaatgccataatatgctgttgaggttttggtaaagtgttttccacatcactcacatcagaatcacctgaggagtttgtcaaaat

SEQ ID NO: 149730 - DNA, 339 bp, Homo sapiens
acaaatatttattgaatgcttattatgtgctaggtaccattttatgcattggagatataaagtcaacaaatacctttgccttcatggagcttatatgttagtggagagagacagacaataaataacatataaacagtttcatgtccatttaatagcttcatgtcagacaataaacagcttcttgtcagtttaagtgacatatttctgtacaatgagtattaaatgattgttttcaaaaaaggtaaaattatgactgttatacaggtataagatgaacacattttaatgattttatttaactttctttttttaaaaaaattttttatgtttttagagaca

SEQ ID NO: 149731 - DNA, 594 bp, Homo sapiens
ccgtgatgtcctgccatggataagtatgtgggtttacatacacatccacacatatctgtatttctgtatgtgtgtgtatatatgtatacacagaaagtggaagtggattaggttccaattatttccagtcaaatttatatcgtatataagttaatatcaagggaaatgaaaagtcagttctagcattacttttagtaatgaaataattcacttgggattatgctaatgatatgtagatattaatacacataatttggctgcctaatattgatttaagttgctcattcaaattctctttattacaaaaaaataaccattttgttttacagtgcttgtcctcagagacagtgagatccagtaaaccatacttatttggtaaataatactatttttgctgattttcatatacacagagagcactattctctttcagtaggtaccctttgagttgttaatttctggttggggtcctggttagctctagccaaatatcctctctggatctgcctcatgatcaatgcctagggttgaaggtactcccggtgaccagggcacagaagtttttgttctctgtgatgttaatatgccctaggg

SEQ ID NO: 149732 - DNA, 750 bp, Homo sapiens
ccacttagccttgtccttcctgctagtgggtgagcgagagagaggggccccctggctaagagacttggcaggggtgatgacaagatgctcagcaggatagagccatcagactgtggctgtcatcgggaaagacagagacgtttctgcttacaactttgaggcttccaaacttttcctggtacgagagagtgtttcttccaccttaaactacatgatggaaagatatgtgagaatagaaaaaaaaaagcgtgtgttgctatggaactgcaaatccctgatagaagtcttcctctgaaccacatcctgcatcgacgagaccacccagctagtcttagagcaagatggagtggccctctcaaatgctatcatttgctgttacctacattcctccaggccctatgtagcagcccctatcatagccatcaccctcaggatttgaatcaattccccagttagcacactaggggaaaacaaaggcctcatttgaagtctctcctgactgtattccttaggaagctgtcccacaatgcctcggtgagggctggcaggcgagctgactagcccctgccggacaactgtcaggttggttgaaggatattagagggaagttgatcatgtgtcaacgcttctcagcgcccactcacatcagggaagtgatacagctgtcactgtggccgacgaggcggctggcagaacaggccacgttcaccaacccagctgtccaattagatgcaagggcctgaccctcag

SEQ ID NO: 149733 - DNA, 305 bp, Homo sapiens
ccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgct

SEQ ID NO: 149734 - DNA, 248 bp, Homo sapiens
tcgccacactgacttccacaatggttgaactagtttacagtcccaccaacagtgtaagagtgttcctatttctccacatcctctccagcacctgttgtttcctgacttttgaggatttttaaattaaaagatgattgagtataaatctggtttttaaatgctgctctttgcaatggaaataactaatatttgtgaaccaaaagcctgatttagaattcttttcattgctttatactgtaaaccaagaa

SEQ ID NO: 149735 - DNA, 387 bp, Homo sapiens
ctagtccatgctttcaaggagtttatgctcagaaaaaatgggatgaacaataactacattaagaagaagaaatggatgtgggcactaggagggataaattgtttctgaagcatagaagaggggaaaatgacttcagtttggacccaggaagctgttactagaacaatcccatttgaataggactttgaagggccattgtgtagcatcggacagacatcttggggacaatattctaaacttgcaaaagggaaatgggagaagggcaaaacacaggaaagtattcgaggaatgccatgagtacctgtagattacaaggagggagagtaggaaattggagccagatcttccagggctttgaatgccaagctgaggagccatcatggggaa

SEQ ID NO: 149736 - DNA, 237 bp, Homo sapiens
cggggatttatggccaagtgatctcccttaaccataaatcccacaaatgtccaagtcagggcaagaatcctggagactggtactaggagtggttgaggtgggtggttctcaaagttcaattcctattgcaagttcctacaagaaaattggatgccagatgtcaaataagaatgcagttttattcccatacgtacgtagtggcgtttctttgattccttaaaccaatttccctgccag

SEQ ID NO: 149737 - DNA, 343 bp, Homo sapiens
attatttcagaagctgtcaaactcttgatggccaatacagaatgtctaaaattcaaatttttactcaaaactcaaattttgtcattggcaacaaacactaagttttcttccttgaaataatagactcactctgttcttcttcaaaaaatgtcaaacattctctcaagtgaaaatggtgtgcacaaaagtaacagctaagccaggtgcagtggctcatgcccataattccagcactttgggaggccaaggcgggcagatcacttgaggtcaagagttcaagactggcctggccaacatggcaaaaccccatctctactaaattacaaaacttagctggacttgg

SEQ ID NO: 149738 - DNA, 216 bp, Homo sapiens
  misc_feature (22)..(22): n is a, c, g, or t
tacatctgagtgagagtagctntggctgtagtctgattgatgagatttttgctgctaagtagatatgtaacatgtctcacatttgcttggaaattaagaactcttacatccagataatcccctacccctctctttacatatgtgaattttctcatttttcaaagttctcctcagtcactacttcctatgtgaaggtagagcttatcaatcaaggct

SEQ ID NO: 149739 - DNA, 620 bp, Homo sapiens
tcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacagtgagttccactgcccattcccgcccccaccctgcagctcagccaggatggggagccaggccctcttctccagtttctggaggactaggactccttgcttctgctccaatccctagggttaagggtttgcacccagtgcctgcccagcaactgactgtcacctagagtgctgtgtccaatgagtaaatggcaccccagcccgtaagagcagggcctactattcgagagaaggtgaacttaggggtgtgtgtcattgtctctcaaaccagaaaatccctgactcctcctaccctcagctactgcccatttgtcacctaagcatctgtcccttatggactctatacgacctgggtgccacagagatcccacccgctccctgctctcccacctggcccacatcctgcctctcaaaccctcctttcccgcttagcct

SEQ ID NO: 149740 - DNA, 382 bp, Homo sapiens
tggatggactgggtatctgtcttggctagaaatgcacctggagtccctttagactcctttgcaattcacacctgcacgccccatgcatggcaaagcccagggcatgtggatgtggagtgcggggagctggagcgatccctttggctttctctaccagctggatagatcagagccttcaatgcccatttgattcaggaagtctggggtggagcctgagctgctcacctttagcccctgggaagtgctggtgatgctggtcgcgtgacagcagcgcagtgagacatgagagtctggagtagctgaggggcgagcgctctctgatcttggctcctggcctcacagatcacagggaatgacaccgatgagtagagccttgcacttc

SEQ ID NO: 149741 - DNA, 184 bp, Homo sapiens
ggtggggagtccccaaagctttcagctcacccacctgggcttggggggacactcttcccttgctcctgcctcccggtgccttctgtttccctgtctggcatgcctctctacgcccccactcctccacctgctcagctctccaaggacctggtatgtgtgcctcctccatgcagccctccaggct

SEQ ID NO: 149742 - DNA, 319 bp, Homo sapiens
agccaggcatggtggcgcgcacctgtactcccagcttctcaggagactgaggcaggagaagtgcttgaacccagaagactgaggttgcaatgagctgagatcacgccactgcactccagcctgggtcacagactgatgagaccctatctcaaaaaaaaaaaaaagtaataaaagaaaaatgcaaaacagtttggaaatatctgatacagggaaacaacagggtgattaaaaatgccaatcagacatctaaattggggcctagattatcagacggagtgactggagtcccaaattaatataatcagtgaagaaatattat

SEQ ID NO: 149743 - DNA, 338 bp, Homo sapiens
gcaggaactttccattctctttaccaccttctaaatttcctctccaaggaggctcagctgcgtgaccttggcacacctttacctggaaaggcaattcattcagatgcacatttataatttcctattgaaatatgccttatttttcctcagtctactcccaaaagcataagattatttaaaaaaaattatcagaaagctttatagtttacagtatggaagaaataaaattgagaaatgggtaatatttaatggcaaatattatttacataaatcatttacataaaaataaaactattcaggccaggcatagcggctcacacctgtaatcccagcacttt

SEQ ID NO: 149744 - DNA, 710 bp, Homo sapiens
  misc_feature (53)..(53): n is a, c, g, or t
tacaggtaccgtttgatacaaaaaatggaccctccttcacttcaggagctcangagatccagatggcagccggtcctcactgggctgtgcctgtccatgtgcctggtcacggtgctggggaacctgctcatcatcctggccgtcagccctgactcccacctccacatccccatgtacttcttcctctccaacctgtccctgcctgacatcggtttcacctccaccacggtccccaagatgattgtggacatccagtctcacagcagagtcatctcctacgcaggctgcctgactcagatgtctctctttgccatttttggaggcatggaagagagacatgctcctgagtgtgatagcctatgagcggtttgtagccatctgtcaccctctatatcattcagccatcatgaacccatgtttctgtggctttctagttttgttgtcttttttttttctcagtcttttagacgcccagctgcacaacttgattgccttacaaaggacctgcttcaaggatgtggaaattcctaatttcttctgtgacccttctcaactccccatcttgcatattgtggcaccttcaccaataacataatcatgtatttccctgccgccatatttggttttcttcccatctcggggacccttttctcttaccatgacaagggtctcgctccattccaagaaaaaaatccgcctccgttggccca

SEQ ID NO: 149745 - DNA, 708 bp, Homo sapiens
  misc_feature (53)..(53): n is a, c, g, or t
tacaggtaccgtttgatacaaaaaatggaccctccttcacttcaggagctcangagatccagatggcagccggtcctcactgggctgtgcctgtccatgtgcctggtcacggtgctggggaacctgctcatcatcctggccgtcagccctgactcccacctccacatccccatgtacttcttcctctccaacctgtccctgcctgacatcggtttcacctccaccacggtccccaagatgattgtggacatccagtctcacagcagagtcatctcctacgcaggctgcctgactcagatgtctctctttgccatttttggaggcatggaagagagacatgctcctgagtgtgatagcctatgagcggtttgtagccatctgtcaccctctatatcattcagccatcatgaacccatgtttctgtggctttctagttttgttgtcttttttttttctcagtcttttagacgcccagctgcacaacttgattgccttacaaaggacctgcttcaaggatgtggaaattcctaatttcttctgtgacccttctcaactccccatcttgcatattgtggcaccttcaccaataacataatcatgtatttccctgccgccatatttggttttcttcccatctcggggacccttttctcttacaataaaattgttttctccattcaaaaaaaaaaatcggccctttggccttaa

SEQ ID NO: 149746 - DNA, 849 bp, Homo sapiens
ggtttagatgtttcttaagtcccttgtgacacattgctgatgtccttctatgagaaaatagtgtattttttagcaagaatgtgggaacagatctttctcttgacttcagggtcttagatgagggaatagacttatctgattcaagcagtctgtccttctaggggaaataactaaatcataccaagtgatgtaaagacccagtcttaaaatcccaaaagaaattccttacagttagtggcagttctcatctattgcatcgtccggggcactaggctattctttactgctggttgacttaccaccattttctctagacacatagattccgtctcaaaggggcaatcattttctcccttcccagcagtgacaggtgtgcagcctttgtttattcagcccttctcctccaaagagcaccttccctagtctatagcatcacagagaggaccagaagaaagaacagctcttgtgtgtcaattgatgtataaacaagcaagaagaggaataacaaatgctgcaccttcaatattactgcttaaaataatagccatgtaagaaatttagtaaacacagttagaatttgatgtgccttgattgttgagtattcacaaactcaagcctaagggtcaggaaacaaaatactgaacaggcccattaaggcaaatgtcatctttaaatacctatttaactctctgggagtttgtacaaataaggtgtgaagactaaatatatgaagcatgctgaaattcatgttttccttgctgtttgtaaaagggctagaaatcccagcaactctcttaaaaatcagacacctggtataccaagctctggatttaaaaatccctaacattt

SEQ ID NO: 149747 - DNA, 144 bp, Homo sapiens
ggagaccatgttggaggctgagcagtagtccagaaggaagatgagcacagcacagcagagacaggttggagaggcggtgacagggcccccttagggagggctcagcaggtgggcttgtcgggccctggtaccacctgagtatgg

SEQ ID NO: 149748 - DNA, 550 bp, Homo sapiens
aaagcctggaatgctgtctaagctgtgtcatatggaacacaggaagcaacttagtggcagggcagcccttgggcattatgctgtagtgagctgtgctgggtcaacaagggctggggctcagacttagctagatccacagccctctgagtcacagggcagaccaacacaaaacactagagggatttgttttttattttttcagaaaaatgttataagagaaattgatgtttaatagttagatgggctgctatgttcctaaaagggccaatggccagctatttcaaagacagacagaatatgaactcttgacctagttgtgtgacacacctagcaggtttatcagtgaatgttaaggcaaagttgcaatgtctcattagaattcgtatcgattctaattaacctataaccaagttcctaaaaagtgtcacgaagtgtgctgggtgtgggagataccaaagcttttctgcttcaagaggctgagtcccactaggatactgttgtatcatcagggttgagagtaatgccctcagtaaacagctattgaataaat

SEQ ID NO: 149749 - DNA, 389 bp, Homo sapiens
ggggactctggggctggcagggctgatgctttgggcagccgcagcagtgacagctgaattggacgtgtcctggggaaacggggagtgccgggcccaaggggagcaggtgtgtctggagaggtggtcagtttcaagtagagagagaaggaaaccacacagaaggccagctgaaaaagagacgttgcagggaactgccagagctggggacgtaaaatgttgctgctgcttgagagggtggagggcaagctctgcggaggttttcttttggaagggaatggggcggtggctggattctaccctggcatgtgagtatcatgccgagcctctcttcctggtcagtgtggaaggacctcggagcagctggacccagctaatgtgatctgcagaac

SEQ ID NO: 149750 - DNA, 474 bp, Homo sapiens
tcttccatctgtccgtccacccatccatccatccaacaattgagacagggtcttgttctgtcatccaggctggagtgcagtggcagtcatagctcactgcagtctccaactcctgagctcaagtgatcctcccaccttagcttgtggaactacagaaaggcacacagccaccatgcctggctaattaaaaacaattttttttttttgtagagacggggcctttctatgtttcccatgctggtctcaaactcctggcctcaagcaatcctctcaccttaatctcccaaaatgctgggattacaggtgtgagccaccaggcctggcctgtaacttgttactttaaacctaagacactaaaaaggatactttttatttagtacatatttttctatcctacttttcaacaaacagaactacagaaatgccatgtagactatattggcattatataaacaattaaattttaaaattaaa

SEQ ID NO: 149751 - DNA, 402 bp, Homo sapiens
ggctagctttttaaagcctcacaagacaactttcaaacctgattagtatgtatgctgtaaaatcagatacattatatttagcttgaagtgcagagcatcgtgggtgcaaagaaagaaagatagggggagggattaaaaaaaaaagaacatctgtaaagcctttcagagggatctgcacagcatatggcagagtaagagtttgctcaagttctctttatgtaattaactgactatgtgtcacctccccatcgtggagctccgacgtcgctcagctatgggatgtgatgactccgtaccagggaggggctcatgcttttctgtgatgacactgaagagctcagcacttccatagacagggtcttccctgagttaaagatcttaactcctagcttgcatgctttc

SEQ ID NO: 149752 - DNA, 541 bp, Homo sapiens
agagagtgagagagaacacacatgtgagagagagagtgagagagagaataaaaagtcttttcagtcttcatcaaccaccatctgactggcgtgaatttcaacacagtttataagggaataggcattaagagtttggaggatagaaccatccttgaaacagtacataagtaaaaagctcatatgattctatagagtcttctgaactgtctttgctcactggagttgtacctaacagtgacctcgaggctgttccacaggtcccaccacagacatcctgatactcagacaaaaaaagctggctatagactgctgcattagcttttctcactagtggaagttcttccactgccatttatgccgtttattagtggaaagtaattttttaaaagagccctttcttttaaagtgtattgaagcggtataaaagtatggaatcatgtcctttgcaacaacatggatgtagctggaggctattatcctaagtaaattaatgcagaaacagaaagccaaagattgcctgttctcacttataagtgagagc

SEQ ID NO: 149753 - DNA, 371 bp, Homo sapiens
atattaaagtgaaatattcaggtcctcagagtattagaagaaagtgaagacaagagacttcgaaagacgcgaaagaagatatgtgcaaaagataatagacaattgacttaaatttggaatatatacataacactcccacatactttttaaataaaattcatctggcaaaaaaaatgcatgaaaatgtgtttcacctctttaatatcaagatatgcaaaataataacataataacataacactataaacactaaagaatttcaagttttaaaagtaagaaaataccaatgtgttagattaaattattagttccaatactttatttctctataacaaaattatgtatgcatatccttgttgtggtcccctggt

SEQ ID NO: 149754 - DNA, 207 bp, Homo sapiens
tctaaaactgtggcatgcattagagatgtgactctagataagggagaggtttctttggaaataaatcgtgtgtcttaattatgtagaatgtctaaagacaagttaagagtaatgttgagggaaaatgatgattgtttaataaggaaagagaaagtaagagagaacctaattttttttttttttttttttgagacagagtctcactct

SEQ ID NO: 149755 - DNA, 146 bp, Homo sapiens
cctataggggggagggggcttccgctgactaaaaatatatttcccctcctcccaacttccgcccagaggttgagaagaaactgggtgaaattatgaattcaaggaacagtgacaacgaggaacagccacgtggctgacaaagtgtg

SEQ ID NO: 149756 - DNA, 500 bp, Homo sapiens
ggaagagccaccacgctggcctgtttagacttttctatcttccacgtgttaaactgtctatttttctcttattaaccacaagtttgggattcttcagaggccaaactactgttctcccaggctttgagaaaaaacttttcgtgtcatttagctacatagttttgctgaacttctccttcaacaacaggaaagcatatgttggtagctgggcaagccctactctgagcataatcttaagggactggcaagaattccctggagaaccccgagaacttgctgaccatgctggagaattccccggagaaccccgagaacttgctgaccaagctggaggattccccggagaaccccgagaacttgctgaccatgctggaggattccccggagaaccccgagaacttgctgaccaagctggaggattccccggagaaccccgagaacttgctgaccatgctggaggattccccggagaaccccgagaacttgctgaccaagctgga

SEQ ID NO: 149757 - DNA, 404 bp, Homo sapiens
acgagtgtgggcctcccctaagctcatctcacgagtgtgcgcctcccccaagctcatctcactagtgtgcccctcccccaagctcatctcacaagtgagtgtgctgctcccctaagctcatctcacaagtgagtgtgctgctcccgtaagctcatctcacaagtgtgccactcccccaagctcatctcatgagtgtgccactcccctaagctcatctcacgagtgtgcttcttcccctaagctcatctcagaagtgtgccccttccccgaagcttatctcacgagtgcgcccttcccaagctcatgagtgtgcccctccacttaagctcatgtcacaagtgagtgtgcagcttccctaagttcatctcacaagcgagtgtgcagctccccctcagcttatctca

SEQ ID NO: 149758 - DNA, 195 bp, Homo sapiens
atcactctatctccagcctagagcagaggcaggcaataaagtgggctcaaagaattgttatcagatgaactaatggtggctcgtgcctataatcccagcactttgggaggccgaggcaggtggatcatctgagttcaggagttcgagaccagcctggccaacatggtaaaaccctgtctctcctaaaaatgaaag

SEQ ID NO: 149759 - DNA, 253 bp, Homo sapiens
ctagacgtggaggaggactgggtggctcccgttacctaggcccggaggcaggcagaggtgagtggggaagaggtcagtgggggcggtgagttatgtccagtttggggtgactatgaataaagccttcatagaatgaggagtctgtcttattaagctttcttttaagaaaagaaattcaaataaaacatttgggaattggttgatattcagccagaagaatttatcgtggctcccgtattaagatgatggcata

SEQ ID NO: 149760 - DNA, 424 bp, Homo sapiens
tgagaaagcacaccctgaacaaatgattgaataacctttttgggcctggtatatttcttgatgctttatatatatttgtttacttttctgcacaacagtcttgcaggatactactattattcccattttatgaatggggaaagttatttgctggccaggcacggcggctcgcgcctgtagtcccagcactttgggaggccaaggcaggtgaatcacgatggtcttgaactccggagctcaagcgatctgcccacctcccgaaatgttgggactagaggtgtgagccaccacgccaggccaatttgaactatatttgaaaaagagggttccattgtttaaaaataagtcttggaaactatagtattgtagctgttctctaacagcaccaattatgacaggaaccaggaactatgaagtggggaca

SEQ ID NO: 149761 - DNA, 258 bp, Homo sapiens
ttgagacagtctcgctctgtggtccagctggaatgcagtggcgggagctcggctcacttcaacctccacctcccgagttcaagcaaatctcctgcctcagcctcatgagtagctgggattacaggcatccaccaccacagacggctaattttttctttgtatacttttatttaattcggcttaggttacttgtttattagtagtagttttgcatctatgggattgttgtataaaataaatggtttaaatatgtaggat

SEQ ID NO: 149762 - DNA, 540 bp, Homo sapiens
  misc_feature (337)..(337): n is a, c, g, or t
  misc_feature (498)..(498): n is a, c, g, or t
attctctagacctcaccctatgttatttttcaacaaggatttaaatttactagctgacattttcttgtattttcaatgaattactcatttattgtcagtctgacaaacttgtcttgctctccattgtatccccagaatctggaatattatctgacacacaacagggatccaaacaacacttggcaaataaattaataaagtaataaggcataatgagtcatttctacgatctctcgtctccgcacacaaagagaaaaacccacaggccctgtagggctggaccctacactgtctcaaaaaacaacacaaaacaaaaaataaagcaattatatttatngtaatttatccagcatctaattggactgtaatgggacagtctggtaacagcatctaataatactggaagcaaaggtccttccctccctttttcattttctacttaactatgtgccctgaatggcaactgtgacagcataggagagacgggcagctccaggnccactccttaacaggtacatcctaagcattcaccctcatctc

SEQ ID NO: 149763 - DNA, 236 bp, Homo sapiens
tcttaggtgacttttaacaaacattaagcaagggtgagctcaaagcacagaatttaaagtggcaagtaagtgcttcattactggaatataagttatctgtgattacaaataaactgtacagagttataaaaattgcattatgtttctagacacaagaatttgagatctatgttatttaaaatagtggttacttttaaaactgggtagtataaaaaatccttactaatgttcttagt

SEQ ID NO: 149764 - DNA, 594 bp, Homo sapiens
gctgagcctcagtttcccaacctgtcaaatactgggctaaatcagaggtatgaaaacaattgccccacaggcatgttttgtctgcactgtaaagcacaacaaaactttgaattaggtgcaacaataatcagaaagttttacataaaaatctagagttctggctacctttgaaaaaggtggggaagatccaggaaccctgagctcacattatccataggacgatctcacagagctgagtggcagccatctcctttggttggcacctagtcagttttacaattcactgcagaccccactgctctctactgtcttgcccagatgtttcaacccatttgtgttacccacgtggcccctggggatatatgaaactgactcctgggctgagtgttccaacggtcacctctgctcctactgtccatgacttgtctgatattcacatgccaacagatgctgcctgccatcccctggggcagtcagtggagggctgaccagcttgagggtgggtcctgcagggctgccttccactgtactgctaagggagaggccctgcctctgccaggattccaatcccccagtcagaacaaagatgacagc

SEQ ID NO: 149765 - DNA, 400 bp, Homo sapiens
gacatcctgctaatgctgtactaaatggctgtcactaaatggtgtactaaatggctgtactaaatggtgtactaaatggctgtactaaatggtgttactaaatggctgttacctaaatggctattatctaaatggctgctggatttggcgatcacgagttgccatttaggacctaaatggctgtcagaaccaaacaggtttctgattctgcagaaacactaaaagttcatcccacagggcaaacatctcaatagaaacgttcaccttcatagctattgctcctcatcaggcggcaactccttgtttctgatcagtttccatgttaccacacaataaagagaataatctagtatttaccacattaagctagttataatcccattcttattacagcactaaa

SEQ ID NO: 149766 - DNA, 172 bp, Homo sapiens
cacccgcacaggtggtggtcctctccacgtctaagtgccccacgctgtcctaaggtgtcctgtgtgcattggggcgggcccaccatcaggccctttaaaggaaaggaggaacgctgttattagtccctgatcctggctaattacacatcccagaaccaaagctcaaggaagc

SEQ ID NO: 149767 - DNA, 373 bp, Homo sapiens
agcctgggcaacaagagcgaaactccatctcaaaaaaaacaaaaacaaaaacaaaaatactaggcatgcaaagaagcatgaacataagctcataatgaagtgaaaaattagtccatcaaaactgacccaggaatggcacaatgacaatcagtagacaaggacattaaagcaggtattatgactgtattccatatgttcagaaagctagagagaaaaacatggaagatacaaaacaccaagttgaacctctagagatgaaaactgcaatatctgatgaaaaacgctgaatgggattaacagcagattggacatctcagaaaaagatatgaaagaattggaagacagcaacttaaacaggaaaaagactgaagaa

SEQ ID NO: 149768 - DNA, 296 bp, Homo sapiens
agcatggatactgagtaggcaaggtagcagaggctgccacaggataaagaacatttaaagtttttgctaagttctacaagtcaaaaaccatcaacttaaacctcaaactgtctactaacttcagtttttttcccttcaagaaatagttctaagttcccgatcgtttgccatcaaacttactcttcacaattgacttatgttacccatatttccccaaaaggattgatcacacactctattataaaaaaactactttagcaacaacctcaaagagcatttgaaaagaggacataaag

SEQ ID NO: 149769 - DNA, 369 bp, Homo sapiens
atggatgaatgtgaatttttgtttttctgcatttaaggggatcaattttttcatgttgatgtgatgagttacattaacagacttctaacatgaaaccatccctcaattcctgacttcccacggctccgagcagctcacggcaagacgtgcagacgtgaggttttcggactaaacgcaggaggccccgacgtactcaggggaagacggcccccgtggctcatgaaaagccgccatcattggcaggaaatacaaacgccctggcgttcttaggaaaagctgcacagggaggtctgggacccaagacagacgactgagatcacaaacttcttcctcacgccttgggataagaagaacctggaaacttcccag

SEQ ID NO: 149770 - DNA, 616 bp, Homo sapiens
ctccctactgcctcctccaccctgtatgggggtgtgtgttcaggagaggagggtctccctttcccatttctgcagttggggcactcacagtatttagggtgtctcccgggtcctgcaggagcggtctatttccttcagagggtctatcctaatgcctttgaagatacattctcaagatgaaggtggtgatttgttcagataatctcacctgagaaagaattagagaagagagaaaaaatggttgattcttagataagtgtgtcccaggtcaaaactgttcacattttcttctacaatgtcatgtatttagaattgcaatcatttacatttctacttctgatgcttttgcctaacaagattattttaactaccttttcccttttcttctcatgatagtgaaaggatctctttaaaataattctccccgatttatcagagccttaactctctccatccagccttcttacatatcacaaataatactcacttgaatttataccctgaagtataaagcgttgagctcaacgctttatagttctaatacatcgtgttcatctgggatgtattagaagtacaagtagtagcttttcaaagctttaaatttgtagaactcatc

SEQ ID NO: 149771 - DNA, 202 bp, Homo sapiens
aaggtggggctggggcctagctggaagaacaactacacatttgctgtcaggggtccccttgctacctgtgcttccctcaaagccaggagttatcgtgtcttagggtaaaactgagcattgctggcagaaagcagttctctgggacagtagctgctttggggaactgcagaagagtctaaagagcaggtttcacaccagcacc

SEQ ID NO: 149772 - DNA, 563 bp, Homo sapiens
gtctcctttgcttttaggcaaagggaatgcttcttcagatttttttttttccccagaagttcaaaataacttgctcatagtcttcccaaaataattttcaaacattctaacaccaaagaaagatactcccaattgagctcagccatcagcctcctactattttttaatgtgctgtttaaccttgtgaatgtgagaatattttgaatgcactgggaaggaatactcaggaacaatatgtaatgtgctttctagttttgcacaaaggcattcattttgatttagtaacaacctcatacttacatagcatatccttctgcagaaatgcttcacagccatgactgcttgaattcttgtcatgttgcttgtaaatgagctcctgtttttagatggagaaatggaggcagagtctcacaattacatgtgagaatagcaagtagaaccttatgattacttctgagtcttttttttttttttttttttgagatggagtttcacttttgtcacccaggctggagtgcagtacagtggccagtggcatgatctcagcccactgcaacctccgc

SEQ ID NO: 149773 - DNA, 455 bp, Homo sapiens
tctccttttagttacccagattcattatctatattaacaaactgcccttccccaaacttacccccacttcctgtactctgcttctcagtaaatgaagatctacccatctggaaacttggaagtcttcctcccttgacttctcaccattaccccttgattagattattacagtaggctcttaactggctcactgcttccatccatgcactcctaggcactcttctgtaatcaatagtatgttgctaaatatttaataaatgttctctagggagggggaaaagccctgatttgtagtgtttccccaccttctatgatgtaaatactactaccaagtctagtttcaagctatcaatatgacatcactgattatggagttggaaagagatgtgcagtttcacactattttagtatttccaccatacagatacaacagacaaccttaagagtaaaggtaa

SEQ ID NO: 149774 - DNA, 146 bp, Homo sapiens
gcgccactgcactccatcctgggtgacagagcgagactccatctcaaaaaaaagttcagatttctgggcttcactctcaaagattttgcataagtaaattggggtggagcctggaagtgttttctaaaagcactccatgtggcggc

SEQ ID NO: 149775 - DNA, 211 bp, Homo sapiens
gggatacacaatcgaactgtcagttactgcttggtcagccctgagaacccattccctgggctcatctgatgattctgcaatagttaaaactcaactactaggcatggtctaagagaaccaaatttcaggaagcattttcttcaagcttccttggattatcagcctgttataaaactcatgtggaaagaaacttttatctgtctctctatcc

SEQ ID NO: 149776 - DNA, 356 bp, Homo sapiens
tcatttgatattttcacacctattgcaaaggagccattaacaacttggctttatgaataaaaggaaatgaatgtatcagtcagaatgcattcgtttgtgtcttgggaacaaacaatttcaaacttcagtggcctgactgtgaaagtttttatgtgttggtcataccacctgcctctccctgaatggcaggggccctggccattctggtgttcggaaatctggactgacagaagaatcacctttctgtgcttccattaatgctttcatagtgagaaacaaacttggctatcataactttctcctagcagtgaaattctgcttctatttctggtcaaattaagtcccattgctatctc

SEQ ID NO: 149777 - DNA, 320 bp, Homo sapiens
aatgatggcctgagagggaagtggattctgttgacaccagcagaatgtgtggaattgggattttgaaagtgtatttacccagtggcatgtggtcccaagcgggatctgccctctatgagctccagactggactcgtcctgcccctgtggtctgtcccttcctaggttcccacggttctctctttccccacaatgtagctttgctttggactagtttttgggacaagatgttgcttgtgaggtgggtctgactgcaggagccaagcagcaccaccccaacaaatcctccaatcagtccacccaccatgcccaacaccaatc

SEQ ID NO: 149778 - DNA, 278 bp, Homo sapiens
acagccaacagggggagcagtgcgagcgtgaaggcagacagtggcctggcccagtctgatgggagagacccaccgaccctgtggggctggtccctacatctggcgctctgacgtggggctctccctcgctgtgtgaagttgcaccctgagtgcgggatcagcggaggagttcaacgagagattcctgaggattgcagtctataaacttggtgcaggcggctgaccccgcagctcaacaagatcaagaggctgataatcaagcccctcagcccgaaact

SEQ ID NO: 149779 - DNA, 270 bp, Homo sapiens
aaaaaatgagataaactgagggttacgggagacaagatctgaggcaggaggaagactactggaaggaagcaggagtgaggcactgggcaaggggccctgggcggaggcagttctcaggagcagcaggtggtaatcgagagaagggctgacctcggaggcctacacaatttagcagaaggccagactgcccccagggagctcagggtgacagtgtcgtgcaggccctcagaagcactggagggggtaggggtggctggcattagggttaac

SEQ ID NO: 149780 - DNA, 380 bp, Homo sapiens
cacccacccgaacctgcaccaatgggggagctcagttccccagaggaaaactacaatgcaattgccagcagtgggaggggctgttgggctggccatccttctgtgggtggtcacttttccttatggagtctcacctgttaactgagcatctcagtgggccaggcacccagcaggcaagagtatcctctagttgtcagagtccgggtggcagaaaaccaacctaaactcacttaagctcaccgtggagtgtattggttcatttggccagaaagtcccaaagtagggccagctccagggtttcctgctgtgtgccacgattctccagctcttgcctggccttcaacctgttgactctttccctccccctgaattaggcttct

SEQ ID NO: 149781 - DNA, 400 bp, Homo sapiens
tcggccctggttcagtcggctcatagagacagggtttcattgtgttagccaggatggtctcgatctcctgacctcgtgatccaccctcctcggcctcccaaagtgctgggattacgggcgtgagccactgcgcctagcctgtataactcttaatatctgctatcaggttataagcaccttgagacagaaaacttgtttctccccggcaatgtctttcataaattaacccctcaatgaaaccagaagccaagaaacaagaaattatactaagggtttcttcatagatgtttggggctgcaaaagatactaaaatatccgtttaataagtccaatcatgcaactctcattttctctcctgcccctgcccattttaaaaataaacattcctaggcccaggaaa

SEQ ID NO: 149782 - DNA, 300 bp, Homo sapiens
gtgagcatgaatgtgcctgagcccacttgctcgctgtcccttccattttggaaacagaaaattggccaacctttgccctagccagcctcagcattttggaggcagtttggttttgagctaagatgggtgcgtctgcagtcccaggccacgttcctgtcagactccgcttctgagtgacagctggcaagccctgacttgggggccacgctgcggagaacaaaacatgtgcagacagtctagggcaccaaggtggcctcattcatgccccctggcattgggagctcctccctcatacacaca

SEQ ID NO: 149783 - DNA, 412 bp, Homo sapiens
gccaaattcatctcccttttctgtgaacttcatcctggtttggactcagaggaatccctgaggcttcagaccagttcctgggagttcttgggagtgctggggagtccactgcctcctggtgccttcccaggacccagataccccaggagtccccacactgtcgttccagcccaaatctggaggcagctcctcaaagcactggtatggttttgtacccacttttccccaagagccttgtgcgatcccatatctccaggtgactctaaggcttctaggagccattcttgggctgagatctagctcgtctcccatttgatcctgtttctcctcataactggcccctaatcctctagttcttaatcacagagtccttgaggaaagaaacagaatcctgcctgtgcagagatttaca

SEQ ID NO: 149784 - DNA, 164 bp, Homo sapiens
cttcaacagcaacacctttattactagcaaaaccctgcagaggaggaaaccagcttactgccagcaccaactgcctctcacaggctggggtgatcatgggactgggaaggaggggtctgggctgtagagcttgctgcccggcaggatatggcaaggatgttcct

SEQ ID NO: 149785 - DNA, 559 bp, Homo sapiens
tgagcatggaatgtttgtgtcatctctgatttctttgagtagtattttgtaattcttgttatagagatctttcacctctctggttagctgtattcctgtattttattctttttgtggctattgtgaatgggattgtgttcttgattgggctcttggcttgattgttgttggtatataggaatgttagttatttttgcgcattgattttgtgtcttgggacttggctgaagttgtttatcagcttaaggagatttgggctgagactatggggttttctagatacagcgtcatgtctgcacacagggataggttgacttcctctcttcatatttgaatgccttttatttcttgcctgattgctctggccaggacttaagtactatgttgaataggagtgatgagatagggcatccttgcctggttccggttttcaagaagagtgcttctaccttttgcccattcagtatgatgttggctgtgggtttgttatagcttatccctttattatattcgtgtttctgttggaaacagatgcatcatttcaacttttagcatcttt

SEQ ID NO: 149786 - DNA, 689 bp, Homo sapiens
ctggagaaaaagaggccatgaatctgaccttggtggcctcagcctggggtggggtggcgaagcccaggggtctgagtgtggactcggagccactggtcctactcacatcctggtcccactgcttcctggctgggtgaccgtgagcaaatcagctcacctccctgtgcatcagtttcccccctgtaaaatgggggtggcaccgcagacctcatggggatgtggtgagagtaaaccagataacacaggcacaagatccagcatggcccttccaatgccagctcttctttcctcctgctcagcccatcccccagcaaactgcgagctctttgtggaggggggctgtctgcttggtgtctgtgtccccagcaccgggctcagggccagcacccaggctctattgtgtgcttgggggtgggagacacagaagtgaacaaaacagacagcaatctctccctgccctcctggagctggcactccagtggtggtcacaatcaacaacatttaaacaccgatgaagtgagctgtggagaaacctgagaaacgggcttgtgtcgagggcggtaaatgttcagtcaggtggtcggggaaggccttgtcaagtgacatttgggcaaagccatgaaggaggtagggaagaggccagaggaacggtctcagatgcaaaggcccagaggcaggaaggggcaggc

SEQ ID NO: 149787 - DNA, 537 bp, Homo sapiens
gagatgttgcacttaagagaagaaaaaccaccaaagaaacaaataaagttgatctaacatacaaactaaacaaaactagctaactttcctttgaagaataacaaaagtattataatttgtgaataatcacatatacactaaaactaaggaatatctgaaagggaacaaaatgaatcactcagtaaatatataaatctaaccagacaatgctggtgtccaaacaggtgctcaataaatatgagacgaatggatggacagataaaacttaagagatattgcctatagttcttacttctaatggcactttaaaaggatcggtctatatctgttgcattttcagtgagatgtattataatgtatgcttattgttaatttttcgtaaaaagaattgtttatataattttcatgttttctgaacttttgccctgaagtattcctaatagagaaagagaacaaacacatatataacaccattaccctgcctcattccatggaggggcataggggactgtcaggcttcagtatgcatatcgagaa

SEQ ID NO: 149788 - DNA, 550 bp, Homo sapiens
tggatgtaaagaactattaggttaatattctcacacatgaggattttcataccagaagatgccccatgccccacaccttggggatgctgatttagtaggcctgcaccttggggaggctattttagtacacctgctgggtctaaggtggagcacggacatgtgccttgtgaaaacccaccacttgctggaaaacacagtgctctggatgccgacagatcctgaaaacttgcttcagatcatccactctgggaagataaattgggcctgggctgcgtgctgcgcgagctggctgaaccagacacttggaaacatggtatttgaggcaaattagacataaaaagtaaggtctctctctttcgaagatggaatgtcaggattgtgctgcagtagggaggtaactcctcacactccctgtttggtacatttggggatatctgtgctgataacggggctaatgcgctcagcaaaatgggcctttcaggagctgctgagctgaaaagacaatcagaagcatcctcattccgatgtcacgcaggttcccaacagctgt

SEQ ID NO: 149789 - DNA, 181 bp, Homo sapiens
ctgggtcagatagggttaaaaccattcatttaaccagctccccgctgtaatagtaggagattctgaaaagcttagagtcaacagtctcggactcatgcagactccagggctgaaagcttttcatccttgagatgtcagttgggactgtggaaaaaacattagactttagttgtttcttttt

SEQ ID NO: 149790 - DNA, 480 bp, Homo sapiens
aaatcttaaattcccattcatttggaaacttaaaaactatttctaaataatttataggccataaacaaaatcaaaatggaaatttaaaaatccttggaattgataaaatgaaatatatcacaaaacttacgagatgtagggaaagtggggcttcaagggaaatctatagcactaatgcttatattagaaaagaaggaagcctaaaaattaatgattaaacattccatctaagaagttagagccgggtacagtggctcacacctgtaatcccagcactttggaaggccaaggccagaggattacttaagcccaagagtttgagaccagcctgggcaacatggtgaaaccccatctgtacaaaaaatacaaaaattaactgggcatgagggcatttgcctgtggtcctagctacttaggaggctgaggtcagattacctgagcccagggaagttgtgagccatgctttcaacactgtactcc

SEQ ID NO: 149791 - DNA, 187 bp, Homo sapiens
cttgttgtgaaatgtgcattgtagtttgtcatgtgtaaaatgggagggctttgtggtttcttacgatctaagtgtaagagcaagctgttacttctccctgtataggcaatagaactcacttttgtttagcatttgccaaaagtattggatttctttggaatctttactttgctacttttagcgttga

SEQ ID NO: 149792 - DNA, 283 bp, Homo sapiens
aatggcgggaaccctcctgaaatccagatgtcaggcgagagccaaacttacaagcaggccttgtaaatgacagcagtcaaacctgcttcgttaactcctctgcacactcgcccacaccctggcttccgtccttgtcctgtgacattttcctgttgtcccctcctacccaaagctgtagacacacctggaccttgtccatcaacctcaactgcaaccacctccaaatcacagacttagacaccccgccctttgaccttccagctgtcttgctcaagaaatagct

SEQ ID NO: 149793 - DNA, 283 bp, Homo sapiens
ccgggcccggggcccggggaggcactcaccctgcttcatggatggagtggaggacgggccttgtaaatgacagcagtcaaacctgcttcgttaactcctctgcacactcgcccacaccctggcttccgtccttgtcctgtgacattttcctgttgtcccctcctacccaaagctgtagacacacctggaccttgtccatcaacctcaactgcaaccacctccaaatcacagacttagacaccccgccctttgaccttccagctgtcttgctcaagaaatagct

SEQ ID NO: 149794 - DNA, 327 bp, Homo sapiens
ccatcatttggtgttctcagtgttttaaattttagccattctaataaaggttgtgttagtctttaatttttaaatttgtaattccccagtgacaaaatatgcatgttttcatatgtttatatgccatctatatattttatataatcatgtcttatgcagcaaagacaattttatttcttccttctaaatcgatatactttttatttcctctgtcttgttgcttatctaggactttaaggatgttgttgaatagtagtggtgagagaagacattcttaccctgtttctggtcttgtgtagaaagcatctagtttctcactgttaagta

SEQ ID NO: 149795 - DNA, 371 bp, Homo sapiens
ttcaccctcaaaagtgtcccagtctggatgataaattgattcattaagcctaagagtcccagaagcaggcctaacgtaccacagaatctcagaaaatttcaggagttgatggcaccatgcctcttaaaatcagggtgaacagaagacctggttgagagtatgtctgagtagcaatcaggtcccctgagccctcttctactactctctgcatccaggtaactgcccctccccaaccagcagaagcctggagtgtttaccctttggagggtcctaccagagagactctggataggtagacattagatagagacacagatgagagtgcgatggtaaaaacaggaggataagtgaaagtctacacactgaatggt

SEQ ID NO: 149796 - DNA, 349 bp, Homo sapiens
tgatcaccccttgctgacaagagccggtgtgaacagcactgcagcccagatgtgctccggacagggtgctgaagtcacttgagaccacagtgtcagcgtggttattgctgtgatactttctcttctgcagggggatggagaaggaaggaaaaggagcaggcaaactttcagctttgcccttctatgacatataccactcacgacatgaatgatcagaactgtcatgacctagattcctgataaacacaggcaggaaatgggaaattcgtgagaatgtcaattcccactttaatttcaccaaagctgcctgggagggggtgggaggaattaattctctgagctgcatgtc

SEQ ID NO: 149797 - DNA, 405 bp, Homo sapiens
cggctccctgaattctctcctcctgcaagtcctgcagctcccgaccttgtctctggacacagtacctctgaggcccttaagaagatggaatgaactcagtgttgaaggtgttgatgctgttattacgtattaatgcctcacctgcacaggccatgcgtgttctcaggcaggagctccctggagcttcacacggacagtctatagagaacgttcatcaccacctgacccttgagaagactaagactcagagacgggaggtaacttgctcaaccccctgtccctgcctcgggaaaggggcagtggctgtgggggttggggttggatcctgcagccaagggtcatcgatatcggttgaggactttgtcctgtggcagcagtgagtgttgtgggggtatcatacacatc

SEQ ID NO: 149798 - DNA, 780 bp, Homo sapiens
ctgagtttgattttctcaattatttaatgatagtttagcaaacatatagctcttcttttgtgtaagtttgtgattctcatgaaggagcactctgaagatactattgagcctcccaggttctctacaattcagctatccaaaggctctgtagacccattcctcaggacactgtcacactgttttttttgtattaagattcatctcaaatccatttgtaattgaatttcattcggatcagagcctggaaggctcttcctcatgacttcataaatctccaggcctcgctatactctcactatactcaatttctacaaatgctgagcagtcacactgagtcagataaatgacttcagtaggtctctggtttatatccacttcaaagcagttaaatctttctcgtacccagtgcctttcccagactctggcagctcccattgatttcctatgttcatctgcccaatgctcaacagagacccaagcaaatatgaactctatgtgggcactcctttctctatgctccattggtcatccagtttttgtctagctccattttccttacctctagtccttacttctttatcaagtgtatgtggtttttcacgtaaattcagttttggaaggagaatatttatttagagttccttgttagtgaggacatatttgtggttttccttggtctgagccgagtctgaccctttgggaagctttctacaaagagtgaaagtcttaggatgaccctcctttgcccacttggagtatctctacataaaggattcctca

SEQ ID NO: 149799 - DNA, 316 bp, Homo sapiens
aattacgcacagtcaaatgacagacatttcatagccaggtgagttttcagaaaaattaaattagaaaacacatgaagaaatcccttgcatattcgaaaggtggcattagcattttttctttcaaattaatgccatctccatttccctcagatattttccatgtgaatgagtatttacatcttaagctactgttttttaatttataaaagaagaaaaccaaagtagtattgcatgtggagagaaactaaattggtaaaccaataaataccaactaaaataaaaaagaaatggtttacatccattaccttggtaaaaa

SEQ ID NO: 149800 - DNA, 335 bp, Homo sapiens
caacatggtgaagaaaccctgtctctactaaaaatacaaaaattagccgggtgtcatggtaaacaactgtagtcccagctactcaggaggctgagacaggagaatcgcttgaactcaggaggcaggggttgcagcgagctgagattgtgccactgcactccagcctgggcgacagagcaagactcggtcttaaaaaaaaaaccaccatcacccagttcagcaagtgtctatgaagcaaacacaagccagtttggggccctgcttacctttcttcatttttggcctctgagtatttcttcataacttgctagctcactaacatatttttaatggtt

SEQ ID NO: 149801 - DNA, 231 bp, Homo sapiens
gcacttcttcatggcaacaaatagggtgtatttcaggattgctggagtgtgcagtacagtagggaggaggaactggagagaagtctgaagagagagggagggctacctcactgatttcacataccacactacaaagtagaggctctatccagtaggctctatccagtagggcttccatgtcttgactggctgtaccagaattatttggattgcttattaaaaatacagatt

SEQ ID NO: 149802 - DNA, 284 bp, Homo sapiens
gagatcactcatgtccagttacagaaaggctgaaattcatttggagtttgaagagtgctgtggagccacctccatccaaggggaggtgtttccctgtacccgagccagttgagaggtactttaaggaaacgcatcagatagcttgacaggtgaccctagggtttgtggagcttaagaactagtatgagatgctaaaattagaccagcccaaggtagaggagggaaggagaagtgtgtgtgtgtgtgtgtgtgtgtgtgtgtgtgtgtgtgtgtgtaagagaatg

SEQ ID NO: 149803 - DNA, 283 bp, Homo sapiens
gcaccatattttcgggtatgagttctgagccccacaatggccataagcacttaaccacagacctagtgacgtatgtataaaatatacactagattccaaagacttagtatacaaaagaacataaaatatcttatttgtaattgtttaaaactgattacatgttaaaatgataatattttaaatataatgggttaggttggtaaaataaaatatattattaaagttaattttaactgtttctctttaccttttttaatgcagctataattagaaaaccacaaat

SEQ ID NO: 149804 - DNA, 378 bp, Homo sapiens
tcaggtgcatactccttttgtgtgatgttctgctttaacttatcttttcatccaacatcttctagtctagatcccatcagcgaggaaggcttctaatatgactagcccagaagttacactgcactcgacagcagtgaggactggctattcccaagttctgctctaaactacatgccttgctaagctgctgacacaaagtctagagtatttgagttataatttgtggataattatcatagaagtatcaaacccaagaaatgcccaaatttctgaggctttagcaaagcacttcctgtccacttgctcatttgcagcatctacttgaaagccagaatgatcagtcatcaaaatattgtgtttttaacacaatataaaaat

SEQ ID NO: 149805 - DNA, 394 bp, Homo sapiens
tctttaagtttcttaccgggatcattccattctctaaatcatcttcatttcttctacatctttagggttgcctacatctttagggttaggaaactcaaacagctacctgaggtagaaacttccagatttgctttacagacagtagctaagtttcctgcaaaaagaagaggaaagtttagtgttcctgttttaagctgtgttaattgatggctacaactggtatagtgtgagatagaagactacatacagtctagtctgttccaggctcaaaaatatgtgtggataaacacaaattctcctgaagatccaaaagaaggatgaggggagaagcctacaggaagagaatgagtatttaggtttcatcttataccaactgcctgtgtgcgtttcggca

SEQ ID NO: 149806 - DNA, 141 bp, Homo sapiens
atccaggacctgagcagaaggcacgacgtcctttctgaccaaacctcagaagtcacactgaggctctcaccttctccttcaggttacaccatgtgagagtcaatcacgtggggatgtgagctccaggacacaggggagagg

SEQ ID NO: 149807 - DNA, 186 bp, Homo sapiens
aatgtgcattctgctatcgttggatgaagcagtctacagatgtaaattattcccagctgactgatgtgatggtgctgttaaactcaactgcatcctgctggatctgtccatttacgatagagggtgctggatctccaactgcagacagtgaactcatctatttccccttgtagttctatcagtttt

SEQ ID NO: 149808 - DNA, 248 bp, Homo sapiens
aggagcgcctctgcctggccaccccgtctgggaagtgaggagcgcctctgcctggccaccccgtctgggatgtgaggagcgcctctgcccggctgcccatcgtctgggatgtgaggagcgcctctgcccggccgccccgtctgggaagtgaggagcgcctctgcctggctgctgtgcaatcttccaagtgtgaagtgacagcctttctgcaggtgtacccaacagctccgaagagacagtgaccatcg

SEQ ID NO: 149809 - DNA, 442 bp, Homo sapiens
tgtctctagaactctggcttgtcatcagtagggcttccctccaccaccacccccaatctcccacattctcaatgtcgagatgaagttttccctcaaatgattaactgcacatggtaagagtatgtcatccagtggtgacagagctcatactgaacagagctactgtccatcttcaggtttcagtctagaaacctctgagactagcacttgcagttgcatttattaatactatgcctcattccaaaagacgtccaaagcagtttgcagagaaacagactacaaaaacagtgataataccagggcaaaagagaatagaaaacgtgaagctaaaggtatgataaagaaaatcatggactttaattcatgaaataaaattcatatgtcctatatagatgagattgatctagatttgacacagcttcctagcagccaaagaaaagtg

SEQ ID NO: 149810 - DNA, 234 bp, Homo sapiens
aatgaccttggacaaatctcttacccttgctgtactttttatttattgatgtaaaaagggttggacagggactgggggatagtggttatcctgataccaagactatattacctagatgttttatcaaaatactggtccttgttacttcaccaagttgttttattaaatgacagggtttagaaatgtactttaatctgtaaacagctacacagatacatacaaactgaatatttt

SEQ ID NO: 149811 - DNA, 451 bp, Homo sapiens
tgctatgctggcctgggctaatctcaaactcctgggctcaagcgatctgcctgcttcagcctcccaaagtgctgggattacagccatgcaccacctcgagttcaaaattcttcattattttccattactcttggaatgaaagtcaaactttttacccagggccagagccggtcccacctaccttggtaaccacacctcccgtgctctctgcctccctcactaagctccagacacactggcttttcagttcctcaaactgcccaggcattttcctcgtcaggtgttctccctagagcctgacttgtcccgaaagctcatcttgtctcagtctttctgtatgagtggctccttttctttcttcagatctgggcacaaatgtcacttcccagaggggctgccctatcactcgcacatggttttgtttccttcgtagctttcagcattggaggtg

SEQ ID NO: 149812 - DNA, 708 bp, Homo sapiens
ctttgtggatttttttttctggaatatttttgatgcgagattagttaaatttacggatgtggaacccacagatacagagggctgactgtacatctttttcaatccccatgctcctttagtatgttattctcacatctattataacatttaccatacttatctgcctttaaataaattatgtaaataactctccttgtcctttagattttgagcttctcatcagaagccaccaattatttatttctccatacgcctcgtagactttacaccttgtagaaactcactaaatggaatgatgctttaggtacctgtgcaggcagagatttttatgttttattcactgatctatcccaagggcctgcttggcacataatagactttcattaagtatttgttgttgactgagttccttgttactgttccctttggaggagaaaaagaaacatgagttttagcagtcttcaatgtaccttgatgatgacaaaatagtttatccattagtgaacagtaagcagttcctgatgacttatatgcagaacatactagaatttctctgactgagattcagaacttcccttgcctggagcattgtttttgtagatacaatggttacactggtgaccctcacattttgagaggggtagtcttttggatctcctggaaattatggttcctttcaccagctaatttctagtggccagtagtcat

SEQ ID NO: 149813 - DNA, 395 bp, Homo sapiens
gcaggtaacagaactcagaacagtacctggcacatagtaagctctcagtataacagactgtgatgattattatcgtagtcatgcccatgaatggggtgaagatgtacccaggcttccttttggagttcaacattccatgcctctgttgcattttagcagcctctcccggcagcccgtggcattctcatcctgttccttcaacatcctccttcccacacacactgctcgctcgctcctctcctttgggtattcacaactgaatcttcactccctggtgacttggggacttgtcagaaacaccagctgagctccaatcaccagaggaaaagaggccaggagacaaagacagggaaggccagactcaccgttctccccagatcctgcctccagcccca

SEQ ID NO: 149814 - DNA, 777 bp, Homo sapiens
aaaaactagaaaaactgagtagtttttttttcattgtagaaattttatttagaaaatttttttttcctgtagaaagaactccagggctaggtggatgcaatatttaataaagaaatattaccaaatatttaataaagaaataatgccaatgttacatgaatatttttagagaattgggaagacataacactttccaacttgttttatatggtggtacctccatgatagtaaaaccatacaaggatattaaaagaaatgaaattacagactaatatactacataataattctaaacaaaaatgtttgcaaatataatccaacaatatactccaaagaaaaatacatcgtgactaagtgcagtaatttcaagaatgtatggtttaaaattagaaaaccaaacaatgaaattaaccacattaactgaataaaagaaaaaaatatggttatttcaatagctgtgggaaaagcacttgttcacatttgaaactatttgtaataataacaaactaggaatagaagagaactgatgtaaatatcttaatatatacacaaaaactactctcaacattataaataatcatgacatattaaacagtttcattctaacacgaggaacaaggtacacatgtccagctcaacactttattcatcattaaaataatactgtgcagtaaaattaacaaggaaaattttaaaaagaacacaaaagaaaactacaaatccttatccctgatcaacacagatgtaaaaatactcaacaaaattctagcaaactga

SEQ ID NO: 149815 - DNA, 299 bp, Homo sapiens
ctccagcaggggagtgcagagcacttgcacagtctgctaaaatgttacaaatcaaacacgcttagaatgtccccaggaagaccagcaaggcaggtagacacttgaaacaggccaaacagctgtcgcctgggccagagtgctgtggtgagatcctggctcactgcaacctccacctcccagactcaagcaatcctcccacttcagcctcctgagtagctgggactgtaggcacacaccaccgcacccagctaattttctgtatttttgtagagacgggattttgccatgttacccaggct

SEQ ID NO: 149816 - DNA, 230 bp, Homo sapiens
gagtaagagatcctaagaggattataagccaaaaagttcagttccttcctacgacttttgcttcagttgttcttgagaactacttcccaaacctgacacatggataactgccaagcacacaaaatcaaatccatttccacatcctctttgcagaaaaagataacccagtaagggaaaagttctgcttaactttctagaggtcttgcccactaggctaggaaacaaatgtg

SEQ ID NO: 149817 - DNA, 188 bp, Homo sapiens
attgatcaacatgggtatgtaggaggagaagcagtttgtgggattgtttgagagaatgggatatgattttatttgaagtcccaagcctggggtatgatgaatgtgggctttcgagtgagagttgggttcagtcctagttctactacctactagggatgtgatcttaggtaggtcacttctctctctgg

SEQ ID NO: 149818 - DNA, 573 bp, Homo sapiens
ttaaagatcatcagcaaaaacagaaaatggcatatgcataggatggcactgtggctttatcagtaatagcaaaagactagaaataacccaaaaggattatcaatggctataaagagatgagaaacatctctatacaccagtatgcagcaatctctagcatatattgttcagtgaataaaacaaggtacagaatagtatatgtagctgatatctgttctgtaacagcagtgtgtatgtgtgtatatacatatgaatgaatatatgtatttgcttaatctttacaaaatatgaaacagtgaaaggatagatttctctgaatatatcttgttcataatttgactttggagatgttttatatattcaaaaaacagcagcaaataaaacagaaaaaaatacaataaattgaacacaaacaacttagtctaattgtgtatcaaactggtgacgaaactgccaggggaaataataacaataattacaggccggacatagtggctcacacctgtaatcccagcactttgggaggccaaagtgggtggatcacttgagcccaggagtttgagaccatcctgg

SEQ ID NO: 149819 - DNA, 110 bp, Homo sapiens
atctttttgtataatccagtctctttgctaacacccactcttgagagctgaaacctcaaaattcattatgggtgaattcaacagccacttggaacctaatggacccccag

SEQ ID NO: 149820 - DNA, 394 bp, Homo sapiens
ccaatacacacgatctgtgaagtagaaccaaataacaacactcaataacaatactattaacagcaataataaaaatagcaacaactaatatgtcccagacactaatctaagtgatttgagtgtagtaacttattcaccacttacaacaattccatgaggaagaacattataatttctttcttctaaaggaggagaacataaaactggaaataatacttaactatgacatcagattctctcagctattcattgcaactataagataaagtacctaaaattgtcttcaaatacaatttactatgtaaatgctattactatttttttctaattccagtcaagttctccattcttttccttgcaaagccagagaacatgtcaacaacaaaaccagacc

SEQ ID NO: 149821 - DNA, 568 bp, Homo sapiens
acctgtgagaacagatttgtgttgtaagtcactaagttcgtggtcatctgttacagcagccataggaaactaacacgacagccctggaaagaggaaattatcgtgggcaccattttgcagaccagacctgggagagagcgtcacttgtctgtggggctgggctggcaggcatggtgcttgggctcaaagcctcaggccaggggctctgtttgccctttctctatggccctctctgtgcatctaggatggtgctctgctgactggccggtattcccctgcccttcccttgcgtcttcctgtcctttcacccagcacctctttactgagtgactgcgatgggggctgacatgctctgccaggccatgttatttttatgtgcctgtgtgtgtgtttggctctagggccagatcataatggcctgaatgtacccagcacttcttacatgctgcgctctgagagctttccctccccagtgccattcatccttgcaacactctcacaggacaggcgctgatacaatctgcattctagagatgtgggaactggcacagagaggacatgacatcag

SEQ ID NO: 149822 - DNA, 418 bp, Homo sapiens
acctgtgagaacagatttgtgttgtaagtcactaagttcgtggtcatctgttacagcagccataggaaactaacacgacagccctggaaagaggaaattatcgtgggcaccattttgcagaccagacctgggagagagcgtcacttgtctgtggggctgggctggcaggcatggtgcttgggctcaaagcctcaggccaggggctctgtttgccctttctctatggccctctctgtgcatctaggatggtgctctgctgactggccggtattcccctgcccttcccttgcgtcttcctgtcctttcagatatggtttaaagaactttgtcacattttaggcaatggctttacttcagtgcatggtagagggaatagctggtgtggaagtctgcatctttttatcatggtcatgtattg

SEQ ID NO: 149823 - DNA, 255 bp, Homo sapiens
caagacaaattctgacgggtgaagaagcaggaaatgagatcactggttgtagaaaaagcagtttgtccaggacattgctataggccattatccacaatcgcaattacaagtgaattctgaccataccctgatgtttgtttgatcagcacaatattgcaaatcctgacttggaatatctgatacgcagaatttaaattacatgctgacgccctgtccaccaaggggcggagaatggaatatctgactcttctattt

SEQ ID NO: 149824 - DNA, 509 bp, Homo sapiens
  misc_feature (469)..(469): n is a, c, g, or t
  misc_feature (471)..(471): n is a, c, g, or t
gagtttatgttatattatacttatattacaccagcattaggtaattttgcttgaacattcttttctaatgccctccaagcaagtatttacccgtgctttttgaattttagaaggattcgacatcaaacttcccagtttcagttgcttaatttcatcacataccagtttatctttttgaacattagtacacaaactgactcaagtatacttgcctccctcctcattttttattatttctcaaagagctattatttctcaaaagtgtttcttaaaatatacttgtaggttctcttttcctggagaaagagctctgaattcaaaagatctgtctttaagtcctgggtctgcttcttaactcatccaggtctttaggtaagtcaggtacagttgctgttttcattgtttattaagtggaggtagatcatcataaaggtcttcatcctcatcattgtcacattgagtatggctngnagcaaaaatcctactcgtattcaaaaggtagagcaaat

SEQ ID NO: 149825 - DNA, 337 bp, Homo sapiens
  misc_feature (297)..(297): n is a, c, g, or t
  misc_feature (299)..(299): n is a, c, g, or t
ttgttgtagattggatggtggtgtgtatggggtggggggtcggccgcatcattttttattatttctcaaagagctattatttctcaaaagtgtttcttaaaatatacttgtaggttctcttttcctggagaaagagctctgaattcaaaagatctgtctttaagtcctgggtctgcttcttaactcatccaggtctttaggtaagtcaggtacagttgctgttttcattgtttattaagtggaggtagatcatcataaaggtcttcatcctcatcattgtcacattgagtatggctngnagcaaaaatcctactcgtattcaaaaggtagagcaaat

SEQ ID NO: 149826 - DNA, 351 bp, Homo sapiens
  misc_feature (311)..(311): n is a, c, g, or t
  misc_feature (313)..(313): n is a, c, g, or t
attggtgcgttctctgatagtgtggtaatggatagtgaggtgagaggtttcggccgcatccgtcattttttattatttctcaaagagctattatttctcaaaagtgtttcttaaaatatacttgtaggttctcttttcctggagaaagagctctgaattcaaaagatctgtctttaagtcctgggtctgcttcttaactcatccaggtctttaggtaagtcaggtacagttgctgttttcattgtttattaagtggaggtagatcatcataaaggtcttcatcctcatcattgtcacattgagtatggctngnagcaaaaatcctactcgtattcaaaaggtagagcaaat

SEQ ID NO: 149827 - DNA, 758 bp, Homo sapiens
attaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagtcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctaatgactgttgtagcctacaacatatgttctagaacacctctgctcagctgtaatcttaaagatgactttgagtttttttttcaccatcggaataacctggatataaatgttgtgattagacaagtttatcatctcatggagaccacgcctactgacattcatccagacagcatgcttaatgttttcgttgcactgacaaaagggcagtatccagtatttaatcaatatccaaagtttattgtggactatcaaacacaggaacgagaaagaataaggaatgatgaattggattacttaagagagagg

SEQ ID NO: 149828 - DNA, 1167 bp, Homo sapiens
cacaccttgtgcttccatagaattgtcggcctctgcaacaggaaagagcagctctggggaagtcgctggtgctgacaacctttgctcacacccctactgggtccccgtctgcatcctccaacaccctcatcctgcttcctttacatagagttcattctcaaggaatcttttggcctgatagtgaggcctcctgcaaggagaaggaaagtcagtgtctgaatctgtttgggcggctataacaaacaccacagaccagaaaggaacctgcagaactccaggaaccaaaattgctgctgtaaaattggaggttgactaggaaaatgccttttcctatcaagtcacgtgtgctggggcatgagccactgcacccagccttttaaaaaactttttggccaggttgttttataggctcatgcctataatccctgttctttaggaggctgatgcaggtagatcctttgagcccaggagtttgagaccagcctgtgcaacatagtgaaaccccgtctctacaaaaatatacaaaaattagtcaagcatggtggcatgcacctgtgatcccagctactgaggaggctgaagtgggaggagctcttgaacccgggaggtcgaagctgcagcatgctgagatcacgccactgcactccagcctgggcaacagagcaagactctatcttgaaaacaaaaacaaaaacaactttcaaatccagctcttttggcatggcaaggcacagactgagagattattatttattataatttcatggctgttttgctcaggggtgattttcaatttgaacatcaaatttggcatgaacaccaaccaaaagcagccaatactatctatggtgtttgggtgcgctggctgatggcagccccaggactttcagcgggaatttccttttgtgctaatgccttgctgtcaacagcaggtgaaacgatgctggtgaagaagccaagtgtcaggtgtgcctggcatgtcctgagaatctgattcctgggggtggtgcctccctggctgcgagggcccagggcaggcctgctgctgttctctccctcctggtgcaggagaacgcagatgccgagaagttggaatctgaagatggatcatccataatataaaaaatgacactccaaatcggtttcaaataaaaggatatttcatga

SEQ ID NO: 149829 - DNA, 458 bp, Homo sapiens
agaggatccacaattagctggggcacaggattcttcaccttcttgcctctttgatcctccacagccacagggtgatttcacccaactcagagactgccataagctcgcaaagccactgcattcagagcacacatgttcaggctgggaactcaggctagagggcaaaggtgagtggcaagcaaggtaaagtgcccagtggggaagccagagggctggatttgaatcccagctctgccctcctggcctccctgaagcctcagtttcctcacctataaaaagggggcaaagaatgcctctatccaccactggcagctgagaggattaaatgagacaacgtagccgaaccccaggcattctccccttaagaaccttgtttggggaatggccagaaatcccagatgtacacagctgctcattatataacccttcccagcacctcatgtatcatcattattaaa

SEQ ID NO: 149830 - DNA, 435 bp, Homo sapiens
agcgctgcattttctcccctctccctccctccttctctctttcttttcttctattctccattcctgttttctcccccaccccactccccaaagctctgcgttgagaaccagatgctgtctggtgggttagggccagaggaggaaaagctgcccgccgtgggctgcacccataccctcttcattccaatgacatgaggggaggggaaaggacagaggtagactgtcctcccctacctcctcctaatacaaatggaattcctggaactggaaaacaaagaatacccccataaaaataagacagtacttctggtgcggtgtaataaaggggaaagtaaccctcaatgtcaggaaactccgcacctcccagctcatatttgtgtggaggaaaagttaaatattaatttggactcaactgaatgtggacacaaacaatgg

SEQ ID NO: 149831 - DNA, 417 bp, Homo sapiens
ggaagaggtgctcggtgctgagtaaaacacgacgaatgaaggggaaaatcaaacacaggcttggagaggcccaacgtttccacgcccaccgcaggtgactgtgaatagggtcacaacagcactggtcttggggacaggaggggagggtgcaggctggtctcaaagcactcagcaagccctcaacaaacagctgcccgaaccccacagctgccaccaccaccggcgtggagtctgcagaccaggcctcctgacctcccagggcagctctgggtcagcaggactcaaggcaccccttgtgcccaggccgctttcatcctcaggcccaaggcagcttctcacctccttgcccgccagcctggtgcctctaattgtctgggacccagggcacctgggcccagcctccccacccgtgtgcag

SEQ ID NO: 149832 - DNA, 366 bp, Homo sapiens
caggctggagtgcagtggcgcgatctaaaatgattttttttaaggtaaagatagaggcttgtccaaaggtagtgagttatctcaattgattgttcagtcagttacagattgaactccttgttctactctttacctacttctcactattgcacttgattagtctttctttcttcctttctttccttctcttctcttctttcttctctcctctcctctttgagaccgggtcttactcggtcccccaggctagagtgcagcggtacaatctcagctcactacagcttcaactgcctgggctcaagcaatactcccacctcagcttcctgagtagcttggtctacaaacatatgccaccacgcctggcta

SEQ ID NO: 149833 - DNA, 469 bp, Homo sapiens
gtctcgaactcccaacctcaggtggtctacccacctcggcttcccaaagtgctgggattacaggcgtgagccatggtgcccggccgtctctgtctcttaatttctctctttctttcctttctttctgtctcccttccttccttcctttcttttcttttccctccttccctcctttctttctctttctctctccttccttccttccttccttttttccttctttccgcgggaacctggggcaagtagaagatacaacatgagaagggggaggcctccagggaggccatctagacaactgaaagagagacggcaaagtggactggtggccggaggagtgctggagggttctggagagaaggaggctgattccagatgtttaagatgtggggtcagcaggaccctgggtgaccagtgaaatgtggagaaggtggcagccaggtcaattagagacagatgtgggggaaagcca

SEQ ID NO: 149834 - DNA, 371 bp, Homo sapiens
cataaaactgagtttgaacacttccttaaggaaaaagaatatgatctcatcagtttcagtagggttatataaagtactttgcatcaagtgcagactttcttatgtcatagaaaaagtcttaagaaagtaagctgagaactataatggcaagataaacaaagaaactgagagaggacatagatggatggtagaatgattaatgctgtatctactcagtacaggtgtttggtacttaagcaagtggttagaaaacaaattgaacatttattcttcctgacaaagggattaagaaatgtggttgattatacctttataaatgaagctttgagtaaactactgtcttgattgatttctttggtatttgctaacac

SEQ ID NO: 149835 - DNA, 315 bp, Homo sapiens
aaaaaagatggcacaaatagaagacaaatagcaagatgatagatttacatctaagcatatgaaaaaaaaatcacattaagtgaaaatgacctcaagaccccagtgaaaaggcagagattgtcaaactggataaaagagcaagacccaagtttatgtactgcttaaaagaaatgtactttaaacataaagatacaaattggttataaacaaaagcatcagaaaaatatagagagacaagattgttctaaaatttatatataaaacaatggaatgaaaatagccaagatacattattaaaaagtcaaaaaataatag

SEQ ID NO: 149836 - DNA, 387 bp, Homo sapiens
ccactgatttgcttgagatgggttaggcacagtcagctttaacttgaaaaactggaaatccatgataaccctgatagtgatacattaccataaacaataaagcaagatgaaatattatgaaataggaaacaagagacagcaaagacttcatttaattctaagctaaaaacagaattacaggggtatgccacttggaaacagtctcagcctcaaattagagagaaagcagatgaggagcacacacgctgaaaacccagacaacaggcatgagcagagcagcgccgagctttcccaccgcaaacaggcatgagcagagcagtgccgagctttcccaccgcgcaggaaccccagcaggaccgcttacgtgaaatttaacttacacccctt

SEQ ID NO: 149837 - DNA, 669 bp, Homo sapiens
tcattgcatgatgacgtgaactcaacataaaatgtggggagtgggagtttcttctgagaacagttcctgtgatgtctggcaataggagcgttgactggaacatgtggatataccttttccaccatgaaacatttgaaaaactccaaagtttggactcaggcaagtgcaagtccaaaatgtgtgttacagtccactctggttttggaggtagttgtggagtgccccacagacctctagggagtaaaacatactggattttactccagtggaccacttggagctcctgagccagctgagaagcctgttcatccccagcagaggcaaagccagtttgggaggcctcaggattgtcatttctcctgttcacagcatggctctgggcagcgccactcagtgccatcaaggaaccatgcacctgaagtttggaacccagctgagtatgcaatacagaggaggagaagactgcagtggggttttgtaaggtgctcccagcacagcgtgcatccgttccttaactctgtaaagcaaatgtggaaaccactcacagttttctagcttccttaccctttattcaactcccctaagtgctgaggcctaattgctgacccatctggcctctggcctgatttccagtggatatctggccagtggtggctaggtccagcattt

SEQ ID NO: 149838 - DNA, 271 bp, Homo sapiens
tgagtttttcttgcttgcttctgttcctgtgtgggagcacagaactggctgggccggattacctatctaggtggcatcagctggtgcattggaaggtctgcaaaatatctggagcactgattttaggtgttacaactgtgatgttatacctgggagcaatttgaggaggttcagattcatgcagctggaggctgtgtggctcctaaaccgtaatttctaatcttggagctaatttgttagtcctacaaaggctgactggttccccaggcaa

SEQ ID NO: 149839 - DNA, 474 bp, Homo sapiens
catgaggtgcagtgacggaataggagctgtgggcgctggggcagttggctatttaaggtttccgtagaagatgaggcttgaccccatgcttgagggatgcactgcgtaaccgaagatccctcccatgagttcttgcactggcagctgtctagagctggcttcagacactttctactcagatgcccacagccacagaggggaggcctgccactccctgtccaccctgcagcctggccctgcccaggccattccttctgtgttctcctcccttctccactcctgggtcacccgatgcttcctgtcctccacatgacacctcatatgtgtcctcccccttctccttcccctgtcagagagtagggtaatattgtacctgtgtccctccagtgacactgatttcttcatagtctgatgcagagggctgctactgaagtagctaagagcaccaactctggagctgcacagaccactctg

SEQ ID NO: 149840 - DNA, 436 bp, Homo sapiens
  misc_feature (174)..(174): n is a, c, g, or t
  misc_feature (179)..(179): n is a, c, g, or t
  misc_feature (184)..(184): n is a, c, g, or t
  misc_feature (190)..(190): n is a, c, g, or t
  misc_feature (196)..(197): n is a, c, g, or t
  misc_feature (205)..(206): n is a, c, g, or t
  misc_feature (208)..(208): n is a, c, g, or t
  misc_feature (213)..(213): n is a, c, g, or t
  misc_feature (216)..(216): n is a, c, g, or t
  misc_feature (226)..(226): n is a, c, g, or t
  misc_feature (228)..(228): n is a, c, g, or t
  misc_feature (230)..(230): n is a, c, g, or t
  misc_feature (238)..(240): n is a, c, g, or t
  misc_feature (247)..(248): n is a, c, g, or t
  misc_feature (250)..(250): n is a, c, g, or t
  misc_feature (261)..(263): n is a, c, g, or t
  misc_feature (266)..(268): n is a, c, g, or t
  misc_feature (273)..(274): n is a, c, g, or t
  misc_feature (276)..(276): n is a, c, g, or t
  misc_feature (280)..(280): n is a, c, g, or t
  misc_feature (292)..(292): n is a, c, g, or t
  misc_feature (296)..(297): n is a, c, g, or t
  misc_feature (299)..(299): n is a, c, g, or t
  misc_feature (301)..(301): n is a, c, g, or t
  misc_feature (303)..(305): n is a, c, g, or t
  misc_feature (309)..(309): n is a, c, g, or t
  misc_feature (320)..(322): n is a, c, g, or t
  misc_feature (329)..(330): n is a, c, g, or t
  misc_feature (332)..(332): n is a, c, g, or t
  misc_feature (336)..(336): n is a, c, g, or t
  misc_feature (340)..(340): n is a, c, g, or t
  misc_feature (350)..(350): n is a, c, g, or t
  misc_feature (355)..(355): n is a, c, g, or t
  misc_feature (360)..(360): n is a, c, g, or t
  misc_feature (386)..(386): n is a, c, g, or t
  misc_feature (389)..(389): n is a, c, g, or t
  misc_feature (395)..(395): n is a, c, g, or t
  misc_feature (399)..(399): n is a, c, g, or t
  misc_feature (410)..(411): n is a, c, g, or t
  misc_feature (413)..(413): n is a, c, g, or t
gacccaggaccagtcttaatgatactgaaatagtttgtccaagaaaaaaaattcccatcgtggatgtttattcaattaagagtaaaatgtcttcatagaccatgatcatatttatagtttaaaaattaagtgcactccaagttcttttgtcttttttttttttttttttttttnggaangggantttttntttttnncccagggnngngaaanggntttttttttngncncctccccnnncgggggnngnacatttttttnnnccnnnccccnngngggngggaaattatgncacnncncncnnncccnggaaatttttnnnttttttnngngggncggntttccccggnttggntaggnggggccaaattcccggattttggggnccncccccnttgntttccaagggnntnggaatttaggctggggccccccc

SEQ ID NO: 149841 - DNA, 258 bp, Homo sapiens
ctttgtgaatcttggcttcaaggaccaggtgtacctgtatctcaggtgggaagattgaggctggagcaatgcctttataggaccatcagagaactcttctgtgaacagatttctgttgtgcatgatgtaccttttacatcatgcagggcattgtagcagatataggagttatgctttatttggtccccagcttcaggtgactaacagtccaatcagaatccatgcacacagagatcagcatgacacaacatgagaaaa

SEQ ID NO: 149842 - DNA, 144 bp, Homo sapiens
tgcacattggaacaggttacaaagactggtgtgaaaattcccccatgtcccttaacatgataccaaatcccacttgcttgaaataacttggagtggtctcacctaaggacaaaggtaaaaaagcaaaatgaaacaaaacaagtt

SEQ ID NO: 149843 - DNA, 415 bp, Homo sapiens
cctggtatttgccgccaggctggtctttccctgaactctgttttcatgccacttctcttcagactttctcctcactctggcagccttagccagaccatcaatgccatagatttgtagtcaacttggccaaacagccattttttagttatcctgggttcagctataccccatcccaatggcctccagtcaggagacagttagcaatcccttcccatgcttacacttgacctagggaatcctgtgcctccaggtatattaaggactcatatcccataatcaggtggggaaaaaaataattaaaagaaaccctatccgtgacagtttgcccactggccttcaggatcagtgctctcccaattctgtgaatgacccccatgtttaaaagtttttgtcatacccttacctattaaatcca

SEQ ID NO: 149844 - DNA, 189 bp, Homo sapiens
caacaacagtatcagctaactcctagtgtttataaaccctaggttctaagaaatgtgtatgtattcactcatgaagtattggtaacgatcctccaagatgggtgacactttttttttttttttttttttttttttttttttttttttttttttttttttttttttttttttttttttttttttttttta

SEQ ID NO: 149845 - DNA, 792 bp, Homo sapiens
ggacgcgtgggctgagagactcaagagaggcggcaggagagtggagaatgaggggtggagggcagaggagaaactgcgtcagggatgtgtccgccaccttcatcctccagacgggacttgggagcggctgcaggaaaccctgagagattcctctttagggaagtcatccagccctggggtccccttatgccgggagcagtgaggacagaagaatgaccatctatcttgctgaaagctctgtgagggaggaacggaagaacggagggagctacgaccttgaccatcccctgagtgtccatggcctctgtgctccggatgatgccggggctgccagggaccacagagccacccactgggaggctgggggttggcctggctcaggggcgttcgtcagccatagacacccacagcatgtggtgggcagggctgggaggtgacacaggaactgaaaaacctgagaagctccagccactccgcagggtaagtgccacctggggtaaaatgattagctggttccagcccctccgcagggtaagtggcacctggggtaaaatgactgcctggagctggcagctgctttctctgctctccccagggccctgcagggaagcgtggaaaggcggcacagggctggacccagaggagctctcagatgctggactggactgtttcaggggtcatctagcccattccccgcctccaggcgaggatttgcttgagcctggaaagatgaaggatcctcccagtgccgtcaagccccggattccacctccctgtaggtggactgccagc

SEQ ID NO: 149846 - DNA, 798 bp, Homo sapiens
aaataaaataacatactgctagttaggtctgtcaaaataactgtgtgtatgtataaaaaaatgtaactgattgtctcaatttcatctccacaacgttaggataatcatcatcatcgcatcaaagggttactgtaagaattaaatgagctaatatgtatgaagcactttgacttgtgccttgcacagagtaaatattatacaagaagtagctatatttatttatatttttctaaaactatgtttatgctactaaatagttatctggagtttacctgggaattgcatattcttttcaggattcacgttttttggcacacttagattatgggagcagttttaaaaaatatttttggttatgaaatccaatttcttatccatgtaagcactgaaacaattcctctttatgtgcgaacactcagtgatacttcacataccattaagcttctattctcagcacagctagctcagagtggcactgtttaatcactttatactaaataacatgtaggttacaattagccacccagtgggctcatttgcttatatataaatggagtcttgtaatcaaaatctggagatgagtcctcctttgtaaggaacctgatgtggtctttgtaccaattagtcacttttgagaaaacctagttcttgctctttgatgaattttccttaaatatggggtgtgggaaaagaagagtaggatatttaaaatcttgtcttgccttggtagggaaagacattatggtagggtgccttgttttattaagtttcctccagtaaatattcaaaaaaactaat

SEQ ID NO: 149847 - DNA, 371 bp, Homo sapiens
agaattgcttaaacccgggaggcagaggtagtagtgagccgagatcgcaccactgcactccagccgggatgacagagtgagactctgtctcaaaagaaaaacgtggaaatgtaaaagaggtatggcagaacataagaacattcatacttattttggttttcctggattcagacattaaatcgactattcaatgcccaaagacatcctagtttagtgctgcagcactatggaacacaaagaagtgtgttttctctgctcttcatccacatcactataaccctcttcccagttttatctctattctagaaaaatgttctcagtggcagcttacaaaaaaaaaaatccctcctctatgtcagtttccggggtac

SEQ ID NO: 149848 - DNA, 572 bp, Homo sapiens
atctccaaccctctcctcatgttcctcacattgcacatgtttctgttccttgaacatatgcttttccctgcctcagggcctttgcactggctgttgcctcttattggcgaggtctctcctcaggcttcaagcagctgatcgcttctcatccttctggcctccactcaaataccatgtcctcagagaggcctttcctgaccgtgctctccaacattgccttcctaccccatgcacatctcctacccattctcctgttctgtttccatgacctgtatcactgttgaaatgatcttctttgtttacttctttgttgcctgtctctcccactggaatattgcctccttacagcagcctccttatctgtcttatttatgtcttcagtggctaaaacaatgcctggcacatggtaggtgctcaaacaataattgttcacgtacttggattcctggatctaaacttctaggtgtgcacacatgggttgacccgagcatgagagctggaactagactgccttggtctgttacttgctagctctgggacactgtgctagttattaaaccttgctggacctt

SEQ ID NO: 149849 - DNA, 294 bp, Homo sapiens
tatgtttgttcttgtttcatttgtgggtatcttaattcaccccttgagctcacatgacagataggctggctttgccacaagattgaccattgtgcgattctgtttcaccttaaagggttattatccttttcccataaattttcacagcattaatccatcaatttttgatttggtattcaggaagcgaatgtagaccatgatgtattatttattcagcatagattccagacagccagttccttagaaatccatgtcataataccatattattagtttgggaataaagaggggagt

SEQ ID NO: 149850 - DNA, 272 bp, Homo sapiens
ccacattttcttaatccagtctatcattgttggacatttgggttggttccaagtttcttttaaaaaaaaaaaaagaagacttttattttggtattttaaaatcttatgtttgcccagcacattagatataaatatgtgtgtcttgaacatttatgtttttgagggtttggagaatgcatttgtatttggatgtaatgtgtatagatacagtgtgtggtctctgtggttatcagagtgcttatgtgattctgtgagtatcagtgaaaaagtgg

SEQ ID NO: 149851 - DNA, 327 bp, Homo sapiens
cctcctatttccttttcgaaagtagcagtttggtttattctcgtttgctaagtaattgtttgaaatatttttcagcctctcctgctccctcacaaaaattcacctgtcattttaatgataacagcatgttaaaaacttggaagtctttatcccaatataagaattatcttgaaacaaaaatctaaattacttttaaaaattctcttaactctgcatttagtctcctattatctagatctctgagtccaggataactccagttatccccagttggatcatgtgtgatttatctgagaaagcatccacaacccacagctagtggaaacc

SEQ ID NO: 149852 - DNA, 284 bp, Homo sapiens
cctctcgtcctaacacccctgggtctccctgctctgcttgaagcagcctcgtccctgcttgtcacggagtcagtttctttctcatcctgtaagtcccagcttaatcagcagcttcgcagagaggcctccctcgtcacccacctaaagcaggtctccacgttctcctattggtctccacgttctcctatcggtctcctcctgagaatttaacacaacttgcaattactctgttacctgctcagtgcgtctccgaaacagtctgcagttctgttaggtgagcgcca

SEQ ID NO: 149853 - DNA, 938 bp, Homo sapiens
gcaggaaaaagcttccactgcacaactggaagaaaccactgccttgggaattttctgtcctgcaaccctcagctacccccttctggaatgctgccaccatgactgctagagacacttcgtggaagcccacaggacgtgtcaccttttctcatgggctcattttgtgggccaggcacaagcttctgttcattccacctatggggtttgtaggtcaactctctgcagcacctgtttaatctctagaagaaatgctgataaaacttggaaatgtcgtagcttaggtatcttcattttgattgaaacaaattttgcaaaaattatgaccgtgagagaaatatgacatagaaaaattacgacagggaaagaaatctcacctaactcattccatcttgcttctaacctccaagctgcttttgttcaatcctggacatagaccaacctaaccatgggagaaatttaatttatagtttaactctgaatcaaggatgagtgtccctttctaaaacagaccccctccttgtcctgatactgaaaccacctttgtaagacccaggaaagaccacgaaattgagattataggaagggtctgaattctgctaagatgtaggcatagttaaataataacctgccattgttccatagcttgctttcttataatccctaatcactcaggattcatgaagccacaggtcataagatttgtgacttccccaattgctcatataaataacatcactactgtagaatctcagaggggccttttgagatgttttccagacttttgcattgtgacaactaactccacttgaacccatgactcatgactcaaccagtcctgtggtccccacccaaaggctgactcagcagacgaggactgttttccacacccctatgattgtatctccaaccaataaacagcacccattgcttagcctctc

SEQ ID NO: 149854 - DNA, 252 bp, Homo sapiens
tctaaaaattaaaaaagaatatagaatcaatttttattatccatactgagcatacttctgttcacccatgttcatttaaaaatcacttgctgtttgccactagtacgtgtgtaatgagagactcatccttaaacactctcatatatactcttccccggttcagtatttctcttggaagccttaggccaagaggcataatcaacccatagattacatatattttttaaagttcagccagaccagtaagtgaaa

SEQ ID NO: 149855 - DNA, 171 bp, Homo sapiens
atactggggtagctacagaaaggccccattcagcactatttttcacacttaccctgcgtttcttggtctaatgcaagttgtagtggttatttgatttaggtgttgctcttcttaatttggaggaagaaaattaactttcgctacagtgattttaaaacggcttctgtagaa

SEQ ID NO: 149856 - DNA, 489 bp, Homo sapiens
gtccagtgccaagacagtgaaaggcagagggccatggcaaagtctgagggctggaggcagatggacagatgatggacgaatgggcaccggtgaggccaaccagaggaggctaccggagctacagggagagcctttcaggcatctctgaaaggggacatcaggcgaggctgaaagcaggaggcacaggatcaccaggtcctgctccacacccaggagggcaggtggcagccccagcccagctcggagggcccaggaggaatcggccagaagacactgtcatggagatcctgaggcagcaatgggaagcaggaggagtgaaagaacagtggcctttgcctacttggatccaagagttgtggcagtcgaatgacagatccttccgctccgcaccccaggggacagcatgacagatccttccgctccgcaccccaggggacagaatgacagatccttccgcctcacaccccaggggacagcatgacagatcct

SEQ ID NO: 149857 - DNA, 1077 bp, Homo sapiens
  misc_feature (1077)..(1077): n is a, c, g, or t
gtatcatttaagagatgtttatcacttaaatggtacatatacatcatttaaaggatatatcatcatcgttaaatgagcatttagtttttttacatgtgttataattactcatatttttgtttgtaaatttactatcttactttgtgttttctacatatcccaccttttctgtttcctttcttctactttcttgacttctggattgattattattaaaactttattattagcaataataataaacacaatatattttatattctaaaaaaaaagaaaaaaacaaacacacaacaaacaaaagaaaacaaacaaaacaaaacaaacagcagccgcgcccacaaagacaatcaacacacggggagacgcccgacacgtgacgcccatcaccccacagcggggggggcggggcgccatcacaacaaatctcgccgcgggggcacccacacactccgccgcacccccacccgttatatatatcaacgacggcgcgccatggatacaacgcggcagccacaaatcaacaaccacgacacgccgagcgcagccgtcacaaaatcaacctagcgcgaaggagcaccaaaaacaccaccaatctcaaacaattactatgagagaggaccaccacatatcagataatgaggacgactacaagacgacacaaacagccaaccacacacaaaagaatacatcacgtcgagggtaaaaaatcaatcccaccagaggtgacgtcgcaccaacacactcctcatcacacctctgcgccagctgcaaaaaaacatatcgaacggcactaactctatcacaaacaatactttacaccagcgaggaggatgaatgaaaagagagcgcgaacctgaccagcaccacatcacgcgctggatcccaaatagtccacatccgctgtaagcatgacgtcagctacagatctcatcagcacacacaagcacgatgcgacgactgacgctccataaacacgccacaatcacacacagcacatcaccctgacatctaacgacgcgactaaacacctccccacctcgaactaccgctaactcgctcatcgacgactcacctacn

SEQ ID NO: 149858 - DNA, 143 bp, Homo sapiens
tgtgtatgtggaaagcgggtgaggggagctggggacaccggggtggtgagctgaggcggggacccgggcctggagagcagggtggggagccgcaggcggccggcaggggtgcggtgcctcgcgggctcaataaatgggcccca

SEQ ID NO: 149859 - DNA, 579 bp, Homo sapiens
tccacaggccaagtcagtctgagctaccaccattggtgcctggagagtagatgggtcagtcgtgtcctcttaaaggagagtcaaaaaatcagaaagcttatctgaatttcctgatcttttactatcggcgtctaattcaacctctttttgaaactgcgtaggaaaaaacaaaacaaaatccaaaactaaaaactacatctgcaggcaggatacattccttaggccaccagtttgcagtatcaacattaaatgagtcaaatgaaatgcctgagaagcctactaaactctggcatttttagtaaagctactgatggaaaattttctctttgctatgcaagcaatttagccgacagcaccaagactgttgttaaactcatcaattttaattcatggtcagaccttagtaccagacctataacttagttttgcagtggaaaggggcagagacacagcagttgccctcagagtccgcctattggtaatctcagagttacatgctgagcaaacatgatttactccaatttttcagcaccctctgtggtgcgatcattcacgcccatagtcacatcagtcacaaga

SEQ ID NO: 149860 - DNA, 383 bp, Homo sapiens
gggcgtaggctcctcagctccctgcttggagatggggagtgcaagggaaggcgtgggcggtgagtgggtgtgtagacacacttcaccgaattcactacgaaaatgggaccactttccttggggtcctacgtgctccctttcctcactggtcgtcaggggctgacttatttgttccctgaatccctcacatgggaaggaaggagacatgttgggttggggaggaagccctgtgaacttgaacctggggttctggtccagtcttagagttagtaggtcacttgggtgttttcacccctaaatctcagggacgctcagtaggaaggccctctagctgcacagcccagagtggtgccgccagctgggggcaggtgtcagaggcctgt

SEQ ID NO: 149861 - DNA, 338 bp, Homo sapiens
cgaagtactggcagatcaatgtctggtgagggcattctttctgattcgcaggtcatcttctccccgtattctcatacagcagacagagcaagctctagtctttctctcttctcattgtagggcctgaactgtcatgacctcctctaaacctcattacctcctaaatatcccagcttaacatatggatgttggtgtgggggggacacaaacatatagttcataaaattaacatcctgatgatatacttgctatttcctagcaatactctgtcttttacaaccttatgctattggtttcaattttccaatagtttcccttgagtatagtgcacagtcagc

SEQ ID NO: 149862 - DNA, 370 bp, Homo sapiens
tgttcttcccttctctgataaattcctttcttccactgagatttgcttattcattcaataaacacttactggccttcagcaatataccaggcagtgtgctgggccacagagggaaaataaaggctccaaatgcccagaagtcactgccctgggtttccttcacatacctcatcatatctccttttcaaaacactttttgctctatcagatctcttcgttgccatttgcctctgatcggtcctttcattctcccagaacccacgcatttgactcaggatcttcctctagatccccccaaaactgacaacaccgtgggtgcctcgacattcctaaggacagccttggcctcatgtgttccttaagtgtctac

SEQ ID NO: 149863 - DNA, 240 bp, Homo sapiens
ccgagggacatattgccagatgacattatatagaggaagtattcctataccttttgtatcattagagagtttggctgaaatgaacactgggtggtaaaacaaaggactgctctgaaaacttgtactagattacctcagagtcagctgaggtgaagtattgtattgcactttctgaatctactttgctgctgaatcctacattttgtaggggctgcttgagtagtaagtggttcaccgtgt

SEQ ID NO: 149864 - DNA, 331 bp, Homo sapiens
cccgacttctacacttttcctttcttttaagaatttaagccccaaagaaaatcaatctggaattaagggaaatcaaaaaaatatttttaactatttaactgaaaaacactatggttaaaagcaaaccaccttctttatcagatacttttgttttttaaaatttaaatattttgacttattttaggttcaggggtacatgcacaggtttgttatacaggtcaactcatgactaaggggtttgatgtatggattatttcattacccgggtagtaagcatagtacttggcaggtttttgtttttttttcctgagcctctccctcctcctcccac

SEQ ID NO: 149865 - DNA, 628 bp, Homo sapiens
agtggatatactgtaataattaaccattctatttttttttacttttagatggtttccaatttttgatactgtaagacttgcttaatatctatacataattatattttgcttatgagcattttttaaaaacctataaaacttgtcatgaatttcagattatttcctaaccctgaattccacacttggatcactgtgcttctgtctctccttaggtgaattagccacttttgtagttaattatttcagcattgacttctcatatgagcttcaatctcataaatccagttgcttgataagcatctccaagcttgattcgccataagtactcagacctaacatcttcattatttagggcattatcatctgtcccaatgtggtcttcctgttgtattccccaaatcaattaatatcacctagtcacccaagcaagaaacacaggagccattctatgctgcttccccttcatccttcccaaaagtaatcaccagcttttgctaattttagctgcagtttctcaaatctgcctctcctcccacccttacagacaccctggtagttcagacgctcatcatttctcctgtaacctgtgcagcagttgatctgtagctgatcctagctgatctctgtt

SEQ ID NO: 149866 - DNA, 756 bp, Homo sapiens
tttagagcaaagggaatagcctctataaaaacatatacagataaaaatattttatttacatatttttcattgcacattacaaaagtgtctttatattctgggccaggtgtggtggttcccacctgtaatcccagcactttgggaggccaaggtgggtggatcacttgaggtcaggagttcgagaccagcctggccaacatggtgaaaccctctgtctactaaaaatacaaaaaattagccgggcgtggtggtgtgcacctgtaatcacagctacttgggaggctggggcaggagaatcacttggacccgggaggcagaggttgcagtgagctgacattgtgccactacactccagcctgggccacagagcgagactccgtctcaaataaataaatatttctttatattatttattacatgcaactcctacaactcaatggttggttttattttcctcattttacctgtgacacagataaaagaaggcccaagttgaccccaaatgctctaccactccttcacatgtcatcccacagctgaggcgcaagctgacatcacacccccaagtaaactctgactaaactgctaagacacctaactaaaaccattagtccttccctgttgaaggaatgcaagtcataacatagctcccataccagtccaaggcttcccttggtttgtctggggacatctattgtttaaacatgtatttccagggatagattgctcctgggtcaatttcaggatggggtatat

SEQ ID NO: 149867 - DNA, 949 bp, Homo sapiens
  misc_feature (14)..(14): n is a, c, g, or t
  misc_feature (28)..(28): n is a, c, g, or t
  misc_feature (34)..(34): n is a, c, g, or t
  misc_feature (75)..(75): n is a, c, g, or t
cgactggggacggnagatggaatagtgngaaggnatcggacctactagtacaaatgaaccaggatttaaatttcngttaccatggccgggcacagtggctcacacctgtaatcccagcactttgggaggccaaggggcaaagatcacttgaggccagcagttcgagactagcctgaacaacacagtgagactcccatatcgacattagttaaaaaataatttttaaaacataaaaaattacaaaaatgtgttctgaagcaattagcaaagaattgattcattttgctggaggaatcagcaattggaatgaattctatttgccttgagcatatagggataaacctgcctaacactggtgagcagagcaatggcctgagaccagaagtcctagaattcctcccagccctctatccaaaagaaagacagagtcctgggctccaagatgatggcacaatcaggaactggcccagagtaatccattacccttctctccaaggcttccttcctctgcttcctaggctttgtcacaatttcctccatttaacccgtggggggatggaacacctgtttacccatctgaaatgcaggatgataggagatcacctgccctctgctcctccctccttccctgtcaggactgagtcaataccgatgttcaacttctggtgattagaagtcaggatgttcaggtggtgggaggttaggtgagggacacgtgattgtcatgacgggcatttgggatgaaagtcagaaccataaacacatattcattatgactctccttctgccgggtctttcatctggggaatctcaaagccctggacaaatggtaattaattttcacaacagcttccacaagaggatgcagtggtgtctgccaaaggccagggggtattttcccagtattcttccctcaacctttcctgctcactcccagcccctgccagcc

SEQ ID NO: 149868 - DNA, 393 bp, Homo sapiens
ctgggatgtaggggctgcccctagttgtttggtacctggtctggggtgattagggcaggggatagtggtcctgagtgtaagatcccaataagaggagttgttgggtggtgtgggcgtcacctgctgttccattggcctttagccagggcctgagagctgggtcaagataacataatttaaaaaacgatattatacccaccagactatttcttcctggtagaaagcaccacagatccatatggacttggatggatctgtggacagattccatgtttgagaagtagccataacctgcggccttcccctttctacaatgcagactccatcctcagttcaacagaagtttcacaggtatctttacaggtgtttcctgagtcagccgatcaggtgaat

SEQ ID NO: 149869 - DNA, 558 bp, Homo sapiens
gacaggaaacaaaaatgtcaagggagactatgtattattaagatgataaatgaaatgatgtccaagctgagcaattaaagtgtgaagtagaaggacacagggtgagaaactgatgcttctcctcagcctctataaaaaagatactgaataaagataattgagaggcattaggggactagactgagaaaggattggaaatctgttcactgagagtacagaaatgaggaagcttggaaggcagaagattttggtcaaagacgtctggcttgaagctatttcagctctttggattatctgtggtggaggccatcacgtctttggagtggaggtaccatgaaactagtgtctgcaaaacatcatctaaatgaaagcaaaattcctgagaaggatggcactataatttttaaaagaaaagctatgagttaagcattcatatcaaggtagatgtttggagtgtattgcttgtgtgtgaaaaggcagagatgaccagaataagagttagaggtatgctgcgttttcttcttggttgatgagtaggatggcctggacaaagaagtg

SEQ ID NO: 149870 - DNA, 906 bp, Homo sapiens
tatgttatcaataatttattatctactatgaatcagacagtagaccaagtgtaaacatttttaaaactcaatagtgacttgcagttgtttatagtttcacgacatgacatagatttgcaaacaagtacaaaattataaccaagattgtatgatatgtgttgtaagagcaatatatattattatagtacagaagatttcaaaaattactttctttgaacgttgagattcaggaacaatgaaacatgtaaaaatactccatagttagaaaaacccaggaagcctgtttctaaatttaaagtatgccatgaaagaggggattattttctgaaatttgcacataagaacaaaatacagtcacacgtagctgagaattgttacttaatgttaatctagtttgataaagatttatattcccttatgaaaacagatggtaaagattatatattttgatataaaatgggtaaatatggcatgatggaaagaacacattacaggagaactttgatctatggaggcgctagaaacaattaaagatacgaaagcagcaagtatcacaagtcccagatggagtccctgtgaatttgactaagtggcccaagactctttgacaatttctctagcagatggtttttaatcttggattgagggctcaagtgttacctggatccatgaaaagggctctttgggagtaaggacaggaaggggtacggacttggactggcctttggttgaagggggttggagtgggtctttagccacttcagcgctgggttgttggccctaatggagggttattgaccggggttgttgtccgggccgtggtaactgtaaattaaatgggtttaagggggaactagttgtataaacattcggggcgttggcgaaaacgttgacggcgttttccag

SEQ ID NO: 149871 - DNA, 412 bp, Homo sapiens
cttcttttcctggggaaggggagtagtatttccaaggggtgtggattctaaggattgcttttgcggagacagcatgagcaaaatggggcgtgctgttccagggcgggtgctggagaggcggtggcgtgggtatatttagcccatggttcacacgacacacttggaaataaacagagccattttctcagcaggcggctgctctggataaataaacaggattgcagagcagccctggtctggaaaagcagagataagcctattttgtgactccacctgggtgtacttgggagcaacaaaatcaaacctcctgtaagaatatttttgtctgccaagacccgcagaggctagctaggatggagagggagacagggaagcatagccacggccctagtgccctcctttccccagatcc

SEQ ID NO: 149872 - DNA, 502 bp, Homo sapiens
ttttagcatttatataatatctcaagcattgaaagtggtatgtaataagctctggtgcaaaatgttaagtgttccttgtacctgtacatgtgccaagtagataaggcactgtgtgccaggtcactaaagtcatccactatgtggatgcctacattcctgtttgctgttataatgatcctttgggttttctcaagcttaataagtctattcccagaaatacatcactcagtttggggaataactgggtgtgccctgaatgaattaatgagttaattaatttagcatgataattcataaataatggcttctaccacacttatttcattttaaatttcagaaatactcagagaaagggaaaatcatctttatgctgtaccaaaaaatgtaataaagttatgttgtatattgtaccattggaataataattactccagtatgaacacagaacttcaaatataatctgattttttctaactctgttaactaagactttggaggaaac

SEQ ID NO: 149873 - DNA, 319 bp, Homo sapiens
accagccatagggttaaatgggatggggagaaaacaatcaagtgaagtaaatgctgtctatcaggatgttgagaggtagccctgataaagtgtcacatccatagccttgatctgagctaatttcagaccctgaactcagttggagtggagggcagtaccccaggaaaggacactgcaactccaggacccaaataaatgataatgatttcccaagttctcctcctaggaaacgtctggagccatttactagatatccatatactagggaaatacaaacacccaaatatttcaaggacccttggaatcaggatccaagttg

SEQ ID NO: 149874 - DNA, 861 bp, Homo sapiens
ctagggctaggtttcagaaggattggcttctagttcctccaataattagctattggccttaaacaggtgagttacattcttgtgcctgtatcttggattcttcaaggaaagatggtgtaattaaatttaggcaaattaaatgccagaatgaaaagacttctcagatagtatgcaatgctagttagtactcagagttctttgtctggttttgttctttttattacatgttacaaagtcatctcctaatttattccaaaaaaggttaatattaggagatagctaacattctaacatgtattactacttactatttatagaataaaaatattctcttatctgcccaataagagaagcaagaaacaggaagaactgcaaaaccagataaagacaatacaagaaaggaaaactataggctaatattgttgatgaatgtaggtatgaatgtagatacttaataaaatattaaatattagtgtatgaggtctagtaggatattaaagaaaataaaatgatacatcataagcaagtttatctcaggaatgtccatattagacacagaaaatctattgtaattcactaatgtaataatacaatggaaaaaggatatctcagttaatgtggaaaaatatttgaagtttattacaatttttagaaacatcttagcaaacaaggaatagaacggaacttccttaatgtgttaaaagtaatatactaagacctagggaaaccactttacttactggagaaatttcagatgcatttcatttaaaaactaggattaagaccagcatgcctaatctcatcactgtgttctgtcaaataccagagatcataaccaatgatgtaagaagaaaaaaagaa

SEQ ID NO: 149875 - DNA, 248 bp, Homo sapiens
tgtgggaagagcccaatttcatttctggcaaaatcctctacaggaccatccatgcccataaagagaattactttccagttattttaaccaaggtcaggtaacacatggacttgagtcctagatcatgttgcatgagtaaaaataggaactgcttacattgttggacttaagagactaggcagctctctaccccattaaatctagaaaatatatgctttcctatgcaaaatctttataaatattaatta

SEQ ID NO: 149876 - DNA, 310 bp, Homo sapiens
agctagtggagacagaggaggagcaggtgagggacccaggtatgactggctccacagactgggaatgacaaacttggaccactcagcatgacccaaggcctcccaaagctatgcacactgtgtacatgaattttaaaacatgtcctacccagcgtggggcatttgtcttgttctagttcagagaatagaacatgtgctatatagtccaagaccattcgcaatctgtttcaccagccatattgaagaacattctgcccagatcttggcatatggcaatttgctttatagcacaactgctggacgttttaac

SEQ ID NO: 149877 - DNA, 316 bp, Homo sapiens
tattttaatgcttagctgactgttgtcaaagtcatcctaatatttatcttttggttttgtcatgactggtgtgtcatttgtttttgtgcaggagatcttgttggataattctgtgttggtaggtccctgacccttgattcctaactttttttgagttttgcggtgctgtttctttgtgtcattttttggttgtagatgtttgtttcctctgcatctctttttttaagcgaaccattaatgctaagtccagtatgtgtagcatgtttcgtggtgtttatttgataccagtataagcaaatccttcctaaccttctcc

SEQ ID NO: 149878 - DNA, 176 bp, Homo sapiens
tttgttttgggtagtgtaaccacttctttgttttctgtagattttttctggatggccagaaaggtgtcccacacaccctcaagaccctaggccctctctgcagagctggggcttcagtacatttatttttgttttagtgacatgcaactcccttattctcttagacaccctattaa

SEQ ID NO: 149879 - DNA, 753 bp, Homo sapiens
ctttatacacagacagatctcacattcatgttaactggtttattcttgaagcataacatttcatcaaggtgtatacctgtatgtgaatatttaacaatttagaaactgaaacagatgcagatgaagaatgacctacttgaaaatttaccagccaagcctgtaagctgtgtagagtaatgtcaacacaaaggaaatatcaattcaagtggattccaatgtgcaatcacagtcattagtatggattggtgtcaaactttcaagcatttgccttgtttattgaacaacctaataattcaaaatggtaatgggaagagggtggagtaggaaaataaggatagactctgaaaccaaggtccttagggcttctatatgaatttcagaattactgtcaaataaatatttattggtgtcctttctcttgtatgtagacaataagtacacatacagatagctgtctaaaaattaagtgttaagctggaattagatattgaaattgagtaccaatattatctttagtcaatttcccttaggatactattttgtgaagagaaaatattattcatgtgcatattaattaaagcttttaaaatgatcactgaaaatgtatcctctgacctgcagagtatatccagtgtatgttcttaagtcctggtgctagatgcaaattaaagatgagtaatgcaaattgaaatttccatgaaatgaatcattctacataatgagctttacaaattccacattttatgcaatacc

SEQ ID NO: 149880 - DNA, 283 bp, Homo sapiens
  misc_feature (34)..(34): n is a, c, g, or t
catcttagtttatataaagagggagagaaaaggngcttttgttcttttgtttattaaggaattgatgaaaataaaaacaacgtatctcacagcatgtttgataatatttccatacgtatgtgataatggatcaacgtttcctagagatgaaataaaaagttctaatttggacaaaagcaaacaaggaaaattataccgtagaaaagcccggctgacggaagtgaggccctgtctcagggagaaacatcggagacgtttaaaagcagggagtgaaacagaggat

SEQ ID NO: 149881 - DNA, 494 bp, Homo sapiens
ctttctgtttttatttccaattatttcccagagggagaggccactatactccgtgtactgcccacaaaagccaccaaccactcaggtgtggtttgcagaccacaccctaagtgagaaaggaaaagccactctggcttatttgacaaaaagcagaaatgctcaccttgtgacaaggaggacactaatggcgtgggactcagtgggttcatgaagatgccaaacacaaatctgcactacagcaaatttgcctatacgaagtccgagagcagagtatgtggctccacacaaactaccttttaacccaagaatcctggaattccactcctggctttaaaccaaggtgtcagctgggaaagccacccttccgcccttgtaagctgaaggaaaagggctttttgtgtgttgctcgttgtttttatcctatcctggcaccaaaatgaaccactttttgagaagacaccagtgcccactacagaggaaataacagaatgatc

SEQ ID NO: 149882 - DNA, 407 bp, Homo sapiens
ccctgtcttcttgccagctttgcctccactcctcccacacctgccaggtcctccttccctctcccatgacctgggtggcagaccagtgtcctgactctaccctaggcccatttcttgtcctcctcaaggccacagccttttcctaggtggtctcagctgagttcacctgcatggcctcggctgggtggctcaggcccctctgtgtaagggggaggcgggcctctgcccaggcttggggagacaaggaatgagacaaggaatcccaagtcgtgcctgccgcaaatctccagcttctgtgaagccctcccctgaaatcagcctcggctgccctcccgcatctgcaagctcatatccgaagcagcttgcctgagacccatgcaggactgtctgggtcagctggtgcttca

SEQ ID NO: 149883 - DNA, 280 bp, Homo sapiens
tcgagtctggaccggtgttatcgatgcacctgggtttgtctgcagttccaagatggccttactttattgtatggtcagtacagttgtatctagtcctcatcaggttaggcctggaactccccaacccctgctacaaacagcaaatcagggttctctgtgagtttaacattatttccaaacaaagttctcaaggctattttttaataaccaccaataattatcaaaacaagtttagaaatgaatctagactttgattttgacagttgttcctcacaagtca

SEQ ID NO: 149884 - DNA, 505 bp, Homo sapiens
ggaggacaaaaagagttgggcatgctgaaggtcagtggtctgaagataaaattatcccttgattctcacccctgtgttcccattactgaatgttagctccttgaggcagagaccttcgtttcattcccactaaattctttgaacctagaacagtgcctggcacagtgagagtgcccattaaatatttgtggaatgcctgagtgatccagtgatcttgggctgggcaggatactaattgtcttggacatggtttggagttggattagatcaaggaaatagccagcctggatgcttctaggagccggtcaggtgaggaaggggagaggcaggcagggtgagtacatttacttcctttgtatgtgtatggtggggataaggggtggatgcaacctagagagcctccaggaggtgcaggcaggcaaggatccattcattccacaatgtctgctgtgttccagtccattggtacccttcaaggatatgggctcagggaggccacattcat

SEQ ID NO: 149885 - DNA, 183 bp, Homo sapiens
taatgctttcctcagagaatttgtaaccaaaaaactgttctcataagactctgggattgaatttacatgggaaattaccatgggaaaccataacaaaatttatacaaaattaccatataatagaattaaaattccattatagtgaaatggaagtgagaaatagagtgaaaaatttccaaaaca

SEQ ID NO: 149886 - DNA, 757 bp, Homo sapiens
gtgaggaaagtgaggctcaaaaggtaaggccatttgtcacatagatggtaaataatggggctgagatttaaactccaattgttccggcttctagccttaagcccttttccatgcaacctttcatatcatcactgctggccatagaaaataactttaaactttgaaaacagctcttcatagccttgtccgaaagcaaagcagcttcctatgcatggaggtacaatagtccttcctctgactacacctccaagtcaagctttctctcctaccctcagccatcattcattctgagacacggaatcacacacttgagctgggagattttcgcagcacttaaggcatcaggggagaagcgagggtgacaataagatcttcaaattccttgacctcaaagaatgtagactttgccagtctttctatgcacaggccatggacttataaataactgaaaaatgggctgctgtgcctgatcctaaatcctaatgtgaccttgggacatagcttttgccttatcccaagaattctgaggcaggtggtagaagatgcagtggaggcagatgacagtcagtttcttgtggaactattgagaatttctgagacataaggacttttgctttggtcatctattcagttgatcagacttatcaaaaagagaaaggagatcctcctagaagttaggagaggggtttgtttcagtagagatcaggagattatgttttcctgaaaattggtgtcatgctacacataaaactggcac

SEQ ID NO: 149887 - DNA, 243 bp, Homo sapiens
cattgccagccccataagcccactggctcccagaagcggccccattgtgaggtgcgagtgactcagggtgcctggtatcatccctataaccagctccagctccagaggccttagcaccagggcatcttgtcccatccccctcacccactttgcttcctgccctcagagaccctggtcccatggctcctggacccccagagccatcttcatagcctccttctccaaaggcccccagggcctctg

SEQ ID NO: 149888 - DNA, 278 bp, Homo sapiens
agtctgtgtctgggtcgtgatcccgtgctgtcaccgtgagtctgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggttgtgatccagtgttgtcactgtgagtctttgtctgggttatgatccagtgctgtcactgtgagtttgctgctcag

SEQ ID NO: 149889 - DNA, 596 bp, Homo sapiens
agtcgcggagagcagaacccggcagcttcaggggctgcctgcgggagggtgttccctgctgtacgtgtgtgttcgtcatgggtgtgtgtgtgtgtgtgttgggggggtgcgtctgtgtgtgtgtctgtgtgtgtgcacgcgcagtgcctgtctgtgtgccgacttctgtctctctctcacgtctctctctctctctctctctctctctctctgtctcccttctcgctctttccgtggccctctctttctgtctctgtccgtctgtgtgtgcgtgcgcctcgggacacatgtgccctgtgcgccggagggtgggtttcttgcacgtcggcctttcttctggtcagcctctccccgcgtctctgcctgggtcgtgtggccggttggcagtcgtcgtcccggcggttccagtttgggggtctgtgaaggcctgggcaacgtgggcatcggcgtcggacccgcaggggttttcatcccctccccatccggagcagcctctttgctaggctggatccagacgagcgctccccaaccaaggacaacggcctcccaggcgctcatcgtccacccgcaggagggtgcccgcagagcttcaagaa

SEQ ID NO: 149890 - DNA, 553 bp, Homo sapiens
aggccgggattcgcggagggtccagcagcaggaagaaaccccaggaggaagaaacctcagacagatcgccggcgaggcagcgcgggatccagcctcaggcgtgcgcggacggtgtgcggattctgtctctctctcacgtctctctctctctctctctctctctctctctgtctcccttctcgctctttccgtggccctctctttctgtctctgtccgtctgtgtgtgcgtgcgcctcgggacacatgtgccctgtgcgccggagggtgggtttcttgcacgtcggcctttcttctggtcagcctctccccgcgtctctgcctgggtcgtgtggccggttggcagtcgtcgtcccggcggttccagtttgggggtctgtgaaggcctgggcaacgtgggcatcggcgtcggacccgcaggggttttcatcccctccccatccggagcagcctctttgctaggctggatccagacgagcgctccccaaccaaggacaacggcctcccaggcgctcatcgtccacccgcaggagggtgcccgcagagcttcaagaa

SEQ ID NO: 149891 - DNA, 565 bp, Homo sapiens
cccgcatctctctctccctttttctctcacgctccctcctttttccctccgtctttctctctccctccctttctctgcctcttcctccctctttgcctctctctctctctctctctgagcagctgttacctaataggctgttaatgatgatacagtaagtggaaggcagagtcctgggggagccgccatgatctgtgtaattggtctcgaaggagacagaagtatctaatatttacacaccagtattagtcctttgggaaccttatcttggctagaaccaagcagggaggggggtgctggctggagccatctccccccattgataccagctcagaaggtctttagttaatgggaactgcttcctccctttgggtgaagataccagggtccaggctgaggtcctgggaggtgtggagtcagtgctgagagtggttgattggaccagcctgcatgggccctgggcactgggcacccccgtggagttagtgctcaactggcaggtggagtcctggagcttccggggcgttatatgactagagtcccccaagagtgaggaacttggggc

SEQ ID NO: 149892 - DNA, 423 bp, Homo sapiens
gaccctaaagattgggatagagctatttagataaattgcaatgaacacccaaattccactcagtagaaacctacgctgtcagagtaaactcaccttcccttactgaagaacctgtagacttatggaagaatgctgactctcaagtgccaccccatcaactcttttgcttctaaacctataactgaactcaaaccttaagaaaaatacaaagtctaatcctggaggatatactatacacacaaaagaattttaatattttgacaatttgtgttagtgaaaactagaagaatatctttgggaattgattgtaagagtgttagaacaaggagaaagaaatacactgttggattcagctaggtttatttatatgagtgcactaacaagtaattttggattccatatattattttgaattgttaggaa

SEQ ID NO: 149893 - DNA, 465 bp, Homo sapiens
tactgtgctgctcactgtttaacttcttaccttctctttccctgtccttccgtgttggacagggaaacatttatcaaagttcaagaccatcaaagtggaaaagaatcctaaagatcatctggtctacctgcatcttttagacaaggaaactgaggcctgttggaggtagtgactagtgtaagttctcacagctagtgagtagccagacagaaccagacccacgatctccacatttctgacccggtgttcttcccacttctgcctccttgactagagtcccatgagatccactgagatctaccgtacatgttgattatgtacaaaggagcggaatgcaataaagtatacatgttcacagtcggatacaactttatcatctcataaatgtgacaaatctgaaatacagtagttactctaaatgtaaaaaatattcacaaagcttactgccatggaatttagaagagc

SEQ ID NO: 149894 - DNA, 390 bp, Homo sapiens
tgtcatgggccctgttcgttctgctgtgaggctgactcagggccaggtgccgtgcaggtacacagtaggagttgaactctgatcaagggcttgttttgtgtttatcttccttgctttgcaagttccttgagggtgggtctccccgaatcttgattataaacctgcaagagccttacaaaatgtcctgctttttgtggggtctccagaaaggcttgtgattggcagagggggcaggagagcagtgaccaggaagaaaaaaggctgtggccactggatggcaaaggagggctgtgcagggaggtatgtgtgacatgtggtctctggaggccaagctcacccctcctgcctcagtagcaagatgtgtgtagctgtcaggctctaggcaagaca

SEQ ID NO: 149895 - DNA, 556 bp, Homo sapiens
cgtcatagctgactcttgagggtaaaataaagccaaagcgaacgacttacaatctttataggtgtttcgtgattagtaatttgggtttcaaggggcttccttatgtggagaggggacagaaaagaggaaattaaggtaacaacacaactattcagtaagcaaattaagtgtttccatgagtgaatgagaagcgaaaatgagtgtttatgcacttgttaaccattaaacatgagagcaagattccccaaaagcaagactgtctgcacagaaggctcagtaacatcaaaaagctgggagtcctcactggacaatctagccaggtatctctctttgagatttacgaactagcagggagctgggcaccttggcagtgagagcgaagtcctgttctgcgggcacagggggaggagaccaggggtccagcaggaagccagcagcacatgcagggccccgcaagcctctgaccactcctctatgctcccttcccctcagttcagaggcacagcaataggaattcccagaacagctcccgctgagtaacagcagccagaattcc

SEQ ID NO: 149896 - DNA, 443 bp, Homo sapiens
gagagatctggagtcagagggggaagtcaccgactcccaatccagtgctgctgcccagggacagtctcaccatgccacgctgtcctaaactagcctgtggccctcgccccaactacacgcccatggcctgtcactgtaccatgttcatgccaggcacagctaagtcagggtggcaggagccacgccaaaggcttctccagcttgagggcatcatctctccacacccctcagttattgacagaaactggcacacgcactgccagaccacgctgtccctaggaggaggcagacagaggtggacgcagcccacaggcttggctggaacggcgggttccagaggtgcccgctggccgcccacagtgaagtctggtaggggtggcactctccccacaggttacccattggaccagagctcatccacccagagcccatttccatgacaa

SEQ ID NO: 149897 - DNA, 149 bp, Homo sapiens
tatccacacacagcccaaacacataaagtctcagctccccaaagaccaagttagcagaaagcgaatgaagccacctcctccggtggccaaaaacctcatcatagagttgtccttttttctcctttataagactgcatttgccctactgc

SEQ ID NO: 149898 - DNA, 286 bp, Homo sapiens
tgggagcccaggcaatggttgcctggataccagtcgtgtgactgttggaaatgatctgggagggccgggagggccggagcaggcatttaagagtcagacaaagagaaagcgggatgctaacaccagagcagacaggtctggcaggcgtgcctctgccaccagacagttcctttttgctcttgtcaggaaggtgccaagtgactgctggctgaccgtccctagaccccacttcagctgtgtcaccagtttccccaggcatctgtcatcccaggtattctcaagcagg

SEQ ID NO: 149899 - DNA, 342 bp, Homo sapiens
  misc_feature (43)..(43): n is a, c, g, or t
  misc_feature (47)..(47): n is a, c, g, or t
catctggggttctggagggaagcgctgtctaggcacacggcanggcnttagtaacagcatgctacactgctcgaggtacagtatgtcccatcgccctgtgcaccgtagagacctcagtcatctcaaggaagaatacatttgcttctccttagaggcgttcgaactagaagctatgcgttacctctgattattaatcttggttgtatcaaaaggttcaatctgaaccctttctttctgtgtttctctacatattcccttagggaaattacccactgaccactaatatattacagagctttaccatttagaccatgttttcaattgatccttgctttaataaaa

SEQ ID NO: 149900 - DNA, 626 bp, Homo sapiens
cttgtaccggtgtttatcgatgcacacctctgtgtggggtgtggcaggcaaacaaaatggatcttgaattcagtagataatatgaacttacagttcacttgcagctagtccagtgctgtcaattaagggctcccaatcattggtaactcggaagataggaagacaagctgttttgggctgacagttagtgtcttagacaaaccaaagaataggctgaaacccatgttgctttgtagtaaccatagtaatagcattaagttactactcagaggtacaagtgagatttgtgaaaaatgtctccaaaataatgagttatttcgtctaccccgcttttcagtacaggacatacatttccgcctactcctttttttggtctgtttataacccgaggataagagcctttggttacttgagggtgtgattgaagcagcttgcttctctttaccctctgtgtgcacgtctctgagtttgtgggaatgagggataaaagaggaagtgtaatgatctccctcacccctaccccttactgctcaggcatttggtgtttttttactatgtttccacagttccaacaacaaatatcattaagagggccagtctctcccaggcagtgtggctgaaaataa

SEQ ID NO: 149901 - DNA, 739 bp, Homo sapiens
  misc_feature (48)..(48): n is a, c, g, or t
ccaacgagatctactattttataaatataaaacaacgcaagcccttgngaacataccaggaaagccaatagaagccacagaccccttgaaggaggtggattgccactgcaggctccattggacagccaaggaacttctagctccacagtgagagcctatcaaactagtaagtcacgagtgaccatgagccctggcttcagctcccagtggaacagcagccaaccagcctggaatacatactcctttccaagagccagcctgcactaccagtcccatgccagctatacctactgtactggacaccctgcttctagctccacagtgagagcctatcaaactagtaagtcacgagtgaccatgagccctggcttcagctcccagtggagcagcagccaaccagcctggaatacatactcctttccaagagccagcctgcactaccagtcccatgccagctatacctactgtactggacaccctgctgtgaaagaaatccaagagtgaacaagaccaagtcttgctcttatggaacttctattctagggaatggggaagttggttattatataaaaagaatataaatacaaagaagcaaacaagagagaaaattataccacagtgttatatgctaagcaaaataaattctacacagagacttaaaataaatataatttaccgcagaacacaaacacaatcatggcctccgttggtctcagcggcggagcctctgtttccgttg

SEQ ID NO: 149902 - DNA, 668 bp, Homo sapiens
  misc_feature (48)..(48): n is a, c, g, or t
ccaacgagatctactattttataaatataaaacaacgcaagcccttgngaacataccaggaaagccaatagaagccacagaccccttgaaggaggtggattgccactgcaggctccattggacagccaaggaacttctagctccacagtgagagcctatcaaactagtaagtcacgagtgaccatgagccctggcttcagctcccagtggaacagcagccaaccagcctggaatacatactcctttccaagagccagcctgcactaccagtcccatgccagctatacctactgtactggacaccctgcttctagctccacagtgagagcctatcaaactagtaagtcacgagtgaccatgagccctggcttcagctcccagtggagcagcagccaaccagcctggaatacatactcctttccaagagccagcctgcactaccagtcccatgccagctatacctactgtactggacaccctgctgtgaaagaaatccaagagtgaacaagaccaagtcttgctcttatggaacttctattctagggaatggggaagttggttattatataaaaagaatataaatacaaagaagcaaacaagagagaaaattataccacagtgttatatgctaagcaaaataaattctacacagagacttaaaataaata

SEQ ID NO: 149903 - DNA, 488 bp, Homo sapiens
atttagtacatggagtgaaatgaaaagaagctcaacgcaggtggaaggtgatgctccgtgtctcccggctctccaggcagtagtcattccttggcccctcagatcctccattttgggtgcaatggtgtggctgtactttgtggagaaacaaatttgggcagctgagttcagggcttcacgtggaggagcgagaagggggccacccaatgcagctttccctggaagcgtgtggactggggcacagttgttgcaggatgattggctgccaccataagtgggcaaaatcatgggcagatcatcctgcttccttaattgaatcttggaatgcattcagaatcttcaacccaggggtctggcactcaaggcgtttgtgacctggcactgactcagtacgctctagccaaattgggcactcatggctcccagatgctgtgccaagctttcacctgcttatctttgcttgcactgttcctgccacctggagggac

SEQ ID NO: 149904 - DNA, 365 bp, Homo sapiens
tatttagaaaaaaaaagttactctgactgcatgagagagaatacacaaaaggcaggtggtaggaccaagctcaggagtccagacacattcttaagcatttaatcataacaagggagaaaagcctttgcttactgtgatagcaaaattgaagagaatccatctctccataatcaaagctgctcttttaattaaattcagaagaattcaaatgctcatgcttaagagatacctgtatcagtggctaaagatgataaaattagattagcaaggcaagactgagaaaccaagatagcccagttttcttcatatatgtaggaatagaagggattgacccaaataaaataaaataaaataaaataaagagg

SEQ ID NO: 149905 - DNA, 153 bp, Homo sapiens
attagaggatccgggcgattctcctcctcctaaagatgataaaattagattagcaaggcaagactgagaaaccaagatagcccagttttcttcatatatgtaggaatagaagggattgacccaaataaaataaaataaaataaaataaagagg

SEQ ID NO: 149906 - DNA, 219 bp, Homo sapiens
tggattttaatctaggaactttatgtagatgatcaggtatcaaatagacttgttgaatatttgcattggttcccctagaatttgggtcacattgatatttctaaaattaaagatgtatgtgtttgtgcattagggctggcctatctaggactgccaaattctgtgggaattcttttttccatgacaagaccaatgtttggatttttctaagcatttcag

SEQ ID NO: 149907 - DNA, 726 bp, Homo sapiens
ctgctccacgctaatttatttccaatgaatgtgatctagtttataattcagtttagaacagtcaaacaatctccaggaactttgtaggcatggtctttgcagttttcaatatttgcttttcctaccagcacatgacattttttgaacaaagggagaataacttaactccagagagaatttacccaggagataaaggaaaaggagaagcccagtgtagggcagaagtgttctctcttttgtgtaggccactgttgtacctacaggccccaaaacgcagaatcaagatcactgagcacaaaaatggcaaaggtcacattcagaagtgaggagctattttccagcagtagggccattccaggacacaggaaattttggttagacgctattatgactgacagaactctgcagtactaaggctgcaatgaggcaaaaaggtggcttttgcatctctctaaaagtgatcctgagcttttgcccaaatattttcttataaagagtcctgaagcttcctgtggagatgaatatctgtgtcaagccatttctgcagatgtttcttcacagataatctattggctgaactttcattggtgatcttttgatgggtgactcagataaattactttcattaagccttccgtaatgcatggtaattcttttccaagtttcctgaggagtagtcagtcctaaattcccctaaagtcagagcgtcactctccatggtaaggc

SEQ ID NO: 149908 - DNA, 448 bp, Homo sapiens
taactttaaaaataatggcagaaatttttccaaaattaatgaaaactataaaaccacatatccaagaagtccagtgaatcccaaacaagttaagtatgaataaaatacactggtgcacatcataatcaaatattaaatgctgctatagaaaaatgacacatcatatacaaaggaaaaagataatgttgatagatttcttattagaacaatgaaagccaaaagacaatggaacaaaatcgttatattgctgaaagaaaaacaaaatctctcaacataggaatctgtgtttaattaaactactcttcaaaaatgacaaaacctgacataattcttcatgagcagtctacaagaaatgataaagttcttcaggttaaagaaaattataccagatgaaaatttggatcaacacaaaggaacgaaaaactagaagtggtaaatgtgtgagtaa

SEQ ID NO: 149909 - DNA, 246 bp, Homo sapiens
gaaggatttcactttctcattctaaagctgatggggacaagatgagataaccagacattctgtaaattcatgttttaaaatattaatggtatgtctagctctgcaatatttggattgtagtatagcagtacataatttgaattttaaataatacgaaacatgagaaatttttctttcaaaaaaatatttccattcaacaaaaaactatatctacttgtctacaatctaactagtatgccatgcttg

SEQ ID NO: 149910 - DNA, 829 bp, Homo sapiens
gtcaaaataatctatatatattaacaaatgtcatgcatctcattcctgccccagcccccaatatataagtctgaaattgtccttcgtataattgatatgataaaactgaggtttttttagagtgggatgttttcataaaaagatttgtttctgttagtctgtgaaactctaagatgcctaatagattatagaatcctgtcataatagtgtgttattatacaaccttagcataatagaaagggttaaacctaaagttgatacctttttttctaaatttaactctgctccttaaaggcagataaatctctttacttctctggtcttgttttcctactctataaaagggagataaattgtaatattctaaaatcaggaggaaaaaccctacatatatttagctaagcaatagaagaattagagaattggacaaggcaacctctcagttagttgctgtgcattctgagttactatgatttttttatctcctttcacttcaagttattaagcattcactcactgaacttttatggccattcactgagcaaggcactgatgttgtaaagatgattattcctaccttcatggagcatgcagtctgctatgaagagtatcagtgatataatgttggtgatgttataaaaagatatcaagatctctgggagaatagatgacagggcctttattatgcatgaaaggcagagagttagacacatcctctgagaagaagtgaccctaaaaggggagtggagtttgccaagcagacaaagcaagggaaggtgttacacatcctgcaaaataaaaaggtagtggtaaaatcattaaaaaaaaa

SEQ ID NO: 149911 - DNA, 293 bp, Homo sapiens
ctcctcatccattccctgagtctcggcacatcactgacctccctcccaggatgaggagaaatcctgggtagaggtggttggtagcagcccttgtgcttaccacgcttgctggtcttaggatgagctatccatcattttgggcacaatgctccctttgtccaacaatttgctcctgtctcaatcattctccctctcttattccctgatctctccttttaaaatcacagtggtcatagtcactcacttgcaaataataagaaaagatggctccttcataaaggcactaaataagg

SEQ ID NO: 149912 - DNA, 567 bp, Homo sapiens
agcacttactacattttactctatggcatagctatttggaaatgtcggtctttccatagattgagattagataaatgaatgatgaaatcaacagatagcacataaagcaccttctaaaaagaagaaagaaatagattcaaaatctcaatgctaaaaattctgtaatatttaaaagactactaactgattaaggcctgcattatatgaatgccttatatcacagggataaaccaaggtaagtcttcatatgattccttaaatctttcactttatcaatagcttttctaagaagtcatgtaccaaactttgggatcacttcatttatcacaacacaaattcaaaactgaactgagtactaaacaaaactgtccagacaatttgttattatcccctaaccaagtctaccacaacccgtgattctgctaaggtggaacaacttcagtgaggaaaaggaaatacgtcaagaagtataattcaaatgaatgatatccctggttttaaggctctaggaatgtaagagtctccaacttagtaaacacaaacaacaggcatctaaaacctgtctta

SEQ ID NO: 149913 - DNA, 233 bp, Homo sapiens
gcccacttgtccatgaaaaggcaacagcccaggcacaatgccaccccgcccccaatggagagcaactctgggtctcacctttgggggagagggtccctgggtacctcttttacctccctctccccctccccaagcacaggcctgcttgagaagagcagctgctttccctgccctgtctggtcttgagggaaccaagccccagcctgccatggcccagagagacgcaggtgtct

SEQ ID NO: 149914 - DNA, 409 bp, Homo sapiens
catgaactctggccatagaggaccactagctacaacctgaaacacagtgggcatttgcacactgtcttctcttttactacctttgcctgcagtgacctcttccacctccaaatagttttctttctcattctttgaggtctttcaaaacaattatcacccctttaactcaatgccccaagcataattacttcttcatctgctggccttattacctcactctgtattacatactttattacatacatgcagagtgaggttaataaggtaatgaggtaataagtcacactgcattacacatggttttttattttctttctctctttacaggattcacctgtgaatcctctaaaatcatgaaaaacgaatatgtgcatgtacacatttttatcacattcttagaaacctctaa

SEQ ID NO: 149915 - DNA, 391 bp, Homo sapiens
aggaagaaatagggcagagccagccctcaaacacggtgagggaagaggctgcagatttgctctgggcagaacacagtgtgctggaccacacacttgctgcacagcgaccccactccacaagcaacagggactggagctgcaacttcctctgggggctgaaccccaaatcaccctgcgggcccagcagggcctctggggatggggaccacctgctgcttggcatcaccagtggggtagttactgtgagctctgcaaaggaacgggaggtcctcatcgtacggggtggaacaggacaaatcagcttccgggaccagggcagcttggctgagagcctagaggtgacttgcatgaagaacggtggaatatggccggaaggaacgcgctcacctac

SEQ ID NO: 149916 - DNA, 325 bp, Homo sapiens
cattgttccctttttgtttttatgcttttaatacatatgtatacatccatgaaccctagaatattatatcatttataatagggcgacatgcatccagctaatctaaacatagtatatgtccttaaggaatatggaaaaaagaagggaagccaagaacacatccttcttttccttcaatggaaattaccaactgatcctccaagagactcctgtactggactaagaggggaatctcaagcttacagtattcttagcaggaaatctgacatacatctcagatagaacatccattatacaaattggcctataatttagggagcacaca

SEQ ID NO: 149917 - DNA, 674 bp, Homo sapiens
gacggagtctcgctgtgtcgcccaggtaggagtgcagtggagcgatcttggcttactgcaacctccgtcttccgagttcaagcaattatcctgcctcagcctcccaagcagctgggactacaggcgtgcgccatcatgcccagctaatgtttgtatttttagtagagatgaggtttcactggccaggctggtcttgaactcctgacctcagatgatctgcccaccttggcctcccaaagtgctaggattacatgcgtgagccaccactcccagctatggggtaaatcttttataaaaacaaacaccttattccaaaggcagaagaaatcatttttatattatcattttatattatctggccaatgctatataatatccaggtccttccatttgcaaagagaattagagttacctggggaggtcagagaagcctctccacctgcctcctgacatcctggacaaggacagaaggagctgaagtccaagagcttcctttggcttttcacctttcctgtcattctgccttctccccatccattccttaaagattcatgcttactctctcccacaggactggctccaggtgtcacagacacctgtctggctctccaaatgtggtttggggacctacacctagccccctaatgccagtactgagatgacttctggcagag

SEQ ID NO: 149918 - DNA, 648 bp, Homo sapiens
agtttgttaggagttcacccctccacacaagtactggaagtcctctgaagtgatttttaattttggaggttgtgttatactttttctcttatcagttagaactttattatgatatagcaaattataaaaaccattatgctatcatattcataaatgaaagagagaactcaaaactaaattttcaaatatctggccatgaagactaactgcttgctacacgggattaacaaaacaatgagaaaatgtctagtaataattataaaatataaaacctttgttaaaatctgatttgaagcttatgtcaaagggccacctcatacagaatcttgaagacattaaataaccccaaatagagatccacagtaaacttatgtggtagtaaattttactatactagacaaatctacagtgagattttctgtattttaaatattttctgtatttctgtattttccaaactgaatggtttatttagttaataagtgataccctaacttatttaccatttccagaaaataaccaagtacagaatacttactgataagctgcaatgctcaaatccaaatattcaacagaaaaaaatttacctagcactacagtgaccaacaagtcaaaatcatttgtgacaggttctattgaatatatagt

SEQ ID NO: 149919 - DNA, 379 bp, Homo sapiens
ctttttatgctggtgtctatttcccattaaatcaaaagttatgtcaatttcaaattaatgagaagtaagtataaagatggaaacttcccctcaatattactatttttatgcttttggagcataatatttagcactgctcaaatctggttgtaaataatttctttcattgatgagatgaactgtctttactttttctcctgttactatatttactgtttcccttttgtttgatgtcattggaaaatgaaattgccagatggtttgcaaagagaagtgagcaacaactctttttttaaaaaaaagtttctttatatacaaataagtaagcaagcaagcaaaaaagtatgtttgcttaaaaaaaagaaagaaaaaaaaattt

SEQ ID NO: 149920 - DNA, 424 bp, Homo sapiens
tgggttcacgctattctcctgcctcagcctcccgagtagctgggactacaggcgcctgccaccacacccggctaattttttgtattttttagtagagacggggtttcaccatgttagccaggttggtctctatctcctgacctcgtgtggcttactcttttactctcttaatcgtgtcttttgatgaatagttatttattttaatgaagtccagtttattgaccattcctttaatggtttgaggtatttgtgccctacttaagacatttttactcattccaagatcatgaaagtattcttatgtcttctttgtgaagctttattattttgccttttatatttaggcctaaaatccatctcaagttagtttttttaaacatttagaaccatttattgaaaagttcattttttaccattgaattgt

SEQ ID NO: 149921 - DNA, 341 bp, Homo sapiens
gaacagggtaataactgaaatgagctgacgctgaggcatccttcgtttatcttggtgcctgggtgcctcttcgccatttctccttgctggaggagagaggctgaggtgtggcttctagtcccactcttgcctgaagttgctcttttaggtcccacttccacaggcaggcagggagtggactagtgtgttacagaagctgggtgggtgacattcagaaccccagtgtggctttggaaacatccacggagtcctggctaggtgggcagggagcagagtccaagtgcttgtggctctgtccatttctctcctcattgtccttttacctgtaggtgtgcctgcac

SEQ ID NO: 149922 - DNA, 442 bp, Homo sapiens
tgtacatgtccctggaagggtatttggatgtctgttcattatgaagatggtgctcggtgtgtctgtagaggctatggagatgaggggacgagtagaagtcagccaggaagctaggcatgtgggaatgggggagggcccttttctctaagagtttatccttgccctcctgaatttcttgcttcaggacgtaggagtcagcaagggggttaaggtgatgcttggagaagctgcagcggtggggatctgatcgactcagtttctcatgcttaaagatgtcattgatggtctttctctcttccgagggcttgcttctgaaactctggacgtgctgaatcactgatggccggctgaccgccatatggtcagtgctttggccatggtgggtctgggacaaactggaacacaagtcatccctagcaatcagtttctttttgctgatcaa

SEQ ID NO: 149923 - DNA, 299 bp, Homo sapiens
atccgagtggttcttgtaccatctctgaactgcttgcttcaagattggcgatgcccgtcggggttaaggtgatgcttggagaagctgcagcggtggggatctgatcgactcagtttctcatgcttaaagatgtcattgatggtctttctctcttccgagggcttgcttctgaaactctggacgtgctgaatcactgatggccggctgaccgccatatggtcagtgctttggccatggtgggtctgggacaaactggaacacaagtcatccctagcaatcagtttctttttgctgatcaa

SEQ ID NO: 149924 - DNA, 1127 bp, Homo sapiens
gggtttgggctggcatctagccctctggcctggaatcctgtcttctcctgcaacaccaaaaccgggtttgtttgaaataggtagatgacaaacagtggaaggtgggtaataagcctgaggaaataaaatactagaaacagcctgcaaactcattaacagctcctgagggaggcctctaagatcactgtattgagcataagagaatgtggagccccgtctaaactccagaagggtctaggaggctgcaggaagcctgggtgctcagcgtggggtacccagtggcctggctgtcttatgctggcccgattgtcccagcctggagatgagctccatgtcctgtgcgtggatgagcgctgcactatgtgtggatgaggatggctctgcacaccagcatgtgttagattccagtggcttcaacttgtcctgagtactatctgcatgtacatattcacacagaagaagtcagggctttgcctttaaatataaaaaggtgacatgataacaatattaatgtgagccttctagatttttatttcagcagtccccagggagggtcaacttcacattagcccacaaggagcacagagataacacagtgctgacttagtggacgctttcatcagacagtgtggtgagccagtgcccttgccaggaggccccacccactctgcaaagtcaagtggagttgtgagactcctccaagggcacagtaataacagaggtagctcgcccatacagaatgtgtcccctgatctttatgatttccttccatttcacagtcacattctatgggtcactcttactgttacccccattttacaggcaaggaaattgacacgaagaagttgagtagctagtaagtggcaaagtcagagtttcagctccatcagccgactccacagccatgggcagattatacagggctgatgtttcactttgtcttgtctaacctagaagtgacctaatgtcacaactaaaaagcacatggaaagtctcacagtcatggaataaccatgtaatttgtacatttaggtaacccctatgaacctccacctccttatctaaaaatgcagactatagtacctgccattcacagccactgtgcagttttgaagtagtaggcttta

SEQ ID NO: 149925 - DNA, 366 bp, Homo sapiens
  misc_feature (1)..(1): n is a, c, g, or t
nctaggaggcatattctggataccttacctttctagtttgcaggactgtgtccagagttggttccttccggtgggttcgtggtctccctgacttcaagaatgcagctgtggaccttcctgtcgcaggtggcgtgatttgatttgtctgaaggcaatgaaaggatacacagatacaccgaagcctcccaaaagaatcctggttccaagactcaagaagatggattaatgtttttccattaattgttggaatttatgccattttttactatatgccatcaattttaaagcacttctgaaaagacataacaatctaaatgagatggcattttaaattcataaaaatatagtattttcctcaacttttat

SEQ ID NO: 149926 - DNA, 530 bp, Homo sapiens
cggcctgcagagctccaccgctgaggccaacgaggccacgactttattcagtaacaagtttaaattttcagtgaatatactgtcaagctaaataacagagagagattctccaaagataataagtgtattcaagagtaagcattgtagtgtggaacacacatgccgagtaaactatgggcacattcaaagaggcaagggaagacagcaatttttaaagctaaaatggggagggttacataagttgttttgaaacaattatccttgcttacagggatcaataataagggtggcatcagtccaaggttaggcaggcaactgctgggcagatgtccttgcagaagtttttttttgcataaggttgcagtggcctttgtacaaggttgtggttttggtatagtcttttgtaacagttcttgttttcaggcgattgagcattaagaacccttccttcatggcctttcccagctccattttgtcacaagtgactctatttttatcctgacaactttcacagtattcaatgagggttt

SEQ ID NO: 149927 - DNA, 479 bp, Homo sapiens
caggatgactcatgcctgtaattccagcactttgggagcccaaggctggtggatcacttcaggccaggagttcaagaccagcctggctaacacagtgaaaccccgtctctactaaaaatacaaaaattagccaggtgtggtggggcatgcctgtaatcccagctactcaggaggctgaggcaggaaaattgcttgaaccaggaggtggaggttgtagtgagccaaggtcacgccactgccctcctgcctgggcaacagagcgagattcttatctccataaaatgaaacaaagcaaaacaaagggagagagaatggaggttgcctgttactgcatcataatcttgtttatgctgactgatgcattagaggtactaatggcatgagaggaacaatttcctgagacacagtttactgaccatgaatttcctcaaaaccccagagagcaggcttctcaggaggagactcagtgtggaatccct

SEQ ID NO: 149928 - DNA, 491 bp, Homo sapiens
agcatgatggggttctggtgagggctctctttctggctgtcttgctgtgcctcacataatggagagtgagcaagctctttagggtctcttctgataagggcactactcttatgagggtgagggccccaccctcctgaacttcatctaactctaatcttttcccaaaggcctcatttcaaatatcacactagggggttagcgtttcaacatacggattttgttacagtctttagtggagacaagcaggattaattaatttatggaaagcatgcagcagtgtgcctctaacataaaaaatgtcttatttaacctgtcatcatcatcatcattttgacttggcctaaaatttcgcatatgggctagtggagaaaaattagaactaatttggtgattttgctcttcattgatggaaagtatgtgataacattcattaagaagggcaatgtaggaagaaagagacagttgtaggcatgctgtggagagatgcttcc

SEQ ID NO: 149929 - DNA, 524 bp, Homo sapiens
caggagtcttgctctgttgcccagtctggagtgcaatgctgtgatctcggctcactacaacctctgcctcccaggttcaagcaattctcctgcttcagcctcccgagtagctgggattacagacacccaccaccacaccctgctaattattgtatttttagtagagacagggtttcaccatgttggtcaggctggtctcgaactcctgacctcaggtgatccacctgcctcagcttcccagggattacagatgtaagccactgcacccagcccaaatggtgtcattttaaaaaaaggagaggacacacagacacacaggcaagaaggccatatgatgatggggacagaggcaggagtcctgaaactgccagccaaggaaagctaagcatggctgggagccatgggaggctctgaagaggcaaggaaggattctctccttgagcctactgagggaccagggctctaccaaaccctgattttggacttctggccttcagaatggcaagagaataaatttctgttgt

SEQ ID NO: 149930 - DNA, 495 bp, Homo sapiens
agtcacaaagcctcaattaataggcacaaggaatgtgtatttaccagttgtgtatctggagctaaggaggccatcagtaccatgaagcctcattaaacaacgcattctgaattaatcagccgccaacacagtatgcctataacaatgacgggagtgactttgtgaggataaccccactactaaaattaagttttgattaaagttttttggttaagaggcaatcataaaaagaataaaagacgggaaaagattctgcaaaggagctatcctactggcctgaatgacaggcacagaatgctgtgaaatttattcactatcttatacttccgttgttactattagcatagtgagaggcagcatagggtgagtattaaaagtacagactcgggccgggcacggtggttcacgcttgtaatcccagcactttgggaggcggaggctggtagatcctctgaggtcaggagtttgagaccagcctggccaacatggcgaaac

SEQ ID NO: 149931 - DNA, 436 bp, Homo sapiens
ccttggcagacaccactcttcactgccatcattgtcaacagtctcgctgccaactttggaaggtgtctttgtatctggccctgttgggttcattacaaagggaatcctcctatgaacttgtgtatacccttagaaagcacctgtcttcaaggagcttaaaatctcactggggagacatgacataaaacttaacatgctcatccagtagcaatctgcctcccacctcacctgtcaaccaaaactggtcttctaaagctaagagtatcctctcttgtttaccaaattcatctcctaacttcacactgtcttggctacacacctctgtaggtctttgccctactgagcatgatctacatgaaactcaggaaaatttaaaggctttgactcagacagacttaggtctgtcttagctctgactctttctagccgtgtgacc

SEQ ID NO: 149932 - DNA, 835 bp, Homo sapiens
cccgaggtcgccacttggctgagctgtcccccacagggacttcaggtccctggttcctccatccccaatctgcttccttccattcccgccagaaccagggtattttccaagggcaggtttcacatccacttggggcagggatcttaagccacagtaagactaatttccaggtcccaggtctcctgggaaaccccaaaagactgagccctgccgagtgagaacattctctgaagctctgataatcaaaacagcgtggcacctcacaagcctcagcagcccagaggcggaccacatgtataaaataacgccatgtgtagtatttaacaaaggaggctccccaatccagggagggaaggattctttcacaaaaggcatgaaaacagttgcttccatgtttggaagcagttttgttttgttttttgtttgtttttttgatacatggtcttgctctgtggcccaggctggagtgcagtggcatgatcacagctcactgcagccttggcctcatgggctcaggcaatccccctgcctcggcctcccgagtagctgggattatagatgtgcaccaccacgcccagctaattttttaattttttatagagatggcgtcttgtggccaggcacagtggctcacacctgtaatcccagcactttgggaggccgaggtaggagggtcacttgaggtcaggagtttgagaccagcctggccaacatggtgaaactccatctctactaaaaatacaaaagttagctgggtatggtagtgttcgggcccaggtatagggggtcagcccagagctgtgggtgaaaggacaggcccatggtcccacctgtg

SEQ ID NO: 149933 - DNA, 485 bp, Homo sapiens
ggtgctatacccagtgtggaggtgactgaggttaagtcttgccttcagggacttcacagccattgcaagacaaacagttacaatgcagagtgcaaggacaatgatggaagtagagagtgagatggaaacttagggaggaggcctttgactaggcctgaggtagccagagaaaacttttggaaggaagtgatgctgagctggatttttaaggatgaattggaattatctgacataaaacaaaaggtgatactgtctcaatatttctgaatacattttacctcctttttccaatctattttaagagtaaaaaaaatgtcttcaggagaagacaagatattaatgaataaatgtcccttctgattactctgacttataaatggattttcagtatgtttggtttgctaacaggaggacattcccaaattgtattaaacaaaggaaagatatagcaaaaaacagttacacactggatgtttagtcatcaa

SEQ ID NO: 149934 - DNA, 228 bp, Homo sapiens
acctacaaagctaaaatatgctgttgcctcattttcaacaatttttaaaaattagtaggtttttgggaggctgaggcgggtggataacgaggtcaggagtttgagaccagcttgaccaacggtaaagccccgtttctactaaaaatacaaaaattagctgggcgtggtggcacgtgcctgtaatcctagatactcaggaggctgaggcaggagaatcatttgaaccca

SEQ ID NO: 149935 - DNA, 299 bp, Homo sapiens
aatgtaaacacttgctaaagttgagtatcgtttctcatgtgagttctattatagccttctgtgtttataaacatgtcttgagcatgagggagaaatgtggtaacctttgagtccccaagaaaatgttcatttgttttctctgtgggctgaaattaagataactcagcatccttctctgagcatcccatatccctcttgcttttcctagcaggcctgggatgatgcccagtttgccatttcctaattgttccatcctcttccagtagagtctgttatcttttgaaaaagtacagttcata

SEQ ID NO: 149936 - DNA, 424 bp, Homo sapiens
tccactggcttttcgaatcaaaatctgcaggctaggtccatctatatcaggacatgactaataacgggatatttatgaatgtggactacatgggcacgagggggaaaaaatcagtgacctgaaggctttttgctaaggatctttgggatgaaactaaagaaaaatcatagtatcttcaaactaggaagatcattttgtctaacttcctcattttgttgaagagtaaaccccagagtttaaataaactgggcccaagttcacagagacagtactaaatctgcttctaaggagaacctcccttagtcctagtacctgagtgaagttgtcactggatgctctgtgaagccagctaatggtctcaaccactcttatgaatttaacatatcaaaaataggtactttttttccttttcttttttttttct

SEQ ID NO: 149937 - DNA, 557 bp, Homo sapiens
gaacaagcaagcataaagctttgagtgcctgcatggatggagtgaaaggaagcaagccttgggcatttattaagcacctgctctgtggcaggctgtgttctttcacacatgctgtgtctaaacccctgacatttgccaggcatgggttctttgcaggatttacggttaccttatgaagcaggtgttctttcaccttacggaaaaggcagcagaagcctggggagtttttaattggtccagtggtgggaattggagggcgaagcatgtcttgaattcagcttctgacccacgcctcctggcccacagcttaagttacataatgtttctttatgttgatgtgcaatataaatctccaatcgcacggctgggaagtgcttttgactggctttgttgcttcagctgtcctaaaggaatggctttcataaacacagagagggaattggattttcgctttgcgatcattcatattacagaagtggggaaggtcattgccacaggaatcccattaatccctgaagctgtgggtcctcaatgagttggcctgccttaggacagca

SEQ ID NO: 149938 - DNA, 135 bp, Homo sapiens
agaagggatggaagaagatgggtaagtcacttagaaggccccacatggtagctctcttggggccatggatttagtatacagcagtcagaggaagaagggcaacacagttagctgcacagtctccgtgttctgatg

SEQ ID NO: 149939 - DNA, 176 bp, Homo sapiens
gggaacagtacagggtgagggagacagggacaagagagggaccaagatcatttagaactctccctttttactttatctctttctttttaaaacatttttatttgtagagacagggtctcgctccatcactcaggctggagtgcagtgatcacagatgactgcagcctcgaactcta

SEQ ID NO: 149940 - DNA, 219 bp, Homo sapiens
cccagactctgttcttaatgacgacgttatgctgcctcttgtttacaaggagagcagtaagaaaatgaaccagaaaggagtatagaaaattcacctgtgacttccagtccacacacaccaaccttactctcatgtagcgtgtgctacaaattctaactcatagtaaggctattccatattaatcataatatcaagtaatgcctatatctgctttaaaaa

SEQ ID NO: 149941 - DNA, 490 bp, Homo sapiens
agatctcaacctcctggggtcaagtaatccttccggttcagcctcccaagcagctgggaccacagatgcatgccaccacaccgggcctttaaaagtttttttgtagagctgggttttgctatgttgcccaggctggtcttgaactcccaggctcatgtgatcctcctaccacagccccgagtcgcctggaattacaggcacacgccactgtgactgactcccaaaagactccttatttaaggaccgctgacaatctacagaggaaaatgaataaaggacaaatactccttccatcctccattggaattcccagataccaagaaaacaaaacacagtagagagatcttgaaagaaaatgcaaagcttcgctgaaggctcccagttcagagtggttcacaagtccaacacacagacaagtaaacgaggcacattagcaatgtattcgttttgaagaaagcacttaacatgaaacttgcttatgaaatcctcc

SEQ ID NO: 149942 - DNA, 135 bp, Homo sapiens
aaacaagtcaaaacatttttaaaaagaaagatgtaattctttgctcaaacccaagccactataattttaaaaaacattccaaatggaaaacattcattgatttattaaaaataaagactaggctttccccccacc

SEQ ID NO: 149943 - DNA, 122 bp, Homo sapiens
ggatgaggtctagggtgtgaccttgagaggatgggtcgcacagtcactgaggaagaggaggtcaacgaaccagaggctggaagggtcgcatctggctatggagatgactgtaagctatcaca

SEQ ID NO: 149944 - DNA, 217 bp, Homo sapiens
cttggaggcgtgactggctccttgaatattgagaatattgagaagggtaagagcaacagtaggagagtcctaggcccatgaaaggaattaggagcctatggggcacctgggcattggttcctgggtggcaggtgtggatcagggtcagatccctgtatagctattggaaacagaagtccggttcccaaattgatagaattaccacagagggcggtag

SEQ ID NO: 149945 - DNA, 566 bp, Homo sapiens
cagtgtgtttaaatgcagaggaacactagtctgtgtgcccgtgtacacacagccttactagagtttaaagaaattgcttgtaactttcctttctgattagttatgatcaataagatggttttggttttaaatataggcaatggtcacaaagctggacttttcacagctgtgtcagaccaaactaaatatttcttgaaaacataatttacagggcatttgtataaccttgcttataagtatcttacaaattttgcactttagctatataaattgtactctttaataggcattagtaggatggtgggggttcttttggttatatgttaagccaccaaacctcttggctggaaaagatgtagcaataccatttaaagaagtttgcacgagttgtatacagatttcagagaattccatcctattctaaaacttcatggaaatgaatttggaatctcacagggaagtaaacagctccagtctttttttcactgataatcacatgtgacagatgtgtttacgtagaggaacaggaaccttaaaaaaaagttttttactttcacatgattcaa

SEQ ID NO: 149946 - DNA, 396 bp, Homo sapiens
cctctgtcattccaaggcttttttcatcaggtgacaggcctgtggttgtcattccttcagccactgttgcaggtcattgactaaggtcaccgtagatttcaaggtccttgtgtccttgtggaagacagcagggggctgaggcatggctgggactcactgtggctcttggcaggacgtgccttctttctggcacggttcaggtcagggtctctccatgcttggtaacatgcccaggaggcccacctgggttccatgcttttctttccattttcactcacgtaaccagcatcccttgtgaaagaggaaactcaggcccagagagattggcagttcaggaccaccgtgactgtagtcgtattttgaagtcaaaccagctccagcccacatgtctagctc

SEQ ID NO: 149947 - DNA, 292 bp, Homo sapiens
aataaaacagcctggtaccaacctaacgggatgtggacacatctccaaagcctagctagtcttacccaactatattccctatttatcctcaaatgaaagaaaattccctgtctgtatttttagtaatcagacttattcctctctagaatatattactcctccattttgtgttgaaactgttcagattagcctttcccaatgtaaccacacaaaatcctcctctgcatatacccattcttaattctataatccagatagattttcctgaactaggtatttcccaattctatat

SEQ ID NO: 149948 - DNA, 402 bp, Homo sapiens
gccaggggctcttccctcacctctgacggatccagtaggtggtcccagattctcactctgacccacccactatgacttcaaagctgctgtgcacagttaccactgctgggcagaccttccagaatcttccagaacatcccatgattcagagggaagacaccctggatgagggagtcctccatttttccgagcaaatgcacgtgttctacacacaactccaggtcattctccagtggtacctgagccctccatagggcccctgtgagggatcctgggtggggacttctgtgactgtgacagctggcctctgggccaccttttccagaaacagcattcctgattctcccttgggaaaccatcacctccacattcagggtggcgtctgccagcctggcccagccc

SEQ ID NO: 149949 - DNA, 307 bp, Homo sapiens
tcccacggggctgggttcatagaaaagggactccgtgtctatagtggccttctacagacgaggcaaagtggggattaggaagagactaagggctgggcctcaccagaagccacaatccccgtgttatctctttgggaccctgggaccctgggacccctgacgagtcaccttagctctctgatcctcacactgcttacatgtaaagtgggctgtggcagggacccagtgggacagtccctggtgcatgattatgctcctgggagagacttcaacacccacgacccacccactgctgtagctcatattc

SEQ ID NO: 149950 - DNA, 499 bp, Homo sapiens
gaggtgatctagaggatcccagttcgacggagactctctaacccttatctgtaaaatggggaataataatattatctctctcataaggtttttatatggattaaataaggtaatgcatgtaaggtacttagtacaatgactgtcactaaatgaaaatgggaaaaaaataagcttaaaaagtaggatagactatctacttctaactaaggataaaccaatgacaaaagttctgaattaatattaaacattaaagcattaattaaattgtaggttctttaagtatatgtgtccagtccctgactctccatcccctaaaagagaaaacagcattggtgaggggatggagagtcagggacgggatagatatacggagagaatctacgctgtaatatacggtaaagcgaatgatatgaggtcagggggccggaccgagctcaacctattctcagactttgattggctaacaaacccggttagctggcgtggagccggtcgtgga

SEQ ID NO: 149951 - DNA, 801 bp, Homo sapiens
cttattatcctttccagtcccacttatctgaagagccagattctcaaagcacaagtaaccctagaggggagtatcaatgggaaagctatggattccttgccacatccccgttacagaactatgcttgttaagaacagaatctcaagaaaacatatcaagaggttgaatgaagacatttctctcttctgtattcctgatctcctggggttacaagagcacaggtttaggcaaacatagccgatttctctctaaggtgtctcttcacttcttgatgcactggagatccttgtggaataatacattagtgataatgagtgttgggtgctcacaaatcacccacaattcattggctgaaggcatcttaaacgtggactttttggcttttattgtctttagctgcttcttttaacatactttagtttgagtgtacagatttggggttttcaaacttgtttttaattaaggcatggtttatttttattgcttgagataaaatgcagtctgagggtcacaaatgtaatttacaaaataaagtgcatctgggcagaccataagaaaaaaaaagaacagaaagcctaaataaagagtgggccaggattcttaagtttatttagtaacttcttggagaataaaaatcccagcacctgcattataaaaaagcacaccttataagtgtccttctcttcgaaacacctaagtgaactacactgaattatgaactaactaatggtttgtaaaaattcgccttgagcaagctattgaagatactaaataaacgaggctgagacagagtctgaggaa

SEQ ID NO: 149952 - DNA, 1089 bp, Homo sapiens
aatttattgggtctatctttgaccacgtgataccacttacctgattctatgtactgattaatgtatctaacagttttatagtgaaagtactttttaaaaaagtatttgaatggtcatttctatttttccccctttgctgtacaagttaatttttactcatcttttgctgtacaaattaactttcatcaatacaaataagaggctagttttaagtcaatttatttgtcatgagcccaggaacaattaaattctataaagtaatgtattaaaatagtacactttaaaaattattttccttctttttttctctttaaattttaagaccatcataataaattatcattacaaagtcaaacatactatatactactatcagtcaatggggaaaaaataagtcatatgttttatggtaaaatgctgtaatagattgggattgtcaaatttgcttgaaaaaaatcacagcagtttttagtttttcttatttgtagattacacgttactcagaaaataagtatcaaagtgctaaaagtaataggtgtaattgctgttatttgtcaaaatcagtttacatttttgtgggaaatacagaatcacaaatatttctttctggcattatgtcctgagttaaattctagaaaatttagcaccttttatactcatatagctgtgacaataactttaaatatgtgaacattaggaaattcaaagcttatatattcttagaagctaattttgaccacgtgcgcaaattatttttcttttttagtagaatggtgcattttttgcctttgtatttgaaatttagctaaattacaatagctatcagaactacaattgaccttagtaatttcaaaaccatagttataagggttttaagttgatttttaaaaatcttaagatatgatagggatttcaaaactatgtgtgtgtatctctgatagggaggggttggggcacagactaataagtgtgccaaaaatctgtgaatccaaatgtgtaacaagtgttgtctgaataaatgtccacaaatccatgctattattggttaacaaaaaataaattcactttgaaatgttgctgaatttggga

SEQ ID NO: 149953 - DNA, 272 bp, Homo sapiens
cagagtctccctgtgttgaccaggctggtcttgaactcctaagctcaagtgattcttctaccttggcctcccaaagtgctgggatgacagatgtgagccactgcacttggcatcatggagtcttgatttgtagacattgcattaaaacttattttggtaagggctgggtgtggtggctcacgcctgtcatcccagtgctttgggaggccaaggcgggcggatcacaaggtcaggagttcgagaccagcctgaccaacgtggtgaaaccccgt

SEQ ID NO: 149954 - DNA, 507 bp, Homo sapiens
tcagccctcagagcacttcatcatgtctggacccgtgaatggggtggcagtgccagggagtgggttctcccagtgtctggctccaacagctggtttactgtgatgattctatttgtgttccctgtgttctgtttggcttggcagcagggaaggaagagggcaacaggttcactccagtttgtactgggttgttcctgcagccacacccgggcattaaagcaggcggcttgcaccctggatgcctttacctgggggcccttggtgtgcaaaagcaaagcgtgggaagtatttccttttcatgggccagccaggtgtggctggcatttcacctattcctgtattactaacgtcatccagattcaggtcaaagggcaggtttcctagactcccatcacgctgagatccgggatcaggggatggttgatcaagtccatttgggctggattacctgagttcctactactcatggacacttaactcctgcttctaaaacaaaatctgtccagg

SEQ ID NO: 149955 - DNA, 152 bp, Homo sapiens
ttgttcccctcaatgcccttggtgcctctaaggtctgacttgggtatcagaggacaatgatatcctctggggcctgcgttatgggtccagggcctcaggaaccgggcttcacaggggctgggagaagcagtgaagaccttccatgctagacc

SEQ ID NO: 149956 - DNA, 733 bp, Homo sapiens
agcctgggcagcatagcaagatcctagctttacaaaaacaaacaataacaacaaacaaaatggtaattcataggcatgagttaaccacatatggggtggggatgccctagcctcacaatggccctatgagggctttggactctgaaagcgaagtcaggtgcggtgttgtgtgtacctgtggtcccagctgctcaggatgctgaggctgaggcaggaggccaagactgcagtgagccatgatcctagcactgcactccagcctgggctggagtaagaccttgtctcaaggaggggtggggcttgaaagcgggccctgggccccacctcctcacatccccagtccctgatagcaccatcatgtgggcgatgcctgtgtaaccccaagctgtatcataaagctggacaacaaagacagctccctggggtccactgtaatggaccaaggtctgtgcgtccttcctttccacatccccctaaagttgacaacagtagtacatggcacgatggatgttgtcttggcagggagcttataactcagcttaggccagatccaggagggcaggtcagtccttgaggatgggcagcagggaccgaggagggcccttggcgtcccccaaccttcgtttttctcaccccggggataaggctcagaggcggtgccagggaaaggcccactttgggcctactcacagcagcgatattgccactttccagaggtggtgaactgattccc

SEQ ID NO: 149957 - DNA, 262 bp, Homo sapiens
tgttgggattataggtgtgagccaccatgcctggctttttaattttttgatgcctatttttttttcctgcagtaagcaacaaatattttatagaattatttgggcagtgggattatttttcttcgaattttctgttttaaacattttaatgatactttctttctctgacattttgttttgaaaatgttcagatccatcaaagaatggaagggaaagtacgataaacacttgtttagtcgtcaccgagactcaccagtggtta

SEQ ID NO: 149958 - DNA, 4313 bp, Homo sapiens
  misc_feature (1880)..(1880): n is a, c, g, or t
  misc_feature (1943)..(1943): n is a, c, g, or t
tccggatgctgagacaggagaatctcttgaacctggagggtggaagttgtagtgagccgagatcatgccactgcactccagcctgggtgacagaacaagactctgtctcaagaaaaaaaaaaagaaaaaaaaaagccaggtttggtggtgcacacctgtagtcccagctactctggaggctgaaatgggaggatcacttgagcccaggagtttgaggctgcagtgagctattattgcactactgcattccagcctgggtgacatatcaagacctgtttgggagaaaaaaaaaaaaaagaaaatgcagacagaatgtgggactgggcaccaacaacatctctacaagaggtgaacaagacggtcctggtctttgccctcacgcagcacacggaccagggtggtagaccagagtgtgccctcagtgttatttccactaataacgacgtttcctcctctgtccttcgcagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggaggcagatgcagcgcagctacacggctcctgacaagacgggcatccgagtctactatagtcccccggtggcccggcgcctcggagtccctgtggttcatgacaaagagggcaagatcattatcgagcccggcttcctcttcaccacagccaagcccaaagagtcggccgaggctgatgggctggctgagagctcctatggtcggtggctctgcaacttctcacggcagcgcctggacggaggctcagcgggcagcccctcggcggccgggcctggcttcccagcggccctgcatgactttgagatgtcaggcaacatgagtgatgacatgaaggagatcaccaactgtgtgcgccaggccatgcgctccggctcactggagaggaaagtgaagagcacatccagccagacggtgggcctggccagtgtgggcacacagaccatccgcacggtcagcgtgggcctgcagaccgacccaccccgcagcagcctccatggcaaggcctggtcaccccgcagctcttcgctcgtgtctgtgcgcagcaagcagatctcctcctccctggacaaggtccattcgcgcatcgagcggccctgctgctcccccaagtatggctcaccaaagctccagaggcggtctgtgtccaagctggacagcagcaaggaccgcagcctgtggaacctgcaccagggcaagcagaacggctcggcctgggcccgctccaccaccacgcgggacagccctgtattgagaaacatcaacgatggactctccagcctcttcagtgtggtggagcactcagggagcacggagtctgtctggaaactaggcatgtctgagacgcgggccaagcccgagcctcccaagtacggcattgtgcaggaattcttccgtaatgtgtgtggccgggcaccgagccccacctcatcagcaggagaggagggcaccaagaagccagagcccctctccccagccagctaccatcagccagagggtgtggccaggatcctgaacaagaaggcagccaagttgggcagcagtgaggaggtcagactcaccatgctcccccaggtggggaaggatggtgtcctccgggacggagatggagccgtggtccttcccaatgaggtaggtgggtgggatctgtcctttctcttagtaggtggagttagtatataaggtccaagctnttttggtttttaagttcagagatatgggccgaggtgggtggatcgcctgagatcgggagttcnagaccggtctggccaacatggtgaaaccccatctctactagaagtacagagattggccgggcgtggtggcatgcgcctgttgtcccagctgctctggaggctgaggcaggagaatcacttgaacccagtaggcggaagttgcagtgagctgaaattgtgctattgcactccagcctgggtgacagactaagactccgtctcaccaaaaaaaaaaaattatctatctgtctgtctgtctgtctgtctgtctgtctgtctgtctgtctatctatctatctatctatctatatatctatatatataaaataaaaattcagggatatggccatgtgttccaggaagttcttatgctggtctaggatagagttggaaggtcccagacctggaacaacacagacctgatggtcacatggtctgaattccaagagactagtgagcatggcttaactagcagcttttgctccacccaccagagactgccagcatcccctccagggaaggggccttactgctctcctgccacccagtggtgtgctagagccagcttgtttggcttgcaggagccaattgtcagcatctctgtgggtttttttttttttattgtttttgtttttgttttgagagaagtctcgttcttgtcccccaggcttgagtgcaatgactcaatctcggctcactgtaacctccgcctcctgggttcaaacaattctgtctctgcctcccaagtagctgggattaaggcacctgccaccatgcccggctaatttttgtattttttagtggagacggggtttcaccatgttggccaggctggtctcgaactcccgacctcaagtgatccgcccaccttggcctcccaaagtgttaggattacaggcgtgagccaccgcgcctggccacatctctgtgtttaacatcaccttggtaccttgagattggccacagtgggaggatttacagcataaaaattggtaaacactacaaatcggggctcctcctatcactcctggaaaactaattgttaaacattagcgggcataccacttctccaccccatcaagacttcacacctaagtgctcacatttcctctgagaatctttcacaccccactcctgctatcagtttcttataagttaattagtaaaccttatttgaatgttagtgagcattatttgaatgtgttagaatgtgcataagttaactttgcagaaagggaaggaaatgtatttgaaggatggcatgttttataaaacccaagagtaggaacctgacaacctcagcagcttctccctgtcttcctctcctctctttaagcttcaccctctctgatatcatattcctcctttttctctgtttctctctctgttgcatttgcacaaggactgggtgggctgtcccagctctgactttacaacatcttccagttcaagcccctaggagagactgacacaaatccctgtctcccaattccacatttctgaaagaaggaaactctgattggtgcagctagaggcgagtgtaccccttggtccagtctatggctgggagtggtaccatgtggtctgctgtggggcacagagacatgagaagggctgtgtgtggaatgggctgtgatagactcaaacattctacttttctattattgtacgtttaggtggtttctagtttgtccctactgcaaataatgctgtggtgaacatcttggtgcaaaatcatttttttacatttcagactatttccttaggtataagttgcagaaatgagattaaaggataatagaatataaatgtggccgggcgcggtggctcatgcctgtaatcccagcactttgggaggccgaggcgggtggatcacaaggtcaggagtttgagatcagcctggccaatatggtgaaaccctgtctgtactaaaaatacaaaaattagccgggcatagtggtggtcacctgtagtcctagctactcaggaggctgaggcaggagaatcgcgtgaacccaggaggcggaggctgcagtgagctgagatggtaccactgcactccagcctgggtgacagagtgagactccatctccacacaaaaaaaaaaatataaatgttttaaagttatttgataaatactgccaaattgtttttcaaaagtgtgccatatctacagcttccagcagtgtgtggcgagtgcgttacttttctatactctcactcagctggctgacatttaaaaacatcttttaaatatttattccttttttggccaggtgcaatggctcatgtctctaatcccagcactttgggagactgaggtgggcagatcacttgagctgggagttcaagaccagtctgagcaacatggtgagagctcatctctacatt

SEQ ID NO: 149959 - DNA, 3530 bp, Homo sapiens
  misc_feature (1880)..(1880): n is a, c, g, or t
  misc_feature (1943)..(1943): n is a, c, g, or t
  misc_feature (2920)..(2920): n is a, c, g, or t
  misc_feature (3040)..(3040): n is a, c, g, or t
tccggatgctgagacaggagaatctcttgaacctggagggtggaagttgtagtgagccgagatcatgccactgcactccagcctgggtgacagaacaagactctgtctcaagaaaaaaaaaaagaaaaaaaaaagccaggtttggtggtgcacacctgtagtcccagctactctggaggctgaaatgggaggatcacttgagcccaggagtttgaggctgcagtgagctattattgcactactgcattccagcctgggtgacatatcaagacctgtttgggagaaaaaaaaaaaaaagaaaatgcagacagaatgtgggactgggcaccaacaacatctctacaagaggtgaacaagacggtcctggtctttgccctcacgcagcacacggaccagggtggtagaccagagtgtgccctcagtgttatttccactaataacgacgtttcctcctctgtccttcgcagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggaggcagatgcagcgcagctacacggctcctgacaagacgggcatccgagtctactatagtcccccggtggcccggcgcctcggagtccctgtggttcatgacaaagagggcaagatcattatcgagcccggcttcctcttcaccacagccaagcccaaagagtcggccgaggctgatgggctggctgagagctcctatggtcggtggctctgcaacttctcacggcagcgcctggacggaggctcagcgggcagcccctcggcggccgggcctggcttcccagcggccctgcatgactttgagatgtcaggcaacatgagtgatgacatgaaggagatcaccaactgtgtgcgccaggccatgcgctccggctcactggagaggaaagtgaagagcacatccagccagacggtgggcctggccagtgtgggcacacagaccatccgcacggtcagcgtgggcctgcagaccgacccaccccgcagcagcctccatggcaaggcctggtcaccccgcagctcttcgctcgtgtctgtgcgcagcaagcagatctcctcctccctggacaaggtccattcgcgcatcgagcggccctgctgctcccccaagtatggctcaccaaagctccagaggcggtctgtgtccaagctggacagcagcaaggaccgcagcctgtggaacctgcaccagggcaagcagaacggctcggcctgggcccgctccaccaccacgcgggacagccctgtattgagaaacatcaacgatggactctccagcctcttcagtgtggtggagcactcagggagcacggagtctgtctggaaactaggcatgtctgagacgcgggccaagcccgagcctcccaagtacggcattgtgcaggaattcttccgtaatgtgtgtggccgggcaccgagccccacctcatcagcaggagaggagggcaccaagaagccagagcccctctccccagccagctaccatcagccagagggtgtggccaggatcctgaacaagaaggcagccaagttgggcagcagtgaggaggtcagactcaccatgctcccccaggtggggaaggatggtgtcctccgggacggagatggagccgtggtccttcccaatgaggtaggtgggtgggatctgtcctttctcttagtaggtggagttagtatataaggtccaagctnttttggtttttaagttcagagatatgggccgaggtgggtggatcgcctgagatcgggagttcnagaccatgttggccaggctggtctcgaactcccgacctcaagtgatccgcccaccttggcctcccaaagtgttaggattacaggcgtgagccaccgcgcctggccacatctctgtgtttaacatcaccttggtaccttgagattggccacagtgggaggatttacagcataaaaattggtaaacactacaaatcggggctcctcctatcactcctggaaaactaattgttaaacattagcgggcataccacttctccaccccatcaagacttcacacctaagtgctcacatttcctctgagaatctttcacaccccactcctgctatcagtttcttataagttaattagtaaaccttatttgaatgttagtgagcattatttgaatgtgttagaatgtgcataagttaactttgcagaaagggaaggaaatgtatttgaaggatggcatgttttataaaacccaagagtaggaacctgacaacctcagcagcttctccctgtcttcctctcctctctttaagcttcaccctctctgatatcatattcctcctttttctctgtttctctctctgttgcatttgcacaaggactgggtgggctgtcccagctctgactttacaacatcttccagttcaagcccctaggagagactgacacaaatccctgtctcccaattccacatttctgaaagaaggaaactctgattggtgcagctagaggcgagtgtaccccttggtccagtctatggctgggagtggtaccatgtggtctgctgtggggcacagagacatgagaagggctgtgtgtggaatgggctgtgatagactcaaacattctacttttctattattgtacgtttaggtggtttctagtttgtccctactgcaaataatgctgtggtgaacatcttggtgcaaaatcatttttttacatttcagactatttccttaggtataagttgcagaaatgagccacngtgcctggcagcagcacttttgatcattatttctgtttattggtaatagtaaaaaattagaaactacccagatgtacataaaaagtgaattggggccaggcacagtggctcacacctgcnatcccaccactttggaaggccgaggcgggcagatcactagaggtcaggagtttgagcctgaccaacatgctaaaatcccctctctactaaaaatacaaaaattagctaggcatggtggcacacgcttgtaatcttagctacttgggaggctgaggcacaagaatcacttgaatccgtgaggtggaggttgtagtgagtcaagatcgtgccactgcactccagcctggggaacagagcaagattctgtctaaaaaataaaaaaataaaaaaagcgaattgggtatataaatcagttatttctatctagtgaaatggtacagagacactaaaaaagaaggcgatcagccaggcatggtggctcatgcctttgggaggcatgagcacccaaaggtgctaattccagcagtttgggaggctgaggcaggaggatcgcttgagcccaggagttcaagaccagcctgagcaacatagtgagaccctgtctcaaacg

SEQ ID NO: 149960 - DNA, 250 bp, Homo sapiens
aaaccaggcaaatagaaatagaaaatcagaaagaggtgacagagaagggtagacagagtcaaaccagactgaaccactgtggcagatgggggaactcagagagataaatggagatgaattagagtcatgtcagaagtacatagtggaggccgggtgcagtgactcccgcccgtaatcccagcactttgggagacgacgagaggggaatcccaggagttcaaaacttgcttagccaacgtggcaaaacccc

SEQ ID NO: 149961 - DNA, 281 bp, Homo sapiens
ggatggccaggcctgcaggtggcatgcactcaacaagtgggccgtgggtgcacatggacaggcggccagcgtgcaaatgcccctgccgtctctgcagtcaccagacgtggcagaagcctctccctcggcctctgtcccctcgtcatagtcaccgtcctcaatgctcccctctgtaagcatgccagtttcctttcccaacctggggaaatctaggtcacttctttcttacttttttcattttaattttctattataaatgatgcctcctttctgggctgatg

SEQ ID NO: 149962 - DNA, 176 bp, Homo sapiens
agaaacaccaaaaagtatactttggaaatttgaagaagtgggagacctggctggaggggtgagggaaggtagcatggcagaggcaccacttgagctgggtcttccttgggaagagatgtaggatttgtacagacaagtgacggagaaggagatgactccgggaagcaatacgcagc

SEQ ID NO: 149963 - DNA, 471 bp, Homo sapiens
tttagagaccagatgaaacactacccaaaagtttctgacaaatttaagaggatatataggccaaaaattaagatggtaatgagaaagtttaccttgctatatacaggggatcttgagatgaaagtgtaggaaggaacatgggaggttttttaaattttgaatattggaagggctaacatatggaagagggcatatctgttcactctggagggcagaactcaacctacaggtagatgtgatggtgatgccaacttgaattctgtaataagaagaaaactccttgcagtctcagctacttaggagactgaggcaagatcactagagcgcaggagattgaagctgcagtgagccatgatcacaccactacactccagtctgggcaacagagtaagaccctgttgctaaaataagttttaaaaaataaaataaggctgggcacggtggttcacgcctataataccagcgctttgg

SEQ ID NO: 149964 - DNA, 707 bp, Homo sapiens
tgaaaaggagaaaagaagtttttatttcttagggttacagcctgccaggtggccaacctgcaggttggcctctagtcaagaccaaagacaggcaccatgaaggaggaggggttggggtaggacatacatattcaacaggttacaggaggagttacgaatattcatcaaggggtcttgccacatgggcattgaacaaacgtgcatgtaacatatgatccatgttcactttagggtggagacaacattcaaatgcattgcaatcaggccgtacatgtcaaaaggtcttttcaggacatgaagtcctgacagtgtgcagcctctggaatcattccacagtcaatggtcttcttatatgaaaaaaagctactgaaatcagtctcttgtccagtcaaagctggagtcatggcttgtggaacagggggtcacttaatcagggtccagcagtggatgagctgcaaattctttcactagtgcttatctccaggccagtgcttatttagctgctagagaaagacaaaaaaaaaaaaaaaagctatggcagtgagaacaagcttattcttcaagggtaggtaagtgacttaaacctcgcctgccatgggtttaggttctgtttataatttgatatcgtattgtcagagagtctgttctgccattcttataatctgtattttaacatctatgctggtcagttgtgtctaaaccccaaa

SEQ ID NO: 149965 - DNA, 791 bp, Homo sapiens
gctcatttgaggaagaggagagagggcctcccaggcagaagggacatgagcaaaggcctggagccatgaacaggcctgatgtgtccagaaaacggaggggaggatggtcccggggtggggtgggcgggcgcagctggaaggctggcgagatggatggaggcccggcagcgggaggcctcgcccaccctatctgggagcccacctagcctgggagcctgggactcatctcctgggctctgaggggcccacaagaggtgttagtagcatctgagtgacatttggtcactttctctgggttcttatttctacttttttctaagtttaggagaaaagcacacatcctgtttgtcaggttctccagcactttggtctttccttcagaaatatcatggtagaagattggaactgcaattctgccggtgacattagagatccctaaacagagcctttcagaggagaagtgaagcctgtgtctgcttcttcctctcccacagctgagcctgttctcctcgccatcaggagaggaaattctcataataagatgatattgttggattaaaacaggtcgaaaagaaacaaaatcaatattttgcaatttgttttattatacagagctcctggactttgcttacagacattttggctcacttccagccccttgtgacaaatgactatttcagggagagttaagatgtctctcacaagctggaggaaatctccagaacgaattttagatgataaaagtagctgggcttgacgatttttgctcaggttaaaaaaaaaaaaaaaag

SEQ ID NO: 149966 - DNA, 608 bp, Homo sapiens
tttcaaatggcctgtcctagcatataaaattaaatttcactgtcaagtgatgactccctagatagactcagcagacttcccagggtttcctgattgagcgactgtaggtgtacaaagttaaaatccttcattatatatcaccagattttacattcccttattagtcttccacccaagggaattctcctctgtggcatactttagtgttttgtttcttttttctaagtgcctgagaatcaaaagatcttcattcttattctaggccaaccacattctaactgtggatacaggcatgtttaacctctgcagatactagcctcttcacctacaaagtagttaggcaatgtttagggttgccagatcaaatacaggaagcccagtgaaatctgaatttcagatgaacaaaatttttatagtataaatattttctgtatttctatctgagaaatttggcaatgctagctgaatgaattctcaggcccctcaatctcagcatggtcttacttcagaagatacaactaacaataacaatcacaatagttgaattatttaagatttactctgagccaggcactattatcagtgccccaacatatattatctaagtt

SEQ ID NO: 149967 - DNA, 187 bp, Homo sapiens
tcgccaccaaatacttttggatatagtgattgtttcagaattgccatgtcaaacaaggcaagctagtcaaagccaatccaatgacactcaaatctgggtgttttgtttttttttttttttttttgctttgattaaaaggaatgagaaattatctccttccactggatttgtggagaaaatgaaaatc

SEQ ID NO: 149968 - DNA, 124 bp, Homo sapiens
gacccccatcaacattctgacctcatctaccactttccctctcatttacctgactctagccacattggtctccttgctgctctttaaacaagtcaagcatccttctgcttcaagacctttgcat

SEQ ID NO: 149969 - DNA, 287 bp, Homo sapiens
tgaagtcagaaggttaaatacctcagcatactctactcctccaaccaggtccaaggatcaggccaaaactccctgatgtggtaaacagcctggcgctccttaccagttatgcaacccaccatcctacttccccacattcaagcaatattttagttcatgcacccagccatgctcagctgtttgtcattatctgagcaaccatggtctctgtcatccctatacctttacctactcttctctatgcccaacatgtggaattccccttcagctgtaagttggtcatcact

SEQ ID NO: 149970 - DNA, 174 bp, Homo sapiens
tgtggtcctggctacttcagaggctgaggcaggagtattgcttgagcctgggagtttgaggctgcggtgagctatgatgatgccactgtaccccagcctgagcaacagagcaaggccctgactctaataaataaatacatacatacataaaagataaaaacagttccctccact

SEQ ID NO: 149971 - DNA, 361 bp, Homo sapiens
gaaattaaattgtttgttaatgctacacaaatttgatagtcttcaaaaatccttctttactataagacaagtaatcattttaagtaaaaaaaagtaaagaaataggacttatcaataataatatttctgaaagtttataaacattgattcacatccaacaaaaccattgcagagaagcccataccttaatctagacagcataataaataataaatgtcctaaaaatttgtatatcaatttttggactagcaaataatctgaaatacatttctagaaacaagaaactcttttagctactcctctcacactggctaaaatgcttagatcacaggatgggcatggtggctcttgcctgtaatcc

SEQ ID NO: 149972 - DNA, 251 bp, Homo sapiens
tagctgttagtctccatcttcctcccatccatctgtgtctactcagaccttgagctccttgagggcagtggcttagtcatctttcagtccctgcagcaccagcacagtgcctgtcatgcactgtcacttagtcagtacttagttaaaggaactgaatagtttgtgcaacattccctgtctttgtctgtgttacggccctggcctcccagaattgtgggtgattcaggggaaatgagagccacatgtttctg

SEQ ID NO: 149973 - DNA, 525 bp, Homo sapiens
aacatctgcctaataaaagtctccataatcaaagttatgagacatttctacgtgctgggtggagatatttgctgtgttgtcagacatattcctactggattctttttttcatcctgagactttcttttacatgatcactaccaatcttctgtcaatctttcgacactgttctcctttctgaaaatgcatataggtggtgagcacacgtgtgtgcttttactattctttaaacatgtcatactcatatacttttatgtgtatgatttattgtgtaagaagaaggcacatgactggctgataaacaaggaccagctttatcaataaacaagaaaatgcaaattaaaacaaccaaatatgattccaaactcagcagattagcaaaatttgataatcctcacaataccaaaggcctagaggaactgtccatcttatagccttctattgggagtgtatatagttactgccactttggagggtaatttggtagtttccaatgaaaacaaaaattgtatgctatgtgatttg

SEQ ID NO: 149974 - DNA, 456 bp, Homo sapiens
tcagaaaaacagtgcaaagtactgaaaatttgatcccataaataaaatagtcagtagaagatttggaagataaggtcaaggaaatctacctggaagaggaaaaaaaataaaggtatggaaaatcagagagaaaatagaaaagcagaagatccatctaggaggcccagcaaaaggaatagggagtagaagaaatggaggagagtccattatcaaagaaataatacaaaatcacttcctaggactgaatgacctgcatctgcagagtttacgagcccattgtgcacccaatacaatgaatgaaaaaaggcccacgctaatttcatagtgatgtatatgaaggtaaaatcttaaaatttaggccaggcatagtggcttacgcctgtaatcctagcagtttgggaggccaaggcaagcggaacacttgaggtcaggagttcaaaaccagcctggccaaca

SEQ ID NO: 149975 - DNA, 611 bp, Homo sapiens
cgagaatccttttattaatatattcaggacctgcggcactttattttgaatacccattgtgacagccaatttttacctttgggggattgggagctatttaagttaaaaacaccgtgtgactctgctatgaatggaaagtttgtgtcccccaaaatgcttacgttgaaaccctaatccccaagtgatggtattaggaggtgggacctttgagagctaattaggtcatgagcttagagccctcattatgtgatcagtgcccttattagaagtgacagaagagtgcttttgatcctatcccacccaccatgaccctgccaacacacgtgaggctacagtgagaagctggctgtctgcaaaccaggaagaacctgaccatactggcaccttgatctcagacttcaacctctagaactgtaagaaatagatttctgtcatttaagctacccagtctacggttttttatgacagctcaagctgactaaggtcctaaaagcaacaatgtgtgtatgtgttttaaacaccagttgtgaagatgattcctgggatgttgcaacagcagacatgttcataccatatgactacaatttctccaagtgacttagttgttacgt

SEQ ID NO: 149976 - DNA, 260 bp, Homo sapiens
tttcccctctgcccctgagcacctgctgttacaagcaggtcagagggcctccaatgtcagcatctgcgactgtcccccgtgtcccatgttcccgaggccctcaccacctgtgctccagctcagacccaggagcacggcaggtggaggaacatcagcaggggagactgatgttccagactcttctaccccctgttcacctcttcatctatgcggggaaagtaacagcttccacccacctcgcccaacaaggaggctaagtg

SEQ ID NO: 149977 - DNA, 106 bp, Homo sapiens
ttgtgaaacgttaatagtgtaattttcttcttacatagagtgagattcattctatctaatctattgaatctacctaccttatctatttatctatctatgacaaggt

SEQ ID NO: 149978 - DNA, 199 bp, Homo sapiens
ggacctgggggcggggactgggtacatggagctgggtgagaggggttgggttttgactccaaatactgccagagaacatagaaaagcacttgaggttcccagagcagtgggatggacatagtacattaatttagaaatcagaaaccctaaatcagtacattaatttagggtgtggtggctcacaccagtaatcccagca

SEQ ID NO: 149979 - DNA, 263 bp, Homo sapiens
taaatgttggcaacaggctccagatcatccaacacaagtttaagctctcaacagcactcaaattaagtctaaataaggccaggagctttcatgaaatgcaatcaccggacaacactgaacatgggggatttctcaagcacatatcagcattcaagtctagaataggaagtataggaccttaatcaaaactgaaagcacagataatttgggtcagaataaaattacattctctagctggattcccaccaaaacaccactctcat

SEQ ID NO: 149980 - DNA, 412 bp, Homo sapiens
gagatacctggccagaagaggtccaccgcaactgctggcctgacacttgctctgacccaccgcaactgctggcctgagtctactggggcctgagggaattgtcgtgtgatgacatcacatttattgggcatctgctttgtccctggcactaggctcaaactcaggacagccagcccacatccagtgtttcctgcaggcctggcaccactcccaatgtcaacttgtctcatcctcacaacagtctttgaggtagcatcagtcattatcctgtgcacagaggagtccacggccaccatggcaaaatcacttgcacgaggtcacacaccggaattggaacctggttgtctgagtagacattgtccctgaactacactgggtgtctgggtccactccgttttggagatgagacctc

SEQ ID NO: 149981 - DNA, 203 bp, Homo sapiens
ctgggtggcagagtgaggctctgtctcaaaaaaacaaagcactgagcaaaatacgtgaaagaatagttttcaagactttggatatgaagcagtaaagaatggtgattcctgagaaataggaatcaaccgaagtatccctgtggttgtttcagcttactgcctagagagattttccagactacgtaaaacagaaaaggggaacc

SEQ ID NO: 149982 - DNA, 710 bp, Homo sapiens
attgaagaagtgaatttagttgaattgaaagaggctaccacacaggttaaaagctgctccaaaagagaggacctttacaataatattcttaggaatatagtattttgcagctctcatattagtccactgtaggctacttacctctttctttcattctgtcctctcctctttcatgaagagtcaggtaaaattaatgtaggtgctcctagctctagtgaccaattactaatatttcctcccaactgaatgtggcatattaacactgagagcaaagaacttagtgtctacaaaataaagttagggctagataaagtcgaatgatggccagccaccactaagagtatatgcctccttctagtggcatgctcagtttccatttaatagagggtgatattgaacatacagtgaccacggattgatcatatacaaacatctgaccaggttgaactctcaatttaacatctcaattttaaatttttacaagttgagtttgacaatattttttgttcaccctgtattgtataaaattattttcagaatttattgtctattatcaaaactaaaagtatcctttgactttgaggaaaataggaaccgttagccaccatcttcagaataatgtaaaggctgattgataatcatccatcttgtttttttcctgctgtctggattccaggggtgtgtgtgtgtgtgtgtgtgtgtgtgtgtgt

SEQ ID NO: 149983 - DNA, 114 bp, Homo sapiens
tccgtttgcccacaaagtcaggaatgtaacctgcccaaccctgccccaggcctcctgacactgaatgccctttagctcactcttcactccgttcattcactcaacaggagttgg

SEQ ID NO: 149984 - DNA, 515 bp, Homo sapiens
tctgtaggcctcactgcatgggggagatcctggggccctcagggcagcctcccaaccccttttgctctattgcttccgtaaccctaaggtacacagctgtagggttatgtatgagtttgctggattgaaaataccatatgcagccttagggtcatgtaggagtttgcccggactgccaaaacaaagtaccacaaaccaggttgctcattgtagcagaaattcacctctcatagtctgggggccagaagtctgagaccagggtgtgggcagggccatgctccctccatacaagggtccttcccggcctcttccagctctcggtggccccaggcttctggggctcacggccgaatcactccagtctctgtctctgtcctcacgtggcctccgcccagtgtgctctcttaaaagtccacttaacatgggattcaggcccacctggataatctggcatgatctcatcttggaatcttacatctgcaaagatactttttctttctttcttttttttgaga

SEQ ID NO: 149985 - DNA, 107 bp, Homo sapiens
aacctagggaatgtccgtgttccgggcccattccctgccactatttttagtggtgattgggaggaaggaggacatttcctggactccccttcagaggctggaaaaca

SEQ ID NO: 149986 - DNA, 215 bp, Homo sapiens
tcttgccaggactctggacctatgggataaagggtgcctcctaactttgatcgaggttgaggcacagctagggattccaactgcctacagaataggagcctttccacagtaggaaatatgtgctcaagcaggagagctagagaaccaacaaccatgagacgacaggaagatcctaagggcaggggtttctttttttttttttttggagatagagt

SEQ ID NO: 149987 - DNA, 1293 bp, Homo sapiens
cctgcccggccctcgtcctcaggcttccccgcgcccccaaaccagcggtgccccgcgccccctctcctctcgcgagaacatccccctagccagccagagccgggagcgggggcagtcgctcccgggcgggaagttctgggtttccccctcgcccgcgtggcccttggcgggcacccgaggcccgggagcggaggctcctcgcccagccgcttcctcggcgcatccgcccacccgccctggccgcggacgcgcgcgccgccaggccccgggcgtctcctccagtccgccgcggccccttggggagatgggcccggcgcgagggctcgcacctggaagcccacgaagtgggcggtgcccaatgaggtagggaccggagagcgcggagcagtccagaagccgaccccaccccctgcacctcggggaagagggaacccgggtcagcccgtagcaagaatcattcctgactataccaggagaccacggcagaccaaaaacacctctctgaacagccttccgcaccgctcgctgcaagcattcgtccacacacggtacacagattgcgggcggatcgtaattcactcttgaaatcacaccctttttagggatattcgttttcaatgactttgggaaagccacgaggtactacatttactacgaagagaccgtttctttattttggaagtcagtgactcctgagactgcattggggacaacttttttgcacaatgaccatattttaccatgcagcgcacttcagaaaattataaaagtttacaagttttatcgcttctggaaacacctgggcagcatccctattatcccgccacgtggctctagccttgttgatgtacctgttactttctcccactgcaacatttttgttaatgtctgtggcttctttctgcagaagagttcctcctcctgacatgcacttcattctctgcttttctatgtcttgacaactctcttatggtagtcattttcttatactgtagccccctggtatttatgtactgtgtggtattaatatttatacttccaggttcacatcttttatgaactgtgcatctgttgggattgtggacaggagtaggaaaccaaataaaagggttttttaaaaaagtcagttttctccgtttgtaagggaaacttgtttccctgaccaccctggagcaaaatttgccattttaagataacacagtccgtctgagagaaagtcctgcaccatgcctttccccttttcccatatttcccagcatgctatgagctgatgaataaacagactttgtccta

SEQ ID NO: 149988 - DNA, 244 bp, Homo sapiens
cagtgctccccatctttactcgcctggagactttactggacaaaagtctggcatgagaggggctgtctgctgttgcatccagacgacaaatattccttgtggaggaggagggtgaggacccattagaatccctaattgagaaaagcatcacgtctcttgggcaggaaggagtggctctgtgtgtgctaagatgctgttcctgattccccatgctcagaagctcattttctgacgattcctgatc

SEQ ID NO: 149989 - DNA, 828 bp, Homo sapiens
ggaagattgcttgagcccaggacttcaagacaagcctgggcaacagagtgagaccccatctctattaaaaaataggccgggcatggtggctcacactggtaatcccagcactttgggaggccgaggcaggtggatcatgtgaggtcaggagttcgagaccagcctggccgacatggtgaaaccctgtctttactaaaaatacaaaattagccaggcgtggtggtgggcgcctgtaatcccagctactcaggaggctgaagcaggaggatcgcttgaacccaggaggcagaggctgcagtgagccgagatcatgccattgcactcctgcctgggtgacggagcaagactctctaaaaaataataaggtaaaaggagtacctgtggatgaaagcagcagctaacagctctgtgattcagctagacctagatattgtgcccattccttcccctcagtccattttctgtagcccctttaaaaaccaaaaaacaactttgaagtcactttgggtttaaaataaatagtggtaatttgtataatcaataaagagttcactctgctcttactgaggggacttgtctgaaagctggcttagcggtgtccaggccagagaacatcctgtgtggactcttaacaatgaaacaggagccgcaatggacaaggtgttctgatctccaaacccagctcagggattgaagctaactaccgccactccttcctctctcgaagaacaaagagccagtacccagggctctgcccacccccgagaaggggtgcctgatttcttatgtctagggtggctcctctgtgcagatcagacaggactgaga

SEQ ID NO: 149990 - DNA, 318 bp, Homo sapiens
cacccactaactcccgttagtaaggacaggctggagaaaagaaatgataaatcctgccttactggtttttggttgtgagggaatggtaggataaacaaaggggtaaatgaacctggatatggggcctttggggtcatctacaactcttctattacccctctatagaatctgtctccaagttactttttttgtttaagcattttttttttgtatccatccttttatctcctctcttacaagtatgccctccttacattatacctggactattacaaatgtccccagttcactgctgtcttccagtttccttccactcac

SEQ ID NO: 149991 - DNA, 535 bp, Homo sapiens
cactggcccatttggtgcctccctcactgcgaatgctggactccacacgctgtctcccccgagagcctgatccagcagggtgtagacccctctgtgcccacgagatgatttataacttgggggtagtgggacaaggtatgaccatgcctgagcctgatagcctgaaagatgtctcaggagtgtttctagatatgcgtgtttcatatagtgtttcatagcgaggctggtggagaggagaggagcctgccttacaggagttggaaataactggttatcatgaccaggttgtctccagagggagaagatgggccagtgggcatctgagcgctcagcgatggagaaacctccttctgcctgtctcttctgagaagtcagggtgatgggcagggagtgtcttaaatctctgcttggccctttaaaacaggcagggccccagactgtactaaagaggaaaatcttgattgatttttatacagtgtcaacttgagaagaaagtaaaaggacattgttaaaaagcaaattcttgtgatttcag

SEQ ID NO: 149992 - DNA, 308 bp, Homo sapiens
ggacaggccaggaggtgtttgctctgacttacatgtttaaagaaaaaaaacaaaaaacaaaaaaacaaaactaattaacctagccccagggttctaagtctttgtactaaacgggtaataaaatcaaaccactctgcaggttctaggtcaggtttaaatggctaccaattcatgaaactgtaactggggattcaggcctgaggaatactaatcacttgtcgcagagtgaaacaggcccaacagaggagacgctcatatcagaaggtgagaaaaaggtgctgcaaatggtcattcctgagactttcaat

SEQ ID NO: 149993 - DNA, 507 bp, Homo sapiens
ggatgtttagtggcaaccatgcttctatccaccaggagacattagcatctccttagctataacagccaaaaatgtctccagacactgccagatgctctctgggacggacagagggaaggagggagagagagggagggaggcaggaatggagggagggaagagtgaagttgtcccccaactgagaaccactgctttagatagagctttctaaacttccaatggcttctgagtgtgacatgagtcccaagactagccctcttttttttccatccttccctccttcacctcactccctccttccttccttcttttccctacagtaagagctttgaatattgatacaaaatccaaagctccaagaaaaagacataggatactgaggcccagggaagtaatagatgtacaagcctggtgcacatcactgacaacccaggggaaaacagccagcaacatcaggttctcaagataggtcctgtctctggaaactcaatttcaggaaggcctgct

SEQ ID NO: 149994 - DNA, 122 bp, Homo sapiens
gtgctctagagtgttcccctgagacgaccttagatggaatgggtgttctaatttgaagaattccttaaaaggattagaataaatagggagaaacaggagactagaacttcagtgccaaatac

SEQ ID NO: 149995 - DNA, 285 bp, Homo sapiens
ataaaaagtgaaaaggccagactcatcttaatgcagaacaacttcagctccaaagctcctccgggttcagctgggacttctgttgcaattgcattaaagagagagggagtgagagagggagagagagggagagagacagagagagagaaaagagaaaagagaggagagaggaaagaggggaaaggggagaggagagaggagagagacagagagagacagagagaaaagagaggagagaggagagaggagaaaaggggagaggagagaggagagagacagagagag

SEQ ID NO: 149996 - DNA, 472 bp, Homo sapiens
cctgttagccatctgtatgtcttcttctgaaaaatgcctattaatgtcttttgctcatttttcaatccagttattagatttttttgctcttgagctatttaagttccttattatcccactcacttgaagtgcttcagagaccctgggagagagggcagcaatgttgtgtgttctttctctgcacagtctctttcccacatgctaacatctccgggctctttgttctcccagagctggctgaacttgttacaagaggttggagactgtatcaaagtgaacactgtataactttatttcctttccagagtagcaatatcacttccgcaagcagaagtttggaaacatctcataatcctgaattctgccatgctatgctctaacctgaggaaaagatgggcacctccctagtagtgctcagagcccaggagctaacaatggcagccacatctgtgcccgccctttctggccacca

SEQ ID NO: 149997 - DNA, 244 bp, Homo sapiens
acgattgtgttaatttctgggagaagtacaggcagctctgagtgcataaaacagatgtcctgatgtagtttggaaactggggaaagtttccatggggaagtgacctttgaggtggacggtgaaggattaacaggagttactaggtgaagctcacgggaacaatattccgggcagaaggaacagatgtgaataccttgaggaagaaaggaacagggccgcttttgggaacccagaagccaggaac

SEQ ID NO: 149998 - DNA, 169 bp, Homo sapiens
tttccccctttgaggtcacagaagaaaccagtgcacctcccttatttgaagaacagcatgagcctccacgggtttccggggggatgcgtgcagcctgcacaaggaagggcgttcaggaggacccgaagatgtgcccttctgaccctcaacctttgcacactcttaactg

SEQ ID NO: 149999 - DNA, 391 bp, Homo sapiens
tgttatactccgtataaagcagcaaaccccatttacagcctttagtagtttattttaggatgctcagaaaacattaaaaattgatatagccctgtttgggtcaaaaactgtacataaccagatcgaggtccaagagactatgatgtatttcttggcttctctcaagatctctgggtcccctaaagcagatttgactttccaggaggttcaactatatagaacaattcttgaatcattttgagtaatttggaatcagactactttacaagttcctacagtacagaccctgtcctcatctaagaggttgaaggttcatggactgcgttaacacttttgtcaaggttacatctaacaggactatatccgttggctataaaatgccaagaactga

SEQ ID NO: 150000 - DNA, 534 bp, Homo sapiens
  misc_feature (498)..(499): n is a, c, g, or t
  misc_feature (501)..(501): n is a, c, g, or t
  misc_feature (503)..(503): n is a, c, g, or t
aggacacctgtcccagttgtccggcaaggctcttcaagactgcagaggaatgacagaatacagagatgcaatcaccaggaacatttgggagcacactgccagcacattcacaggtcaaaatgcagatcttcgtgaagaccctgactggcaagaccatcacccttgaagtggagcccagtgacaccatcgaaaatgtgaaggccaatatccaggataaggaaggcatcctccccgaccagcagaggctcatctttgcaggcatgcagctagaagatggctgtactctttctgactacaacatccagaaagagttgaccctgtacctggtccagcgtctgagatgtggctgttagttcttcagtcttgcatttgcagtgctcagtgatggcattacactgcactatagccatctgcccccacttaagtttagaaattacaagtttcagtaatagttgaacctgttcaaaatgttaataaagggttatgcgcccaggctcnncncncctcctttttttttctccccccactcccccc

SEQ ID NO: 150001 - DNA, 540 bp, Homo sapiens
  misc_feature (504)..(505): n is a, c, g, or t
  misc_feature (507)..(507): n is a, c, g, or t
  misc_feature (509)..(509): n is a, c, g, or t
tgcctacttaagccaagcagtattctaggcagtgagaatacagcaatgaaccagtcatgcaaaaattcctgacttcatggaacttaaatctccagtgaggagacacagagaagaaacaagtcaaaatgcagatcttcgtgaagaccctgactggcaagaccatcacccttgaagtggagcccagtgacaccatcgaaaatgtgaaggccaatatccaggataaggaaggcatcctccccgaccagcagaggctcatctttgcaggcatgcagctagaagatggctgtactctttctgactacaacatccagaaagagttgaccctgtacctggtccagcgtctgagatgtggctgttagttcttcagtcttgcatttgcagtgctcagtgatggcattacactgcactatagccatctgcccccacttaagtttagaaattacaagtttcagtaatagttgaacctgttcaaaatgttaataaagggttatgcgcccaggctcnncncncctcctttttttttctccccccactcccccc

SEQ ID NO: 150002 - DNA, 540 bp, Homo sapiens
aggacacctgtcccagttgtccggcaaggctcttcaagactgcagaggaatgacagaatacagagatgcaatcaccaggaacatttgggagcacactgccagcacattcacaggtcaaaatgcagatcttcgtgaagaccctgactggcaagaccatcacccttgaagtggagcccagtgacaccatcgaaaatgtgaaggccaatatccaggataaggaaggcatcctccccgaccagcagaggctcatctttgcaggcatgcagctagaagatggctgtactctttctgactacaacatccagaaagagttgaccctgtacctggtccagcgtctgagatgtggctgttagttcttcagtcttgcatttgcagtgctcagtgatggcattacactgcactatagccatctgcccccacttaagtttagaaattacaagtttcagtaatagttgaacctgttcaaaatgttaataaaggcagatgcggccgaaactactcgcttttatatttaccaaactaacttataacctacatcta

SEQ ID NO: 150003 - DNA, 188 bp, Homo sapiens
gtgagatgatgtcatttacagaaatagggatcacaggaggaaggcattaaatgaagatggaaatttccaatttctttgtactaagtctaaaatgttcacagaatattctgaaggcattggctggaaagcagctatataactagaacttggaagacagggtgtagtacaggttgagtaaacagccacat

SEQ ID NO: 150004 - DNA, 277 bp, Homo sapiens
atgcattgtactgacctatctccttccatccataaacttactcttactgaactttacttgaaagtgattcatagcctttactgggggctctattacaaatgctcctagcaagcttattgttgtgtctatcgcaagaatatgaagttttctaccactttgcagaatggcccctttactaagcccttcaggagatatttctgcctgtctttaagccaactctggatccatttttatggtacagaaggcttacacctaaatttgaagccccactgtgcca

SEQ ID NO: 150005 - DNA, 478 bp, Homo sapiens
atatatgatctctggttgttttgtgatcccaggatctactgagatgtatagcataagaagttatacacatcctggattttgtaagtttcccagcttctccattgttcttgagtatcatttttcagggcaatcataaaaatgggcagggcatgaagcattgcacttctaaaacttgcaaatctgaaacctggatttccaaacatatcagagaaagaagaaaaacaggtcctcactgccctataggacaaaccagaacacgacggccaggattcagctcctaaccaatcaaatagaggattcaaaaatacccaatcaagaggaggattgaaaaacagactcttctgaatggacaaaggagaatatgggagggaacaacatgggaatataagtcagactagcaacgacaccctcttccgggtccccttccaccacgtggaagctttacttttggtttgctcaataaaccaagatgctgcac

SEQ ID NO: 150006 - DNA, 401 bp, Homo sapiens
atatatgatctctggttgttttgtgatcccaggatctactgagatgtatagcataagaagttatacacatcctggattttgggtgataaaagtacttcttccatgaaattgctgggggttaagtgagataacaaaagaagaaaaacaggtcctcactgccctataggacaaaccagaacacgacggccaggattcagctcctaaccaatcaaatagaggattcaaaaatacccaatcaagaggaggattgaaaaacagactcttctgaatggacaaaggagaatatgggagggaacaacatgggaatataagtcagactagcaacgacaccctcttccgggtccccttccaccacgtggaagctttacttttggtttgctcaataaaccaagatgctgcac

SEQ ID NO: 150007 - DNA, 320 bp, Homo sapiens
aggaccccttgaaggcatcggctagtatgctaaacgctgcctagtatgagtcggatttaatatggagttagtttattttgctcttgtgttgggatgtgatagggagctgagtgcttgccctagttacctcttcacattataaatagtaatattcattagaaaatgtttattatgacctgaaattttatttgttcttcgtacaaataggaaagtaatatttgttatataaagttgaaaaacagttgtttgggaagctgtagcttttaggctgggtagattatttatatactttttacatttgtctttttactttcccccca

SEQ ID NO: 150008 - DNA, 132 bp, Homo sapiens
ggactgaggctgccttcagaagttcccttgcagatgatcgaaagcttctgttcttcacattttggggtcacggactcgtttgagcatctgatgagtcttgtgaagaatggatgcctcagcacacaacccacg

SEQ ID NO: 150009 - DNA, 319 bp, Homo sapiens
tattggataaaatacataatctttctgggccttgatttcctttgtctgtaaagtgagtgggttcagagtggatggttacttgccctttgcttcttttgtgtttgtttttgagacagggtctcgctctgtcgcccaggttggagtgcagcggtgcaatcttggctcactgcagcctcctggattcaagcaattctccctcctcagcctcctgagtagctgggattacaggaatgcgctgccacatctagctaatttttatatttttagtagagaaagggtttaccatgttggccaggctggtcttgaactcctcacctca

SEQ ID NO: 150010 - DNA, 133 bp, Homo sapiens
tttctttgtgaacttctaacacctgtttgaccctcctattactcagagaacttcacctcttatttcactaagaaaaatgaaataataagagaattacgtcttcccacttttcagtttgctaattattcagtct

SEQ ID NO: 150011 - DNA, 312 bp, Homo sapiens
catgagggaggggtgtccacaagggcagggtgtcctccaggggaagctgccctccagggaaagacaatcataaggggaaagtgtccataaggggaaggcatccaagaagggtgggcgtccttgaggggagagtgttcttgagggcaaagcgttcttgagggaacgtcatcctcgagggaaaagcatcctccaggggaaggtggcatccatgagggaaaggtgttcatggaggagggcgtcctcgaggatagggtaccctctagggaaagacatccttcagaaaggcatctatgaggggatgatgtcctccag

SEQ ID NO: 150012 - DNA, 399 bp, Homo sapiens
gaaagccacatatttacactgaatatgggctaaaacagcatttgtattttctttgacaaagctcatatttaatgaagtatgtttatgttgctctgagaacctaagttcattttcatcaattatttgtttgggtctctatcaaagtggacaatatgaaaggtgtctgcctagcccagaaaccattgttcctcctaggaaactgcccccacaatgtcctctcccaccttggtggctccctggaagccacatttgtacctcatgatcccactccctggtcaggacccagcctggccaaccaattctgtcctgagaatctgtctttgagactgagaaatgacgtgttcattactgcaggggaccatgggactgcctcatcctgccatttgatttgaattaagt

SEQ ID NO: 150013 - DNA, 333 bp, Homo sapiens
ctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacaggga

SEQ ID NO: 150014 - DNA, 357 bp, Homo sapiens
tggccacatcagggggcacgcagcaagacggcaccctccgctcccaccagccctgcccttctggatgttgctaggtccaggtgtgacccgtgtccagccgggggcctgactgctgactggctgctggaggctgactgcctccctgtgtgccctcaggagacaggccaaggctggagtgccgggggacgtgtggcagtgacatcggatgaaccattgtaagatgaacaattcagtggcgtgtagcgcattcacagtgtggtgcagccatcatcgctgtctacttccaaaccgcttcattcccccaagaggagaccccatgtgcattattcccccaagaggagaccctatgtgcattat

SEQ ID NO: 150015 - DNA, 411 bp, Homo sapiens
cactgagcaaatgtccacgttactcctaatgtttaatcttggggcaaaacatggataaaaatacaaaatgttaactatgtgtatcggtctattggaaccttcctttaagaatgtacactatggaagctggtttgtcttccctgtacattgcaaaggaccttctttgatgtcatctatgcatgagtgttcattaaggattaatcgatgaggatgaacatttcaggctggccctgagttctcatcattccatttcagcatcgagagactgctcattctaatcccagctggttagtgatgtatgcaaatacccagtaaaaaggaaatgactacaaattcctaaactcactctggaatgatcaaggattagactgttcagctctgagagttaaaagtcagcaaactaaataccag

SEQ ID NO: 150016 - DNA, 599 bp, Homo sapiens
caagtgatcctcccacctcagcagctgagactacaggcatgtgtcaccacgcccagctaattttttgtattttcagtagagcctctttccttggctcccaaatggttacctttttgctgtgtccccacgtgattgtccctgagtctgtgtgtctgtcctcttctgataaagacaccagtcctattggattagagctcatccatatgaccttgttttatcttagtcacctttaaaggccctttctccaaacacagtcacattctttcaccatgttggccaggctgatctcaaattcctgacctcgagtgatctatccgccttggcctcctgaagcgctgggattacaggcatgagccaccatgcctggcccatccatttgtctttgtatcacatagctcagtgcccacaatatgcaggtactcaacaaatagtggtcagaatcaacgtacttggatttctggggcctcgcagcccatgggagtggcagtgtaagggcccgagttagaggtgggcagcctccctcctgccgcctctcctcaccattgctttgagtcccattgctctcagcacagctgagtgtcctggtggctgccatcact

SEQ ID NO: 150017 - DNA, 593 bp, Homo sapiens
cctgctagatcaaacctgttgttggactttctagtgaatctctaaactcaggtattttacttttcagctctacactttgtttctattttgcacttttaatcacttctttgataatctcattatcttcatgcattgttttctttttctgtttagttttctatattcttctttagctgactgagcatctttaagctaggtgttttagccaggcacagtgacacgtgcatgtgactccagctactttgaaagctaaggcaagagggctactgtattaatccattatcatgctgataataaggacataaacaagactatgtaatttatcatgaaaaaagttttaatggcctctcagtttcacatggttagggaggtctcaccattattggaacaagcaagagaccgttcaggggaacctccacttataaaaccatcagatcacatgagacttatttgttatcatgagaacagcatgggaagatcccacccccatgattcaattacctcccacagggtccctcccaggacatgtggggattattacaatttaagatgagatttgattggggacacagagccaaaccctgtcaattact

SEQ ID NO: 150018 - DNA, 303 bp, Homo sapiens
tcattagatcagtaaacatttaagcatatatgtaccaagccatagttttgctagaccctcctcaacgtttctttcaataaaatcaaggtaaacaagaacattaaaaattttgatttttatagtacatgatgatgtagtaactttttactgaaatctctttaatagcaataattcatatcttgaataaattctgttccttaggttgattcaatgagatgaaaaggatgtctaatttttatcttctcaaggtaagttctccagtctaataacagaatagctattctaaggctaatgtattttcac

SEQ ID NO: 150019 - DNA, 1225 bp, Homo sapiens
cagtgcccactttgttcatctctgctcactgggggagccaggacacggatccaggttttctgactccaggtctcaggcttgctccatagcgccacctgctggtgacggcaatcggtaggcacccaaatcaagactcagatttcctcatctcagaagttgtccacttcttctccgacctccacggtaactcggaaccacaccgtggagttatccctgtgtcctctttctcggaagttccacatccaacccctcagcaggtctcagcggcactctcaccacctcctctgctctgttcctgtttctcttggatggccgaatgtttcctaaggagtgtctgctgcttcacgcttgccccctggagtggcatctaaaaggtgaggataccctacaactaacaggcatgatgccatcaagacatcttgagcctggctacctcccgtggcctgtattttgtccacaggaaactcgcgcagtctcactacagcaaattgaggtggtatggggtgcctgctgctgcctctctcttcacctttccacagagggctgccccagcctgactcccacttccagagtttctccagccaggagaatcctgaaatctctgtaaataagcaatccaggagccagagaatcatgggatctcatataaacaaatcatcaaggaaaaacacagccagagtctccatttggtaaacctccgtgactggggatccccggccacccagaaagcagtattgcctgccatgcatgtcatcactgatttttactgctgcagcagactccgtcagacctgcctgctgcttcagcgaattgttcagtgcacaccaccagctacctgctgtaagcattcacactcctctacctgcctggcagcatttctcagctgaacacaggccaggccagaagtgccagggatttaatgcccttagaagtagctctctaccaatgacaaatggagctggtggatacattctcagcttcctcccctctcaggtggaacagccctgagatgtgctctatgcaatctcccacaagtccccagcaggctcaagctcccattgtccaaccctggtaacctgctcattgacacccctgtcttgccttcccttcctggcctcactttctcactctcttactgttgcctcctgagatcgcatccaaaataaatgacctgcacccagaaaaaaaaaaaatcggcctcgtggcatcagcggggagctctcgg

SEQ ID NO: 150020 - DNA, 1180 bp, Homo sapiens
cagtgcccactttgttcatctctgctcactgggggagccaggacacggatccaggttttctgactccaggtaggcacccaaatcaagactcagatttcctcatctcagaagttgtccacttcttctccgacctccacggtaactcggaaccacaccgtggagttatccctgtgtcctctttctcggaagttccacatccaacccctcagcaggtctcagcggcactctcaccacctcctctgctctgttcctgtttctcttggatggccgaatgtttcctaaggagtgtctgctgcttcacgcttgccccctggagtggcatctaaaaggtgaggataccctacaactaacaggcatgatgccatcaagacatcttgagcctggctacctcccgtggcctgtattttgtccacaggaaactcgcgcagtctcactacagcaaattgaggtggtatggggtgcctgctgctgcctctctcttcacctttccacagagggctgccccagcctgactcccacttccagagtttctccagccaggagaatcctgaaatctctgtaaataagcaatccaggagccagagaatcatgggatctcatataaacaaatcatcaaggaaaaacacagccagagtctccatttggtaaacctccgtgactggggatccccggccacccagaaagcagtattgcctgccatgcatgtcatcactgatttttactgctgcagcagactccgtcagacctgcctgctgcttcagcgaattgttcagtgcacaccaccagctacctgctgtaagcattcacactcctctacctgcctggcagcatttctcagctgaacacaggccaggccagaagtgccagggatttaatgcccttagaagtagctctctaccaatgacaaatggagctggtggatacattctcagcttcctcccctctcaggtggaacagccctgagatgtgctctatgcaatctcccacaagtccccagcaggctcaagctcccattgtccaaccctggtaacctgctcattgacacccctgtcttgccttcccttcctggcctcactttctcactctcttactgttgcctcctgagatcgcatccaaaataaatgacctgcacccagaaaaaaaaaaaatcggcctcgtggcatcagcggggagctctcgg

SEQ ID NO: 150021 - DNA, 565 bp, Homo sapiens
aagtaatttgcccaaggtcacacagctggcaagtggtagagctgagattagaacccaagctttgtggcccatgttctcaccagcatactgtgcagctgtctgcagttcagcagtacaaccccatttattctgttattttttatgagtttgttacattccaaattgcaaaatatcttattatatggattcagccacctcacaggttaaatcttgtctcttgagattttttctttttttcttttttcttttttttttctttttttgagacggagtctcgctctgtcacccaggctggagtgcagtgtgcgatctcggctcactgccacttctgccttccgggttcaagcgattctcctgcctcagcctcctgagtagctgagattacagacgtccaccaccatgaccagctaattctatatatttagtagagacgaggtttcaccatgttgaccaggctagtcttgacctcctgacctcaggtgatccacccgcctcagcctccaaaagtgttgggattacaggcgtgagccatcgcgcctgacactctcttgagatttaatgtcta

SEQ ID NO: 150022 - DNA, 225 bp, Homo sapiens
taaggaaaataaacattatggaagatgttggttttgatgaaaaccagaaacaaaatgtcagaggcaaaatggtcactgctctaggcaaactgctaaaggttttgggaattaggacacggagaaaagaaaatgttcataaaactttcttggttcattgatatgctcctatgaagatggtagaaactccttgtttttccaatatatcatttcaagaagcaacaaaga

SEQ ID NO: 150023 - DNA, 311 bp, Homo sapiens
actgaaatgggaatctcataattttcatgtcagaaaatattctatattaaaaaaaaatttaaaaatatgaaaactattcttagctagcaggtagccatggttatacaaaaacaggcagcatgtgggttgtaatttgccaaaccgtgggttagaccaaggacttgagaacatcctacacaggcaagtcaggtcactcactcagaacttaccaaggatgcctaggatcccttccacaggtaagccaatttattttcctgtcaagatgagtccctttagacacaagaggcaaggaaatgctacttcccctttat

SEQ ID NO: 150024 - DNA, 541 bp, Homo sapiens
tagccacagagaaaactcagtggcttaaaatagtgtaatttgatgtagtcaataaaatatatcagtgaagccaatttttatgtaaaattttaccaaagataatttacatggaaaaaattagaaattttttttctacactctacaggaaaattttttatgagtgctataagaaaaagtaattggaataatcagtatcattctaaaaaattatggtaagatttatggacaagggtggagcaaggcaaaacttgatttttcccattgttctttcgtattctaaataaaagatactcttttgttttcttaggtttatgttctgctttggatttaaatgggaggaaggatgaaatgagacagatgtaggaacaggacccattgtgagggaaaaggaccagagtgctctttagaaagtaggggtagtttacctgtttattgttaatgttggtcctcaaagtttttgattgcttgaaatgttttggacagaagaatttggcaaattacaacttttttttcttcttaggattggcttttgtcattccca

SEQ ID NO: 150025 - DNA, 283 bp, Homo sapiens
gcctgttaaaactctttaaaaaccaatgccttggtggaggtaacatttactgtttactgtagctgtggttgttaggggttattgctaaggtcctggttttccatgacatcagcagcattccaagggaagtgtgtgtcagtgactttcagtaatgactcccttttccaaacgttcaaatcttctgccaagctgccctacacctgcacaccagctgagttgcaggaaaaggaaaagcaagatggattaagtgggatttttgtctgggctccttaatgagactaaa

SEQ ID NO: 150026 - DNA, 276 bp, Homo sapiens
gcaataggaaactaatacatgggccttctactttcaaatgtgctctatccttttctaaaatcaaggatccggcttttatcttattataaaaatcaaagcctactctgttatattaattagtgctggactggagaaaatacgattttccaataatatactctaaggtctgtcccttgggtgtttctggccctgtgctggtctatgctagcctgtttgtactcagatccacccaccagcctttccctgctctctgctattgaaacttctaaaactagg

SEQ ID NO: 150027 - DNA, 162 bp, Homo sapiens
tatggaagagcttccattagagtagtatctttagcctttctccatcttcatcactcactcatctccagggaaggaggagtgatatacctgtccaataaatttaggagaaagcattggtatgcttggatcaactccctttgctttagatttgtctacctacag

SEQ ID NO: 150028 - DNA, 329 bp, Homo sapiens
tcagagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctatttaatcaagtt

SEQ ID NO: 150029 - DNA, 341 bp, Homo sapiens
cgttcctgttctagctgcctgggagtcagaggctgtgtgccttgagggagctcctggctgagtctccctctctgtgctctgtcctgggcccagccctcaggaggtggggacagaaagagctggacagggccgggggcggtggctcacgcctgtaatcccagcactttgggaggctgaggcaggcagatcatttgaagtcgggagttcaaaaccagcctagccatcatggtgaaaccctatctctactaaaaatacaaaaattagccgggcctggtggcgggcacctgtaattccagccactcaggaggctgaggcaggagaatcacttgaacccaggaggc

SEQ ID NO: 150030 - DNA, 268 bp, Homo sapiens
cctcaccttacaacaaactggagccatcttgtgtctctgccttggaatgcccttctcctgtctgaaaaatctctactcatccatcaacatccaatttctatatgccattactaaatgaaacctttcctaataatccctggaaaagattctatactcccactgcgctgtattaatgtattaacatgtctgtcttcctcaaccagatgcttaactcaacatcttttaactctagtacctggaatgtctggcctacagattcattcaacgt

SEQ ID NO: 150031 - DNA, 277 bp, Homo sapiens
aacaaaaactacataatcatctcaacagatacagaaagatatttaacaaaatctaacaccctttcttagtaaaaacattcaataagctaggaatagcaaggaaattcctgaacttgataaagagcatctatggaaaacccacaactaacatcatacttaatggtgaaagcctgaacgttttcaaaaaagagaaaagaaggtctgctctcaccactacttttaaactttgtactggaggctctagcaatggcaatttggcaagagaaagaaataaaag

SEQ ID NO: 150032 - DNA, 291 bp, Homo sapiens
caactgtggaaagaagaaacaaggctggaggctgacgctgaacttcgaaaatgatggtaaagtggaagggatagaaacagcacggccctggtgcaaagtgaagcaaacacgtcgggcacaggagagtccaaagtaaacccacagtttcttacaaagctgcaacggcaatgcagcggagaggggagccctcccagcaattggggtgggcaccgctgggcgtcaaggtgcctgtgccgacgctataccatgtaagaaacctcactcaagacgcgtcccaggtctaaatacaca

SEQ ID NO: 150033 - DNA, 899 bp, Homo sapiens
acaggtgcgcaccaccatgcccagctaatttttgtgtttttagtaaagatggggttttgccatgttggccaggctggtctcaaactcctggcctcaagtgatccacctgcctcagcctcctaaagtgctggaattacaggcttgagccactgtgcctggtcttgctggtgatattttgaagaaacatattcttgtacattgatggtgggacaccattctcatgggggggcaattggcatacctaacaaaattagaaatggtcctagctactcagtaggctgcggcagcaggatcgcttgagtgagcccaggaggttgaggctgcagtaagccgtgatcatgccactgcactccagcctggatgacaaagcaaaacccaatctcttaaaaaaaaaagggggggttgcggggggaaatgtcctcagacccagtaattccacccctaggaatccagcttacacacacaagaaagaaaagataaatgtacaaggttagtcactgcacagtgagacagcaaaagattagaaagaacccaagtgattattgatctgggttttattcctttatagcccaaccatatgatggaatactataatgttgtaaaaatgggttaagagttctttatgaattggtgtggaaacatcgccaagatatgaaagccaaatgcagaaaaatatatgtggtatgctattatctatgtgaaaaagacattactattctctggaaggataaacacaaatttgagaatggtggatatctggggtgagaggtatccttttcactgttctttaaaagttttgatattttggtgtttgcctattcaaaaaaatggttaaaatcagttgccaccaattaaaaattaggagaatgcatataaagaactgaatttcctgttagttt

SEQ ID NO: 150034 - DNA, 481 bp, Homo sapiens
gtgatcatcccacctcagcctcttgagtaactgggactacaggtgcacaccaccacacctggctaaattttttgtatttttagtagagaaggggtttcaccatgttgcccacggctgttcttgaactcctgagctcaagcaatctacctgcctcagcctacgaaagtgctaggattacaggcatgagccactgcaactggcctgtattttgagtttgtttactatttcattggtcttgctcctgtcttttttattttctaacttctaatttctatttcctaatttctattttggtttattctctgacacatagattatttagaagtgtactgtttaattttcagtcagttgagtgttttctcattttttaaattgattatattagttatgtattgctgctgtaacaaattaccacaggtttagtggcttagaacaacacagatttattatcttaccattctagatgtcagaaattcaaact

SEQ ID NO: 150035 - DNA, 587 bp, Homo sapiens
cagagcccgcgcccgcagccacagggtggggcaaggtatcaaagaccccacccagctgagctaggagtgagggatgtgagccacccccgcttggcaccccggtggatctggtaacaaagtgagttggagcccaggttcttgtccccagattttggggcttcctggggagggaagaaccaagggactctcgttcgtccccagggttgcccatcccctcagtcccatgagaacaggaagggccagaaaaccttgactgcaagggtgcggcgcagggagaggaccacaggcttttagctagtccgggttctggaggctgtacctgctaggtcgtggaggatggggcggagccggtttccgctctcctggtagtttcagttcacaagtgggactagtgagactagactgacctacagctggacgccggaagctagctgaggcttggttgactcagtcccagatggaaagttagcactgagaagtttaacttcccattgaatcacccctgggccctgcattgccattgggcccttgtcctggaccagatgccagggatgagatgaacagaccagatccagagactgccctct

SEQ ID NO: 150036 - DNA, 202 bp, Homo sapiens
agacatccagtggtcatggtcatcccatcactcaaggccttggaggccgggccatcggaccatctgcgcagctatctaactgtaccactgctcagctcccattgcagaagggcatggagtgggtgctccattcgctcctatgactccagtggggcccccatggggcttcccccaccgacaaccctcgtcccccaccttagcc

SEQ ID NO: 150037 - DNA, 830 bp, Homo sapiens
tctgctggttgggctacactaaggtttcctaacctcagcactgctgacagtttggagctggtaagttttggttgctgagggctgtcctgtgctttgcaggatgtttagcagcatccagggcatctacccactagatgccaggggcaccctccccaaagtcatgacaataaagaatggctccagacccactgccaaatgtcccctggtggcaaaatctctcctggagctgtgaaccactggactacactcagctttggggactttggtggtcttttaccctagatcaattggttttatatttgtccattcatttagcagccattttttgcctcctccttccctgtaatgtgtcaggactaggctaggttctggggatcctggggtcacctgagcccccagagtactcccgggcagatggcccagtgtcccaggagctccagatgtgttttgttgcaactgctgtctgtgcacagaggagtgtcaaggaagagggccaggaaatgactttggctgcaccttaatagctaaggatggcaaaggatgttcttggtagaggaagcagcaagtgccaaaggtgggcatttgagaaaggacaccaggataggaaccggcctgtgcactggctgggagaggtgacgcgattgcggagggcatctgtgtcttgtgtggccttgagcccagggaaggcggtgggagccgctagaggtgtccccactggtgtgctcagtccagccatcccctgatcagcctgtcaggcctgcttctccatgttggcctctcctggatctttccagcagcaaacatgcatagaactcccctcttcacaacca

SEQ ID NO: 150038 - DNA, 383 bp, Homo sapiens
  misc_feature (38)..(38): n is a, c, g, or t
aagaggtaatcaaagcccattccagagccaaccgttcncaccccttgagagcaaacaggtggaggacagggagaaatctaaggatggcaaaggatgttcttggtagaggaagcagcaagtgccaaaggtgggcatttgagaaaggacaccaggataggaaccggcctgtgcactggctgggagaggtgacgcgattgcggagggcatctgtgtcttgtgtggccttgagcccagggaaggcggtgggagccgctagaggtgtccccactggtgtgctcagtccagccatcccctgatcagcctgtcaggcctgcttctccatgttggcctctcctggatctttccagcagcaaacatgcatagaactcccctcttcacaacca

SEQ ID NO: 150039 - DNA, 588 bp, Homo sapiens
tcccaaaggagctcagcagccccaagatcctgatgaattcaggatctgagaatttgtttcattctggtccacactggagaagaaccagcccagcctgggattttctagaaaatgcagtgaacaaattctgaagttaaattctacaacactgtcatttccacttaaggcacaataaaactaaaaatgatgaagcaggagctgacttccgagacgtagcagcctacacttctctcaagggcaaaggctcatcatgaagacacaaagggctcctaggtagcctttggcaaggggctgtgcctatgaaactgcagtccgaggcccacgcacaggggatgaaccctcagaaaccaggccctctgaaccaggaggaaaatgggaagcaccacccacctctctccatctcctccctttccaaggttccaggacctgtagggactctaaacaggacaatgtgggactgggtgtaagtgaacagagatctgaaacagaaaaggcaccctaaccacagggtaattattattagacgaacagcccaatacacatgaagactgggcatctcatcttactgcttttacggaatagaaatga

SEQ ID NO: 150040 - DNA, 563 bp, Homo sapiens
tatttactagtgaattcagacaatcaaaacagaaataccccctcaaaacaacagaaaatcattgcatttagagggtaagggattttaacctaagtgtatgttaccagaatgataaaagaggtcagctacattttattttgttttctctcaacctgggcaagtgtataccagaactttctcttttaaacgtttttcttcatactctcttgtccttttgccctctctcccagtgaagtgttaagaattcggagttcagtaaattgttgcctgattaatgagttgccatgaccaaaagaaaacttaccactttaataagtatacctttatatccaaataaacctcaagcttgaaggagctttgaagtgttcccttttcatgtgcataatttatacacattccacttgtgtatctgttgagtatagttggaaataggcacctaagagttgagaagtaaagggactgattagtactatactggagacaaagcctctgtgcatttcttctaaaaagtaccatgtttgtgctcctaagccctatgcttgctcgtgagtggcttggaatgg

SEQ ID NO: 150041 - DNA, 756 bp, Homo sapiens
  misc_feature (621)..(622): n is a, c, g, or t
  misc_feature (625)..(625): n is a, c, g, or t
  misc_feature (634)..(634): n is a, c, g, or t
  misc_feature (636)..(637): n is a, c, g, or t
  misc_feature (640)..(640): n is a, c, g, or t
  misc_feature (652)..(652): n is a, c, g, or t
  misc_feature (654)..(655): n is a, c, g, or t
  misc_feature (658)..(658): n is a, c, g, or t
  misc_feature (665)..(665): n is a, c, g, or t
  misc_feature (672)..(672): n is a, c, g, or t
  misc_feature (676)..(677): n is a, c, g, or t
ctagaacttgagaaaaaaatttaaatcttggactgccacttctggacaagattaggaaacacctagaataaaggacaaaatatggaaacaatgattctcagaaaattgagcatcagacaagaaaagacagtgatccctgagagatggaaaatgaaaaggtatttttctacttattttgaaagatgaaaatccaacatacagttttatatgtcaaagacacacaatcaccgtgactaattcagacgctgctgctatcagaaaatgtgatgagttgcagaattcagtattgaattgcatctaccagtgcctcaaaatcagcattgcatgcagaggagcccattacaatgttaaattggtctcatacctagatgagcaattatttgcctattttcacaataacgtatctgctgcattagcctctttgttaatataagtgcaacacatgtactgaatgcttgaatcctaataaataaatgagtgaataaaattccctcatttttcatacaaaaggctagaaatgaaagccaaaaggaaaccatctaaaaagtctatgaaagccaagaataaaccatcacagaatcctataataaaattttttctaattgaaaaaaaaaaaatcgnnctncttggcctnannggnggactctgcggncnnttncctttangagggtnaatnntgatcctagatgactgacccaatgccctcgaccatcggcgtgtcgagagcggttttcatttttcccatgtggcacatcg

SEQ ID NO: 150042 - DNA, 606 bp, Homo sapiens
ctagaacttgagaaaaaaatttaaatcttggactgccacttctggacaagattaggaaacacctagaataaaggacaaaatatggaaacaatgattctcagaaaattgagcatcagacaagaaaagacagtgatccctgagagatggaaaatgaaaaggtatttttctacttattttgaaagatgaaaatccaacatacagttttatatgtcaaagacacacaatcaccgtgactaattcagacgctgctgctatcagaaaatgtgatgagttgcagaattcagtattgaattgcatctaccagtgcctcaaaatcagcattgcatgcagaggagcccattacaatgttaaattggtctcatacctagatgagcaattatttgcctattttcacaataacgtatctgctgcattagcctctttgttaatataagtgcaacacatgtactgaatgcttgaatcctaataaataaatgagtgaataaaattccctcatttttcatacaaaaggctagaaatgaaagccaaaaggaaaccatctaaaaagtctatgaaagccaagaataaaccatcacagaatcctataataaaattttttctaattga

SEQ ID NO: 150043 - DNA, 578 bp, Homo sapiens
tgccagctgaggaggtggcgatatttgccagtcacttggaccagtctcccaaactatctttttccacccgtggtggtgtctttcctccttactgaatcatttaggtaattacctcaattcttcactttactttggctgtgaagacagagtcttaatgagcccagagccctggacaatcccagctccagggtgaggcagccgggtggcggctgtgggaggggaagacggtattaggatgctcacattgcataacctgcacgtccaagtggccaagctggctgccatctgcagcccgggcgagaagacgggagaggccctccaccagccaggggaacgcagtcgctttctgcagtagctcccaaagcctttaggaaaagctttgttttacccctttgtcctccagaaataatgacctttgtgtgtcaacttttgtagtatctcatttctgaacccaaagcagatggttctggtgatttcagaaggcttagtgaggggatttgaggagcctgggtgagatctcaggtgaactgacacaaagcatgatttctagtttctatagccaaggcttggggatgagg

SEQ ID NO: 150044 - DNA, 369 bp, Homo sapiens
aaattgaaggtgtggtgtggtcagtggttgcattgcatgctagcggtgcataaggcctgattcctcttttctttcctcagccatcagtaatcatccgcaaagggctctcttgtggacacttatgctgcaagagccacttcctccacggtcttatcacctcacccaggccctgtggagcagccagaaggcagggagagcttctcccttgcaggtcccctccattgctgtcagtacccagctggctccagggctctgtgatgccgccagctgggcctatgagggccccgaaccctgagtcctcactgcctttctcccaatcccaggaaggtatgctcagccagagcccaggcctcatacacactggcagtg

SEQ ID NO: 150045 - DNA, 311 bp, Homo sapiens
cctcagatgatctgcatgcctcagcctcccaaagtgctgggattacaggcatgagccaccgcacccagcccacacatttttacataacaagacatcctttagtccacacaaaggctgacgttagctgcatctgtaacacaactttttcctcaaatgtatggagttttttttaggcttccacttctatacttgcctattctcactccctgttttaatttaacatagacatgcaatgctagataatagaattgttctctaccagctggacagcggggagtctgtgcagtttctgacacttcttgttgcacatg

SEQ ID NO: 150046 - DNA, 350 bp, Homo sapiens
ctgcctcaatgggttcaggctctggtgaggagtcagacaaggacagcaactaaaagacaatgcagagcacagagcaggggcctcactgagtcctggggtgagagggtcttccaagaagagataaggccaacaggaggccccagggaggaggaggagttccataggtaagggagctcaacaggaagaagaacatgaggactcgaggacagcaaacgcaaacacctgagggtgaggagacaaaaaacacaagtgcttggggatgagggaacagtgaacacaaatgcccggggatgaggggacggtgaacacaaatgcccggggatgaggggacagtgaacacaaacgcccag

SEQ ID NO: 150047 - DNA, 282 bp, Homo sapiens
tgtcaaggatcatggattgaatcctgaaacagaggaaggacactgaaggaaagactgggaaaacctgactgaggtctggagtttagttagtgatactataccaagacgaatttcttagttttgataatttgttaacagttatgttaacattgggggtagctatgcaaggggtgtgagaatgctgttatatctttaaccttggcccatggttaaggtgtttccagtgtaaggtcactgttattccttgtagttaacatatatttggcaccacaggattcattc

SEQ ID NO: 150048 - DNA, 763 bp, Homo sapiens
cattcttttagttacttaaaaatgtacaattaacttgctttgtcttatcactcccggccagagaaaaaccctgtagacattagtcactcctcattctgtctcaaaccctctccctgaccctcagccctaggtagcaactacctagtgcgatcaatcccatatgcatagattaccatattgtggacatttcctataagcggaattgcacaataggtgagctgttatgactgacataacacgtagcacaatattttcaagattcgtccacattgtaggcttacccacagggggaaaccatttttttgggggcttttagtaacaccggtgttttctccttccttacgtccttctttccttccttccttccttccttccttcctgacttccttctttccttccctccttcctcctatttctctcttactccttctgccctctctctttcctatgccttaggtgcatcccacattctgcgtttctttggggaaatcctcgacaggtgcaggaaaattgtgttattgtaactatttaccgttatctctctttcacggctctccatcagttgtgaacatctattggtttatcccaagtcactaagcatattttcattaggtaaacctgtttttccttatacagctgtttctggagtatagggtcgcatactcataaacccagtgtaactcagaaacgcatctaatattccagtaaacccatcataacgttgaaaaatcgtaaatcaaaccatcataagtcacggtttgtc

SEQ ID NO: 150049 - DNA, 590 bp, Homo sapiens
tgtgtcgccataatcatcttccatgcagcccaagtggcgggtggtggtcccagctcccactcccctctggggctttcactgcttgcttcctggagcacatccatcccatagcacttcatcctggcagccagtgtgctagagcccatgtgcatgtccctgctcctggtggcctgcgtgtgcctggggcttgctaggtacactagtgaaactagtgggctttgggtcacggcagctctgtgcagggtgaaagggtgctcttcagacactctgggggctctgtgggagacactcccatggagacatttgggtgtggacacagcatgtccttgggcaggtggcaaaactgcttcccacgtggcaatggcgccttgtagagagctgccctgggcctgggtgtgtctgtgagcatgtgcgcgatgcttcgtagtctgccctgtttgtttgtgtctgtaggtgctgctgtggttttgtccactgcgggaaagtagtggttcttttaatgcaggagccggagcttctttttgatctgctgctatgacatctccactcacttgcttaaaacagtttcctttttgttccccctcctcccc

SEQ ID NO: 150050 - DNA, 557 bp, Homo sapiens
tgtgtcgccataatcatcttccatgcagcccaagtggcgggtggtggtcccagctcccactcccctctggggctttcactgcttgcttcctggagcacatccatcccatagcacttcatcctggcagccagtgtgctagagcccatgtgcatgtccctgctcctggtggcctgcgtgtgcctggggcttgctaggtacactagtgaaactagtgggctttgggtcacggcagctctgtgcagggtgaaagggtgctcttcagacactctgggggctctgtgggagacactcccatggagacatttgggtgtggacacagcatgtccttgggcaggtggcaaaactgcttcccacgtggcaatggcgccttgtagagagctgccctgggcctgggtgtgtctgtgagcatgtgcgcgatgcttcgtagtctgccctgtttgtttgtgtctgtaggaacccacgcggctcttcagctgtggcaggggacacgtctgcagcaggaaggcactgctggatggcagctttggctgggtgccaggccaggactctggtctcct

SEQ ID NO: 150051 - DNA, 696 bp, Homo sapiens
atacagtaagtgacttgtccaatataatacagctactataccttcttgaagttaactgaatggtaatggaaataacccttaaacaagatcaacagatagacaaaaagtagaccatgccacataatactttgattgctgttcattgatagtcatgaccaatctagttttgttgattggttagttggatttaatgagatgcaaccaggcaaacaaattgagtgtttttcagttctatagaccacttatttagagaaactgaagttggcctaaaatgtagccaatcttcaaaactcaaagatgccatgataaaagtatatgaattcatttgtttataagtatagtacttgctccaggtgactacactcaaacttagccgtgatttggcctagacttcaacgaaatcagctggtttttgttttgtttttcaaatggacatcttgagattacttggataagatttaaatcaagttaaactttatttacccaactttactgataatgaagaaattctcaagtaagactctctaggtgataaaacctgaataatttttagtctggacatatctaattcaaggagtattccttccaaagctgagtgtctcctgccaaaaccagaactggagaaaactgagggaccagatgaggaaagtgtcatgaaacctctaatgtctatacacaccaattgtaagggcccaa

SEQ ID NO: 150052 - DNA, 277 bp, Homo sapiens
ccatgatctacagacatgagtgattctacactaaataaaatagtggaggaaattgagcttattaaagccaatgcttccttcaaaattatgagtcctgagcttcctccaaaaatggaatgaaataagcactttatttgtatttaggcaatattctcgccttttcaaataacaacatgagttctttaatctgactagcagctcccgatagagatcaaaagtaggtaacagacttggatctatcatactttagacactacagcgaaaaaagcagatttga

SEQ ID NO: 150053 - DNA, 626 bp, Homo sapiens
agttcgacggagactctcacaatctggtgaaagcaaatgaggagcaaagtcaagtcttacatggtgacaggaaagagagctgtgcaggaaaattctcagttataaaattataaggtctcacaaaacttattcatcaccatgagatagatatgtggaaaattgcccccatatttcaattatctctacctggccccacccttgacacatgggaattattacaattcaaggtgagattttggtggggacacagagccaaaccatatcattctacccctggaccctcccaaatctcatgtctctttcacatttcaaaacacaatcatgtcttcccgacagtcccccaaagtcttaactcatttcagcattaactcaaaagtccacagtccaaagtctcatctgagacaaaacaagtccattctgcctatgaacctataaaatcaaaagcaagttaattacttcctagatacaatgtgggggtagaggcattgggtaaatacacccattcaaaatgggagacactggcaaaaacaaagaggctacaggccccacgcaagtctgaaattcagcaggacagtcaaatattaaagctctaaaatgatctcctttgaccccatgtctcacatcca

SEQ ID NO: 150054 - DNA, 391 bp, Homo sapiens
atatagttagttatttctgggagcaaagctgccagtatttcaatatgacttccctagtagaacttttgtgccatggagctggggagtggtagacggggatggaacctccaggttataatgtcacagactctaactgttcttactgatattcagtaaatttttaaagttaatttttaaatcgatacataataattgtacatattcctaaggtacatatgatattttgatgcctgcatacaatgtgtagtgaatcaaatcatggtaattaggatatcacctcaaacatttatcacttctttgtattggaaacattccaaatctttcttctagctattgtgaaatatacaacaaatttttgttaactatggtcaccctactgggctatcaaact

SEQ ID NO: 150055 - DNA, 654 bp, Homo sapiens
acatttctcattctctgtttattcttacttagattatgaaactataaattattcttaaaatttttgttttcaaaacttcaggggactttagaagccatccaaacacttcagtttccaaaagagaaaacaaaagtgctttgccccagtttcacacaaatcagttgcaaccagcaaccattcaaagcccaaacacctaaggccctccaagtgttaggctgtatattccttaggggcctggaatataattcacatgccttggttttacacgtatttgtagagcatgagctcattaagtggcgaagaaggaaggaaaaaagaagagagggagagaggaaggaaggaagagaggaaaggaagaaggaaggaaagaaggaaagaaaagggatggatggattgttacaatatagtttaaaatatgacaccaaaagacatctaatacattaaaggaaactgttgagctgaggtcaggatggggtaaatgaaccatttcccacttcatcccagctcagatattccactaagccttcattgtttacttgtaattgcctacacatacatacataattatgtgtgtgtatgtgcacatgtgttgtttttaaggaagagcagatgtaggatctaggaactatttgggaaacataagaaagaataagg

SEQ ID NO: 150056 - DNA, 528 bp, Homo sapiens
cccccctaggtacaacagctccatttacaatcagctccagttacaacagttccagttacaacagctccagttacaacagttccagttacaacagctccagttacaacagctataaaccaaaacacaaactcactcccaaacacttttctcttcactctctgcttgctaatgttaggatgctgtgttccatagggtatgaaagtaaataagaaggtacccctgatttccagacaatgcactgttatattagaacacctctgtgtcttctctccagcagggggaaatttacgttttttgcttaaaaagtattaattcaattcaaattcaaagaacattaaatgcttcctatgtgtcagcagttacaacagctccagttacaacagctccagttacaacagctccagttgtaactggagctgttgtaactggagctgttgtacctggagctgttgtacctggagctgttgtacctggggctgttgtacatggagcagctcttaaaggggacgattagatttctgtctacta

SEQ ID NO: 150057 - DNA, 193 bp, Homo sapiens
gaatggcatctcaggctacaggagcatgtgacccgaggaacctttgagctctctgagccacagatgaatctgggaagacaggaattcaacaaagcacaaaaataaggtaacataaccaaatgcaacagagggggaggctgtgaggcagggtccagcaggcgctctccctgttcttgtacagccatcagcagaa

SEQ ID NO: 150058 - DNA, 406 bp, Homo sapiens
caaaagaagaatttaagctcaccttttatatagcttttctgatagccacaatttctgcattaaaaatctgagggatgacaaagtccctatgcatactagttaggaatttcttagaacctctcttccatttactatactgtttcccatgttcttttgggtgtttttcatattgatggttggatatcattacaacaattacttttggctgtttttaggtcttcagctgctactgggatacctcttctatattttcaaagtaaccagtgtcatttcataattgtttattatacagcttaagatataagcaccatatacagatttcagtaaaagcaaaatttgaagctgttttcaatttaggaaacacatcgtctatttataagcaatttgatgtgtatagtttcatatc

SEQ ID NO: 150059 - DNA, 478 bp, Homo sapiens
ggtaggaatgtgatatgacaggtggagattcctgggtctcactccaacacccaggctggagtgcagtggtggtgtgattatggctcactactgccttgacttcccaggatcagatacgggctttcactgtgttacccaggctggtcttgactcctggacttaaaactatccaccagcctcagcctcccaaggtgctgggattacaggtgtgagctaccactagtggcctcttctaagaggaaatttggatatacagagagacaccagagatgtgggggcacagaggaaagacctgctaggatacagtaagaaggcagcctctgcaaacttaggacaaagtcctcaggagaaaccaaacctgctcacaccttgatcctggacttctagcctccagaactgtgaaaaaaatattctgttgtttaagctacccagtctgcggcattttgttttgccagctctaataaactaataaacaacc

SEQ ID NO: 150060 - DNA, 546 bp, Homo sapiens
ggtaggaatgtgatatgacaggtggagattcctgggtctcactccaacacccaggctggagtgcagtggtggtgtgattatggctcactactgccttgacttcccaggatcagatacgggctttcactgtgttacccaggctggtcttgactcctggacttaaaactatccaccagcctcagcctcccaaggtgctgggattacaggtgtgagctaccactagtggcctcttctaagaggaaatttggatatacagagagacaccagagatgtgggggcacagaggaaagacctgctaggatacagtaagaaggcagcctctgcaaacttaggacaaagtcctcaggagaaaccaaacctgctcacaccttgatcctggacttctagcctccagaactgtgaaaaaaatattctgttgtttaagctacccagtctgcggcattttgttttgccagctctaataaactaataaacaaccgatggtgtaaagatgtaatatggatttaaaaaccttagatagtaagatacataaaggtcgcaacggtg

SEQ ID NO: 150061 - DNA, 431 bp, Homo sapiens
tgaaaaacagtaacaaaggaagcctcagctgtccatatggtaaaggaaaccatatatcaaggaggacagaacctactgttccacctgtgttcccaaatgacctcgtggaacagaaaccctttcttagcctgaaagtcatgtgaaacaaacaaataaacaaaaacaaactcctgtgttgtctgaatctcagcattctgtgaccttctagacaaaacaacatatatcctaacatgtgcatttcattttcaggggtaacacgattagataccctaaaaacaacaggcaagaaaaatgtcgaattttacaaacaaattatctaatcttgtaactgaagattgcagttgaaattaaaataaagaaactagtacctaggggaagaaaaaagaacacagagagaaggggggtataaagagtttaaaagtgacagaaaa

SEQ ID NO: 150062 - DNA, 270 bp, Homo sapiens
ttggaatttgtttgttgtgtgtgtggctgggctaacccttgttggagtaggtttcgtgccgcttttggcttcttgggggcacacagcggaatttgctctagggatgcggcgagcatcagcggtgtagtgggctggggccgggcaactttgcagcctaatctcagtgccgctgaccgcaccgttgttcgtgatgtgagctgactgaggcatagacacgggcaggctgcagggagcttccaaactttgaaagcattctccaggaatggatgc

SEQ ID NO: 150063 - DNA, 222 bp, Homo sapiens
ggcgagccgggccccaagttatagaaaaaaaaagtataaatatatagtaagagtgtaccataaatccatccattaaaaatagattttgttttattgttataaacaatgctgtaacaaatattcttttacttacctgtgtatacatttctctaggataacattatcaaagtgggattgctgtttttttttttttttttctttttttttctaataattaactgg

SEQ ID NO: 150064 - DNA, 944 bp, Homo sapiens
ttcctcctcttcctgggtgtaaactgcgattcaaaaagccaggtgggaagccctgtagtagggactctggctttgtccctgtttcccccttttcttcctcttcacccactaaaaccctgttttactcacggttcaaattgtttggcagcctgaattttcatggccatgggacaaagaaccccgtctttagctgaattaaggaaaagttctgcaacatttttgacgtgcaacttgggggctcaagcggagaagcgaagcagagcccctggaaaactcacatatgtgtcaacaatagtccttgatgcccctgtaacaaaacttgagcaaggcctggtgatgaagagatacaagattgtcacccaaggatttgattatacctctgttgaaagttaatgcacactcaaccgaatatggcaattggtactctcaattctatattctcaacaattacagtgaagatacaagtagaatacaatcactgccacattttttgaaattctgtgtaaactgtaatattctgtcaacattaatgacatttgaagtgtcctgtcaaaacaattgcagctactttatgtataaaacatattaaataggctcatccaacttgcattctttattaagcttattttcatattttttcctatggatgaacttaaaaataattttgtttcttaattaagattctatgcatgaagatgctgaataatttaagacaattgttcattcaaatagttgctaattacaccctcctggcatagttattgtattattactacatttaggaataatatgctgtactacttggacttgaaaatgtttctgacattttaatgaacacactacttagttatattttacaagggttttcagtgaaccacagaggattaaaaaatgtcattcaagggttgtagataattaaactgactgaatataagaagcctcat

SEQ ID NO: 150065 - DNA, 278 bp, Homo sapiens
ccttggcctcccaaagtgttatgattataggcgtgagccactgtgcccagcccagttttgagactggactcctcctggagtcctattctgcctgctctcttccagagctgccacacagctcccatgcttggaggtgcctccctctactgtgtttcctgcatcccatggattctttgattttttcccctctcataggggaatacatcttccaggagtttttgagaaagggttcatgagaggtgacttttctggggtagatcatctgaaatgtctttatt

SEQ ID NO: 150066 - DNA, 849 bp, Homo sapiens
ggacgcgtgggtcgacccacgcgttcgaatgataatctcaaaaatgatcttttatttttggagatttatatagatacacacacacacacacacacacacacacacacatatattttttgagacagagtttcactctgtcccccaggctggagtgcaatggcacaatcttggctcactgcaacctccgtctcccgggttcaagcaattcctctgcctcagcctctgagtagctgggactacaggtgtgtgccaccatgcccagctaatttttgtattcttagtagagatggggtttcaccatattggccaggctcgtgtcaactcctgacctcgtgatctgcccaccgcggcctcccaaagtgctgggactttaggtgtgagccgctgcacccggtccaagtaaaattattttaacaatatactatgaagagaaaaacactggctatgaaagaatatgcatagttttaccctgtttaaaaataaagattgaaagaatacatatgcaaataagtttacttttatttttggtaacactttactgcattgtctgaatattgacaatcagtatgcattatgaagctacctggctaacattgtgtactcactgtgtgtgccaggccctgggttcaatgctctacatgcacttatatttcatttaattctctctgcaacctgagatggtatagccacctcattttacagagttgaaactgaggctcagagactgaaagttaagcctgaggttgcagtcaataagaggcagagctggaactgaaacctacctgtgtctgaccaccagttcgtgttctgacggcaggctagtctgcatcacagagtgtggagtagatg

SEQ ID NO: 150067 - DNA, 355 bp, Homo sapiens
cactccggtctgtggtattatcggccccagttcaatgctgcgtacagttctcatctaaatgccatctccagcatacagtctcactgaactcacctagtattttatctccagctctcattatatctgtgttctagatatttatgtgcatataattatcttccctagtaaactctgggcagactctgtacctaatttaacttagtattttttatatcacttacacttaacatcagagaaagttaaagctgcaagggctgaggagacacacagacctgtgataatgtctttttcaaacttctttctctgtgctctagtaaataatagtgctgaaggtaggatagaccagatctcctgg

SEQ ID NO: 150068 - DNA, 293 bp, Homo sapiens
aaccctaggacattcctttgtaaacaaacagccttttaccaaacaccaactgtcaagggacttgcctgagtacttgtccaaaggacagcgtgtccccatgtgtaggcagtggtctaatctggttcctaggagaggactgctgaggccacagcaacttaactggctagtgtgggtgaggcagaagtgtttgaagctcaaggtctgtcaaggacagctgattagagtatgtctgtccctaatacagggttagagctcagtaccaatgctggggatgaggtgagttgaagacacag

SEQ ID NO: 150069 - DNA, 416 bp, Homo sapiens
gagacagagagagagaattgagtcattctttgttccctttcctgatttaaaaaagcaagtgatgcttagaaagtcagtttaacaaagtatgggtaataaaagcatcttttaatcatttgctatttgatatggcatttttatgattttatcaggcatgaattataccatttgatatatttcttaatataattaaaaagtaaaattaagtaaacatcccgtaatttggatgctagattaaaaacttaatttctaggaaattacaaagtctgtgatgaacttcaaatgtagttgacaactacactggcagttttattatttaaacatttgaactggactttgtgggaacagttaacgtaggattgggacgtttttctttgaattatttaataattgcctcttgtccgtacttgtgacat

SEQ ID NO: 150070 - DNA, 540 bp, Homo sapiens
gatatgtttcagctgagttttgctgattgggggagattagtatatttaggtcagttaaaagatcatcataaagcggcaatgggggtgcagtagcctctggtgtaggtggaagtggtgcaggcatgtcagagtggaagtcctcctttgaaattacgttctcaatttgtgtagtatcctcaggggaaagagagctgagcgcttcctcgacctccctcagaggagaggaaagagggatcagtctccatattgtcctcctgagtctgtaaggagtctaagacagagtgaaccgaagcccagattgaccaaatggtgggtgggataaaatgtccccctttatgagcaattttgaattgtttgccaatctcaacccaatctttaagttctagagttccctcagtcggaaaccaagggcaaagaagatctacaacctcaaatagttcaattaacttttcagtagaaactttaacacctccttctttaagaagagtttttataaaatttaaataagccaaatactttgtactggcctgtcccatggtg

SEQ ID NO: 150071 - DNA, 270 bp, Homo sapiens
tcttgtaatttgacagttagatgcctcagtgcgtaagaacttaagaatccaacaatttctccttttctgacacacaacctcatgtggaaacttagttggcagtagcactgtgtccttatagtcaggataccccttgggcaaggaacttggtaactgaatgctcaatgctgaacatgcacctaattttgaggcttcactgggtgccatgaagcaagactgatttgaaaacagcacttacgggatctgactgcatacatgcagagtcagaat

SEQ ID NO: 150072 - DNA, 374 bp, Homo sapiens
agggatcagccgagaagggagggaagaggcaagagaaagtccagcccctaggaagtgggcagggaaggggctctgagggatcctccaagggccctgagaaggagcagtcccatggtgcggggagcaagaggatggcgccaggaccaaggggcagcaagtggagaacagatgaggaatgagcctcttacacctccggttgggcctatttcctaaggccaatctggttgaaactgcatggactgttttctcagaggtgctgacctctgttctggacgttttctttccaaaactttaccaagaaagtctagtgagacactctgtcttccttttctcttgtggtgtgcgggggagggcaggcagcctcaggtgggttg

SEQ ID NO: 150073 - DNA, 355 bp, Homo sapiens
agtgatccacccgcctcggcctcccaaagtgctgggattacaggcgtgagccatcgcgcccggccagaattaatgtccttataagcagagacactagagagctctctccctctttctctgtctctctggaagcacacaaaaaacggtttctcagaaaatgtagagaaaaggcagccaactacaagccaaaagaagaaaccttagaatgaaacccaccttgccagcaccttgatcttggaattcttagcctgcagaatggggataaataaatttctgttgtttaagccactcggtttatgatattttgttatggcagttcaagaagattaatatgctaccctaccttcataattgc

SEQ ID NO: 150074 - DNA, 352 bp, Homo sapiens
ttccaataagttttatgcatagaaacaagacctaggatggatatggcctacagacaatagtttgccaacccctagtatagtggaaagcctatggattttggcatcacacacaacctgtctgaagtccatctccatgttcttgctatgttttctagtatatattcaaatatatatatgaattgtatatatttagttatttatataatttatctttcccattcgcacataagatccatctgcaaaaggccttaaatacttttatttaaagtactgggtgtttgagtgcagcagtagatactaccacatgctgctgtactcagacactcagaagagggctgaatgacttaatgac

SEQ ID NO: 150075 - DNA, 161 bp, Homo sapiens
cacgagcctaggggtttgaagctgcagtgagttatgatcatatgatcatgctatatattctagcctaggtgactgaatgagaccctgtctcaaaaacaagaatttactatatttttgtctgattttatgcctaatgcaccctatttcccatagaaactgtg

SEQ ID NO: 150076 - DNA, 329 bp, Homo sapiens
gtgacctaacatggctggcgtgactggcaggctttgagaactgggcctgaacttctagcacactcagcaaacttatgtggcctcactttctccagtcagattccccgaagctcgccccagaggctgtgagatgctgtttaaataacttgtgaaccagaagtatctgagacaggtcttaatttggaatgtttattttgccaaggacgtgcccatgacacagcctcaggaggtcctgatgacatgtgcccaaggcggttggggcacagcttggtgtaatacgttttagggagacctcagatattagtcaatgggtaaggtgtaccttggtt

SEQ ID NO: 150077 - DNA, 266 bp, Homo sapiens
tgcacccagcttcttttttttaattgtgataaaatgtaagcttaatctttatattacactgtctcttatgtttgaggaaaagcttagggacatctggttctcttcatgggaaggagaaatcttatctttgcagccagggaggcagctgcaccctggtacagaaggatccagaaaggccatgctgtgagaaggcacattactgggcctttatgactcgtcataggaccgaagttggccagcaagctctaagatcctgtggagaacgt

SEQ ID NO: 150078 - DNA, 805 bp, Homo sapiens
acaaaggaggctcagaggattaagtgacctgcccgcagcaacacggagaagatgtggtggaaccagggatcaaaaatttgtcctctgtgtatatagcgcctcaactttccatcacacttgccttcctggtgacctgatatcccaggattttcacttactgctctggggacacattggttaaatccaagtggtttgcaggcactgactggcaacataactgtggtcaatagaagaatgatgtactgagtggtggtcacttagaaccatgcatctgccacccctcgaggctgggccatgaagaaggcatggctcggctggcacggtggctcacacctgtaattccagcaatttgggaggccgaggtaggctgattgcttgagcttaggagtttaagaccagcctgggcatcatggcaaaaccccatctctataaaaaatacaaacattagccaggtggtatgcacctgtgatcccagcaacagcaggaggctgaggtgggaggattgcttgaaccgggtgtcagacctcagagcctaagctaagccatcatatccccagtgacctgcttgtgtacatccagatggcctgaagcaactgaagatccacagaagtgaaaatagcattaactgatgacattccaccattgtgatttgtttctgccccaccctaactgatcaatgttcttgataatttcccccacccttaagaagtttctttataattcgccccacccttgaatgtactttgtgagatccaccctctgccccaaaaacattgctcttaactccacctcctatcccaaaacc

SEQ ID NO: 150079 - DNA, 208 bp, Homo sapiens
taacattttgttgtttgccacaacattacacctgtgacttctttctttctcctgtcctcttgatgcagcatgctgtcaaactgtatcttttgagttgttctaaattgaatcctggtcaaagggatttaacaacatctaaaacggaactagcttagattctcttccattctgtagaggttcctttgttcctgcttacctacccatgtct

SEQ ID NO: 150080 - DNA, 419 bp, Homo sapiens
caagacctcctcctcctatctctcaatcaagagaaggatgctaatttatggcccaggaagagaagaggcagtgtggccttctattaatagtagcaagccaagaagcaagagatggatattcggtgcctgggtttttccctgacagttaagttgggccttagtggaggttagcatgcacctagaagccaaggtgggctcagatcccacacacaaggtggccctggaaagtcactgcctctctctagatttgatgctccctttataaaatgaaaatgtttagttcatctcagaagccccctctgtctctgacagtgtatgactatgtggggaggcaggaaccagatgagaccaaatgccagggcattacaggaccaagccgccaatcctgatgcaaatgacaagccttggaggagtgactc

SEQ ID NO: 150081 - DNA, 325 bp, Homo sapiens
tcacaaaggatgtcgtgctacctccacaaacagccaatcaacctgactttgttgcctacaggtttgtccctggctgtctttggctaattaggctttcatgatgccttattcaaaaaagaagtacattggttcactaacatctctcacatgctacaactaataggtggaaaccaatatggagatgtcaaatgagtcggtgtccaagtttgtgtacttcaaaatgctaaagaggaaaatccatacattgtgagccttatgcagtttcacaaaagacacactaaaacaaattctgaatctcaaccaccctgtttgtggaggtagcact

SEQ ID NO: 150082 - DNA, 108 bp, Homo sapiens
tgggggtgggtgggggagaagctgaagctggtaagggctccagcccatcagagagagaggctctcctagggcgtccagggctggccatctgtgaacggggagctttct

SEQ ID NO: 150083 - DNA, 288 bp, Homo sapiens
ctccctttcctcctccctaatacattgaatagtccacattcaccagcatcaagtctcttttactaggacaatggcaacaagaaatcttcaacaagtgctggcctgacccctttcctttttctacagttccagctgagcagcaaaaactgcttgaaattcagcaatcacatttctcactgtttcagaatgacctatttcgcactagaatgaaccagtgaattcatacatataaataactatctgcagaccctgcttttcaaaacatgaacagaaataagtaaaaagaag

SEQ ID NO: 150084 - DNA, 329 bp, Homo sapiens
tgctagtcactgtgctcaacacacctgatgcctaggataaaattgttgcagtagtctcctgcctgtggggtggcctcattcccatctgacctcccggcactgaagatggcctgtatcttccacctctgtggcctaaatgcccaggcttcctcctgttctagactcaaaattcaattggttctgcttgtgtccaatgccatcaccctggagccaatccctgaggccattgaaatggggatggaagcatccatgcaggaagtgagggtgctgtgcaaagaacacacctacaacaatggccctcagactcacttcttcccttccgttccagt

SEQ ID NO: 150085 - DNA, 467 bp, Homo sapiens
caaaatgtaatgtaaagattatgttctgattggtagtgtcctgaggagatctgatagtgtcctgatattttgtccgatcaagcctcaaaaaccaggttaatgtagaagtcaacccaggggatcaataatttttcagacttatctcaggatttgaactacagtgaagctcaaggtcttcacactgtcctcagtgcactataatgctatagatctagtttgaagccagtggtatccaggaccttagccagagacttcaagggtttgaagagcagtagaaaacacagcaatgcagatacttgggttactggttgtacccagtggaatgtgtacaggattctttttgactgttagaaggaaagggagaaatagagagttggataaggagattgattgattgattgattgattgattgattttgagatggagtttcgctccagcctgggcgacagagccagactccatctca

SEQ ID NO: 150086 - DNA, 226 bp, Homo sapiens
gatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttgttgtgaa

SEQ ID NO: 150087 - DNA, 347 bp, Homo sapiens
cttcagcctgaacagtgagcccaaccacactgtgctggacttgggacctatgagctgctaacgttgtagtaattaattacatagcaataggaaactcacatgacgtttaaatatgacattaaagccactcatagtcttgaggagactcttaacttttaacataatatggttattcatctgaaagaatgatccttttttattttaaagttataaagtagatgaagaaaagttggaattaaagaagtgtacccccagatattttagacataattaaatgtgtcctgtcatcgcaatgatttatagatgtattgtgaaagccattagaatgtccggagacaacttctgct

SEQ ID NO: 150088 - DNA, 278 bp, Homo sapiens
cctttctaaatgggaagatatatcctggaacttcagagatatttagaaacactcatatactgggaagttcttcctacagtctaactgaaatccctcctacgatagctgaaacccacttcttccttttctttctgtcccttgggggatattgacagttcccatccttcctcccgccaaaggttctccctttggatgctgaatactaacttcttgctgaagtcatatctacactgaaccccacgcatggtcttaggaggatttatcatgactctataaac

SEQ ID NO: 150089 - DNA, 158 bp, Homo sapiens
cacgcacttaggtgtggttcccaaaggccaactgaggaacgtaggccacaaaagacaaatcaagtgcccagagggtgggtaccagctctctcctcacatctaaggcaggactagaggatccactggtgactgtaatctctcctcaggatacgtctgtg

SEQ ID NO: 150090 - DNA, 228 bp, Homo sapiens
agtttctaaaaatatataattaaattgctgatttgtaatctttcttctttcataatgtaggcatttacagcttacatttccctcttagccctgctttcattacatcccagaagttttggtactttgtgttttctttttcattagtatggaggggttttctaatttctgtagtgactttttctttgacccactggttgtttatgttgtttaatttccacatatttgtga

SEQ ID NO: 150091 - DNA, 420 bp, Homo sapiens
ccctgatgtttctgtatcactttcaggatcattcttccctttccttgaagaacagtacatgtttgcagccaaatagctctctgggctagtcctgtagaatccaagttcagtagccttcctttattttgtcccactttgtcccttttaattcaaactggcaatgtctttgctggtataatcccattattatccctgacttgtgctgagatggctggttaagtccataagtcatatccatcttctctgtatcaaatagttgtttagccacacccttggtattctcttagaacaagctttccctttttttttttttttcttgagatggagtctcactctgtcacccaggctggagtgcagtgacacgatctcggttcactgcagcctccaccttccaggttcaagtcattctcctgccttagc

SEQ ID NO: 150092 - DNA, 446 bp, Homo sapiens
gcagagggtggggaagggccgcaggtaaggtgctgtgtcaacctgggcagttccaaaccctgcatgggaccaggggcaccgagggccccagctcccagggtagggggtcgtgccactatgcactgccttttcttcttccggtgctgctttactttctcttgctcctggagcagtgctcactggagacgctgggaccctgagcactgaccaagagtgatccctgacagcgtcagattcctatgcagaagggactgctgggtgggaaatggatcaccgacaggttctaaatgcaaacccacaggctgcaggagaggggtgaggggcgaaggagggaatcccacctctgggaaagcatcctcaggaaacctagataggtcctggaggtgaggacaatcgccaaggagggagaaggaaaaggaggaccctggttaatctgcacgccaagg

SEQ ID NO: 150093 - DNA, 275 bp, Homo sapiens
taacagcacatctgaggcaaaaccctgtaattaaactttcttaatacgtagtactaatgatcttataagagaaaaatatctattccgtgatcatcttaataaaggcttttgaaaaagtatttgataaaattaaacactaatgaccaataaaatacttaagaaatggagtagaaagatacttttttgactgctttaaaaggtgttaaggtagtaaacactactaaaaatgagccccagagcagtgttactcaaaatgttacagtttgtgaggaggt

SEQ ID NO: 150094 - DNA, 486 bp, Homo sapiens
atctgcctgcctcagcttcccaaagtgctgggattacaggcatgagccaccgtgccctgcccactgaaacttttaatttatttccatgagtggattttaactaggaagaaatattttttgctttactggcagatctagtggagtgaattgtgcaatttataagacatctatctttaacatagatactgtttttcttgtgttacattttaaagtgtattgtctgtacttttctcatattttgtgctgggggagctgagataatttcttgaatattagtgccttgtagtacaatgtaagatgctagttataagatagttgttgtttgaatcccagagtcctcaaaacaatcttttattgctaggaagccagaatggccttatgcacaggtagggttaaggaatgcattcatttgttcctttattcaacaaacattaattgcatgtctgctgcgtaccaggtattgcattaagagctgaggatatagca

SEQ ID NO: 150095 - DNA, 312 bp, Homo sapiens
aaaaactatgtctagtataattccaatttgcaaaaataatttgtgtgtttatatgtatgtgtacagaatatatgctacatattaaccttaattatctgtggtttgtggatgtagatgattttaattcccttctttgtgcttctattcttcaaaattaccacaacaagtattatttttaaaagggtggaatgagaatgccctggggtatcttataagaatgtgatgaaagtctaaatttaaattataaattaaatcatgcacatttattgtattattgttagatattagactgatctcaagctttgcctttct

SEQ ID NO: 150096 - DNA, 519 bp, Homo sapiens
ttttagggagacatgagacagcaatcagtatgtataaggtgtacattggttccatctggaaaggggacaactcgaggtgaaggcgggacaactcaaagtgcggagggggcttccagatcatagatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150097 - DNA, 512 bp, Homo sapiens
cgtaattcaactgtttatagaggaaaaatcacattgccaggacagtccctttggggcaacactcgggctgaattcgggacaactcaaacagcggagggggcttccagatcatagatatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150098 - DNA, 464 bp, Homo sapiens
  misc_feature (18)..(18): n is a, c, g, or t
ttaataaaattttttttntattttttattaggtttttttgtatgttttaaggtttgtggatactattaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150099 - DNA, 451 bp, Homo sapiens
cccatacacatcaccatacctcccccctccactacgcggagacacagacctactaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150100 - DNA, 454 bp, Homo sapiens
ttagatacgggtggaggtgttggtaggggccgaggtggaggggtaacccttttgactaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150101 - DNA, 451 bp, Homo sapiens
tggaatgggaagacggtaggagcgcgggtatagcattttcagaggcgcactgataatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150102 - DNA, 450 bp, Homo sapiens
tgagaccaacaaaccacaccccgccgccgccacccctcgcggggcgccttagtgatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150103 - DNA, 454 bp, Homo sapiens
gaatataaaaaatatgagaagagaattttagtgtgtcggagaaggaagtgttctgctaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150104 - DNA, 568 bp, Homo sapiens
ttttagggagacatgagacagcaatcagtatgtataaggtgtacattggttccatctggaaaggggacaactcgaggtgaaggcgggacaactcaaagtgcggagggggcttccagatcatagatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgcaaactatataaacgaagatcatataacactactggcctccttggcctcac

SEQ ID NO: 150105 - DNA, 813 bp, Homo sapiens
  misc_feature (1)..(1): n is a, c, g, or t
  misc_feature (21)..(21): n is a, c, g, or t
  misc_feature (23)..(23): n is a, c, g, or t
naaaaaataaattaaataatnangtatgtggaggaagaaggttaaggtttctaataatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgcaccaaaaacaaggcgcataggtccgcgggggcacgtaccgtcgcgctctcagttcgcgctcgcggtgtgcgccgcccttctccggcaaggctcttccctcttcctcctactgcgccggcgtcctcgcccccccaccccccgctccgggttgcgcgtctactgtcctggttcctcgggcgcccgacccgcgccccaagcgcggcgggggccctagcgatggtgccgaggcgcggtcccgcgcggtgcgccgtcccccacgctccgcgtggcgggtgctgcgtcgctgcgtcgcgtgggtggcccctcccggtcgagggacccccgcgccgcgcgccgggtttccccgcgctccggagtccgac

SEQ ID NO: 150106 - DNA, 487 bp, Homo sapiens
gaatataaaaaatatgagaagagaattttagtgtgtcggagaaggaagtgttctgctaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgcaaaaaaaacaaaacaacggcctccgcggccccac

SEQ ID NO: 150107 - DNA, 446 bp, Homo sapiens
cccgcgcgacggattcatcatgcgcgtccgcgggtgagaggccttgctagatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150108 - DNA, 458 bp, Homo sapiens
atttttgtaataaaacccccaaccaacaacgtcgcgtgaagcccccacccccaccccccataatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150109 - DNA, 452 bp, Homo sapiens
  misc_feature (54)..(54): n is a, c, g, or t
tatccgaaactaaagtaaagagaccctcaacgcacccacaccccaggcttttgntaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150110 - DNA, 444 bp, Homo sapiens
gagaactagaaagctaagcgaatcatggagcatagcgcgagtctagtaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150111 - DNA, 434 bp, Homo sapiens
  misc_feature (29)..(29): n is a, c, g, or t
aacatatcaacgagccggaaagaaaaagnactttaggaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150112 - DNA, 582 bp, Homo sapiens
ttttagggagacatgagacagcaatcagtatgtataaggtgtacattggttccatctggaaaggggacaactcgaggtgaaggcgggacaactcaaagtgcggagggggcttccagatcatagatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgcatgcatgctatgtgtgcatgtgtgtatgtaaaatcaaaaaagaaaatggcctcgctggcctcat

SEQ ID NO: 150113 - DNA, 883 bp, Homo sapiens
ttttagggagacatgagacagcaatcagtatgtataaggtgtacattggttccatctggaaaggggacaactcgaggtgaaggcgggacaactcaaagtgcggagggggcttccagatcatagatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgcaaaaaaaaaaactaacaatggactccttggcctcatttgtggcactctgtgggccgttccctttatggagggctattccacgttcctcctttacctgctccgcttcgtccccacgcttctgctgatacttttagctctcattacgctatccgcgtcgctattggtcgacttttgcgtagcgcggcccggggctccggggaagctatgtccccgcgcgtttatgcggcggcccgcctctcgcgcttggacaggctgctcgtgtcgcgcgtctcgatgtcgagtccgcgccgtcgtgccggatcatcctcgcctagcgatggccctccccttcgctcctcggctttcgctcgctcttcgccgccccc

SEQ ID NO: 150114 - DNA, 880 bp, Homo sapiens
ttttagggagacatgagacagcaatcagtatgtataaggtgtacattggttccatctggaaaggggacaactcgaggtgaaggcgggacaactcaaagtgcggagggggcttccagatcatagatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgcaccaaaaacaaggcgcataggtccgcgggggcacgtaccgtcgcgctctcagttcgcgctcgcggtgtgcgccgcccttctccggcaaggctcttccctcttcctcctactgcgccggcgtcctcgcccccccaccccccgctccgggttgcgcgtctactgtcctggttcctcgggcgcccgacccgcgccccaagcgcggcgggggccctagcgatggtgccgaggcgcggtcccgcgcggtgcgccgtcccccacgctccgcgtggcgggtgctgcgtcgctgcgtcgcgtgggtggcccctcccggtcgagggacccccgcgccgcgcgccgggtttccccgcgctccggagtccgac

SEQ ID NO: 150115 - DNA, 571 bp, Homo sapiens
ttttagggagacatgagacagcaatcagtatgtataaggtgtacattggttccatctggaaaggggacaactcgaggtgaaggcgggacaactcaaagtgcggagggggcttccagatcatagatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgcagaaaatcaattacacactggaattaaaatcaaaaatggcctcgttggctcta

SEQ ID NO: 150116 - DNA, 441 bp, Homo sapiens
gtacttgcgaggtagagcatgatacaagtcttcgagtccttcgcaatccaccctgatttcagcgggcgttcctgggtcttgtatgcactaggtgccctcaatgcttggcaactggaatgggttagcctggaggcatttaggctgtccttctacaaccacagaagagccatcactggcagagagatccttggcgcagttaagcagagatcttctcagaagagcttttgaataaatgaagttgttcagaatggccttgttaaaatgactcacttgtcaaaaaactagatgtgttggaaggctgggttggaagacaagatgtctgagaagctgtcctgctgcatgaggagtttcattgctacacacctagtctctgggtcctgtgtttttggcctccagcttacttcgtgaacataataaaggaaaggcattttctcttgtgca

SEQ ID NO: 150117 - DNA, 152 bp, Homo sapiens
tcctgtggaattcttgggtgataaaagtcttgccttctaaagactacttcacttagggataactaataggcctggactggacaaatgcatacatctgtaagctcaagagccactccataatgaacagtcccacctaattgcttctttttttc

SEQ ID NO: 150118 - DNA, 579 bp, Homo sapiens
ctctatttagaaatcattgttttaagccatggactgtggcagttcctagagcaattggccagtcactgaacatctgttgcttcttccctccagctgttgggttcggatggtagcaaacagtgtgtccacaaataaacagttgacgctttagaagatttcataggactggtcaggaaatgcctttgttggtatctgcttctactggaaggaccccttctttgtaaacacatcactagctcagtatatgttttggctttaattcttggtattcttttgatcttgaagagcaaggcagagagccatctgattgtcaggagatttaagaaacaataataatcacagtgatggaaatgccgcttatttgtgtagggccatatcatttacaaagtgaattcatgtacacaagcccagagagaaaagcaagctgatgatggcaggttccatgtgccttttatggttcattagagttcttcagcatcaaatgccctcccattcattgctacactcattttactgcttgctcatttcagtcctttggtactctagtgacacaacaggtttctgtgtttgatcctgtcc

SEQ ID NO: 150119 - DNA, 467 bp, Homo sapiens
ttcattggcacaaatttccaaacatgtcagacttgaaactaaccagcaagggattgctttgctggaaagtcattctaaagtctaaattcttattctaagatccagggctgaaaggcaaagtaaattcctcgggcaacacagttttggagaagtcatagaaagatctcccaaaatgttactgagtcttttcccaactaagcttttagctattccaattaactaaaaactacacatttataagcattaaacatgctactgtttaggctaaaatctcaaccctccatttccattcagtgaagcttttatccacaacaatcactttaactcaacatggcagccttgcaagggttaccatggcagagttctttggttactttggttacctcctgagctccacactctggggaagtgtgttttatgcgggaaagagcattgagggggaaacatgcccatgggctcaaactgga

SEQ ID NO: 150120 - DNA, 657 bp, Homo sapiens
ttccatgtatcatcagtctatatatatcacaaagtcccccgaaatcaaacctcattatgataggaaacattccatgaactgtctcttgtttgatcaatattaagcagatgtctgttaaacagataatgaaagagtttttaaagttgaatatggtagtcctacctacatttttccaataataatagcaataatgctgctaatgagcataaatcataatagtaaaaataataataaaagcaagcactgtttatgaatgtctactttagcacctactacattcaaaagcattaaatgtttctgttcctcatatcaacactgaaatattatcattattacatttttaatgatgatgaaactcagacttatgcagattgttaaggccaaaatgttagaattaggattctgactagttatttctggctctaaataccatgccttggtatttctattacttcatgctacctcagtgactcctaatccatgggtaaggagagaatacagacaaaccaccaagaaaatcaaatttgtggtccatttttgttaatcatagtattccggcaaagtggcaaatgatattactggagaattagtacatatgatccctatttaaagcctaaacaacgattataataatacagagagtaggctgggcgcggt

SEQ ID NO: 150121 - DNA, 281 bp, Homo sapiens
ctttccttaacaaggagcaattgcctccctgagcacatttggttctcctatagacgttaacacaacaggagcctctatttctactgagttttaaaagggttaagtgtcagacatgatatattactgtgaaatgtcatctaaaataaatgaggctactgcccttagagaaaggatcattgttggccatcaaagaaatagcactgacattcagtcatctcactacgctttagggtgaaggatcactttaggcaaatagcaggcaacttgtaagtacttatttt

SEQ ID NO: 150122 - DNA, 194 bp, Homo sapiens
gtttgcagaactcttaagttgaagagctaggatcacagactcctaacattccattcattatacaagttatccctaccttccagatcagcttacctacctgctgtctgtgtactacacctcaccacctgggtgtctctcagacgttaccaagagacagagtaaacccatgctttctcctatccaaaccagtctct

SEQ ID NO: 150123 - DNA, 373 bp, Homo sapiens
tatttaaatagattaattctgcactaagtaggacaaagaaagattataaatgtccttacaggtgaaaacagctccagcgtgagttttggcaccacactggtagaaaacacttggtgttcagacccttttggacctgggggaattgcagagtaaggaatcttgcccacctgcccttattgtctgtggtgaggatgaaatgagatcattgcagataaatgttcttagcaccctgcagggaaagcacttgtttgctgttggctgctgctgctgtggtcttaagagataaaatagagacactgtcaacaaataagagaacgcttacccagggggaaggcacttctgtaggtttttgatgtaaacaagctgttaaagg

SEQ ID NO: 150124 - DNA, 612 bp, Homo sapiens
tcaaaaaaaaaaaaaaaaaaaaaaaaaagaaatcagatgcagatctcgttctcagggattttatagtccagtgggatgggagtggtgagcctgtagtcaaggacaaggcaggaagtgttgagttgagaaaatggagtgggagtttagagggaaaaaagcttgagaggaggtagcactggaaccagtcctcagaggaaggtggggtagtagggtgaggatgtaaggggatgaggtaggtggggtccagcaggaccatggtaggcaaagtcgtggaggcagagaagtgtgatctgacttaactagaatgtggcagtgaaaactggaaaggtaaatgtggccaagaaggccaacaagcacggagaacggcctccaggggactgccctcatggcggaactcagagcttccacataccaggctctgcatggaagcattcttgtacacccagagctgtataccgaatcatactggtatccagggctcaatgtaaaagtatgcacatgcacacgtcagtacacggaatcacatacatcaccggggtcatatgctgagccatctgccacatcgggggctatgttcagaaccacacatgtccttggggctctggagaactg

SEQ ID NO: 150125 - DNA, 868 bp, Homo sapiens
atttagcttgacaagtcatgagaattaagagtcaagacaagccatggaaattaggagtcaagacaaatgatgagaatcaggagtctaaagatattctcttacaaggaaactcttcattttgaaaatattttccaattgacacttcttttgcaagcatgagttacacctcaaaagaaatatgaattcatcaatgaaagaaactctacgttaccaaactttttttccatttcttaactagagtctggcataaattatgccctcaataaatatttgctaaatatttatttgtataaaatcttaaaataagttaaataaaagcatattcagaggatgtgttgtttctggttatgaattgagaaataatttttgtctatttatgtattattactctgcaataatcaagcataaaaaaggatattgcgtttcactttttagtactttatgtatataaactaatttatactctcattgtttaataagtacttgcaattttctaaatgtattacttatgtgctttaaataacattaatttcaatgtagagggaatttgcttgcctataatgcatttttcccaatatagaatgaaatgtattttgtcacaaggaaaatatgtggtttgaggctgacaatcatacagagtgcaaatgtatttgtggtggatcatgaaatataagcttcacacactggttatttcagaaaatcgggagtcagccaaatactttagaccataactttatgaagaagcaaatattatatgacttttgtttgcctttgaactgaaatactcacctgtaatactttctaccaaagagatatgaagtggaaaactaattgataaagtagattaaagacaatttctgaggccatt

SEQ ID NO: 150126 - DNA, 329 bp, Homo sapiens
cgggtgcgccggcctggcccgaggggttggtatttaaaagcaattcgatatatctctccttttaactcttcattttgaaaatattttccaattgacacttcttttgcaagcatgagttacacctcaaaagaaatatgaattcatcaatgaaagaaactctacgttaccaaactttttttccatttcttaactagagtctggcataaattatgccctcaataaatatttgctaaatatttatttgtataaaatcttaaaataagttaaataaaagcaacagatgcgacaggccccttttttcccgtgagtggaagtgatcttaaaagaaa

SEQ ID NO: 150127 - DNA, 276 bp, Homo sapiens
cgggtgcgccggcctggcccgaggggttggtatttaaaagcaattcgatatatctctccttttaactcttcattttgaaaatattttccaattgacacttcttttgcaagcatgagttacacctcaaaagaaatatgaattcatcaatgaaagaaactctacgttaccaaactttttttccatttcttaactagagtctggcataaattatgccctcaataaatatttgctaaatatttatttgtataaaatcttaaaataagttaaataaaagca

SEQ ID NO: 150128 - DNA, 320 bp, Homo sapiens
atttagcttgacaagtcatgagaattaagagtcaagacaagccatggaaattaggagtcaagacaaatgatgagaatcaggagtctaaagatattctcttacaaggaaactcttcattttgaaaatattttccaattgacacttcttttgcaagcatgagttacacctcaaaagaaatatgaattcatcaatgaaagaaactctacgttaccaaactttttttccatttcttaactagagtctggcataaattatgccctcaataaatatttgctaaatatttatttgtataaaatcttaaaataagttaaataaaagca

SEQ ID NO: 150129 - DNA, 370 bp, Homo sapiens
  misc_feature (323)..(323): n is a, c, g, or t
atttagcttgacaagtcatgagaattaagagtcaagacaagccatggaaattaggagtcaagacaaatgatgagaatcaggagtctaaagatattctcttacaaggaaactcttcattttgaaaatattttccaattgacacttcttttgcaagcatgagttacacctcaaaagaaatatgaattcatcaatgaaagaaactctacgttaccaaactttttttccatttcttaactagagtctggcataaattatgccctcaataaatatttgctaaatatttatttgtataaaatcttaaaataagttaaataaaagcacangatgcgcgcagaccccccttttctcaaaaaatacccggttccccaaa

SEQ ID NO: 150130 - DNA, 398 bp, Homo sapiens
  misc_feature (352)..(353): n is a, c, g, or t
  misc_feature (388)..(388): n is a, c, g, or t
atttagcttgacaagtcatgagaattaagagtcaagacaagccatggaaattaggagtcaagacaaatgatgagaatcaggagtctaaagatattctcttacaaggaaactcttcattttgaaaatattttccaattgacacttcttttgcaagcatgagttacacctcaaaagaaatatgaattcatcaatgaaagaaactctacgttaccaaactttttttccatttcttaactagagtctggcataaattatgccctcaataaatatttgctaaatatttatttgtataaaatcttaaaataagttaaataaaagcaaaaaaaaaaacagtggcctcgccgcccccaannaaggggctctgcccccgcccccctcgagagaggcngacgccataa

SEQ ID NO: 150131 - DNA, 373 bp, Homo sapiens
atttagcttgacaagtcatgagaattaagagtcaagacaagccatggaaattaggagtcaagacaaatgatgagaatcaggagtctaaagatattctcttacaaggaaactcttcattttgaaaatattttccaattgacacttcttttgcaagcatgagttacacctcaaaagaaatatgaattcatcaatgaaagaaactctacgttaccaaactttttttccatttcttaactagagtctggcataaattatgccctcaataaatatttgctaaatatttatttgtataaaatcttaaaataagttaaataaaagcagcgcgatgcggccgatcttttatgtgtgataaacgaaataaaaggtcgaccgg

SEQ ID NO: 150132 - DNA, 319 bp, Homo sapiens
taagtgatccaaatttgccactggcaatttagaaaccagagaaagaaatgcacccggtcagagaaagttgaggctacatgacagagaaaagccaagaacttgatatttcacaggaatggggtaagacttgggagacctatgactttgccttcattgcactggacagttgttctttttattaataaatgtccttggagtgacaattctgctcttcaaagataaaagcggaagctttcagagacagtcagaaagggattcgactattttaattaattcatcactctcactaggtaacagcctctcagtaaatgcctttatc

SEQ ID NO: 150133 - DNA, 414 bp, Homo sapiens
aagagggcccagaatcagtgtcctctatcccctgaactcacatgtgtgcatgcaatgtgtttatgcatgtatgtgtctatgtgcatatgggtgtatttgtcttgcttctctggcctggcctagctgctccactcacaggtgcacccaggtcctcatcactatcaccaccagggcccagggccaggattagagaatccacaggtgctccccaatctctgccctccccaccgagtgtggtcctggggatgcagacagaggaggggcgccgagcagagtagagcgggctggtaccctctctaggtggaacccaggttgtgtgtaaagttggaggtctgccaagcagtgctgaattcaacacatcttctcacattctctttccagcaacgctccagggtgccctgactcaccttccta

SEQ ID NO: 150134 - DNA, 255 bp, Homo sapiens
actgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagg

SEQ ID NO: 150135 - DNA, 443 bp, Homo sapiens
gaggcacaagttaaaacatcataaaatgtcatttatgggtcctgccaagattggaaaccatatattcataacagcacaacaatacagttggcaagcagaaggcagctcttaggattaatccaggactgagaggtttgcctggtggatgaagtcgcagaggctgccggtgccctcccagacctcccagacactcacctttcctgtgcatgctgacagtttcttcactggagcagctgagactctccacctcagggtttttctctagctgtgtgagcaggcctcgccctcagacaaaagggaggtgagaagctcttaaggaagaagttcccctgggagcagcccacagccagtgacccatgaatgttggtggatgaacaccctagctccggtgcctctggagggaggaccactttgagacgtgctcctccttacagttgtccaaa

SEQ ID NO: 150136 - DNA, 270 bp, Homo sapiens
gtttattgtctgttcccccaccaccccactggaatgtaagcttcctgaaggctatatatggttttctcaccactacacagaaagatgcctggcacatagcaggcattagccacaagtgtattgaataagtaaatgaatcctatttgcatttgaccattatcaagctcacagtatcttactcataataaccaaagcacatataatagccaattaaccttacaataagcaactaaaaggacagataacagcattctgtttttattaaggatg

SEQ ID NO: 150137 - DNA, 1003 bp, Homo sapiens
aaatataaaagaattaacttgtcgtggtgatgtagtcccagctgttcgggagggtgaggtgggaggattgcttgagcccagggaggttgaggctgcagtgagctgtgatcgtgccgctgcactccagcctgggtgacacagcaagaccctgtctcaataaaataatacataaataaaataataaaataaaataaaataaattactgccaaaaatccatactaaacacactctccacattttaatgactatctcagtattactgatttttccctttccctcaggcttcagtatagctctccaagacactgttgctgatccttagctttaaattcaaataatggccaggcacagtgtctcacacttgtaatctcagcactttggaagaccgaggcaggaggatcccttgaggccaggaggaggttgcagtgagccgagatcgcaccactgcactccagccttggtgacagagcgagactccatccaaaaaaaaaaaaacaaaagaagaagaagaaaagcctttactccagatgtagagcagatgagctcatccatcatgattctccgggatatttactgccaagcaagattataggtgaagtcaatgtgccaacacggaattccggtaaaaggcttctggaaccctttgaaggtagcagcccttctctggacttctttatataccccgggacataaacttctggctagaggggggtggcaaagaaactgggatgggtacgcaaacgtaaggagagccacggtaaacagaccggggatcccagtaagcgtacaaagaacacactaaaggcccgcactggggcgcaacccgcctggaccagggacggggagacacgccagttagtgatacaacccgctgtgcaacaattgagcctagacccaaaagaagaagacacggcggatcagcaggaagagacgaccgaacgcacaaagacagagacgatagaacgctgcacgcaaagcaacgcggaacacaccacctgagca

SEQ ID NO: 150138 - DNA, 533 bp, Homo sapiens
tttatatccaggagttcaaagaacttgcctgtctgatacctctcttgttcacgacagggccaggccttttgagtggctgttacctacctctaagggtatgatgatgaattttatgtgtcaatttgactgggccacaggatgtttagatatttggtcaaacattattctggatgtttttggatgggatgaacatttaaatcggtagactgagtaaagcagtttgtcttccataatgtgggtgggcctcatccaatcagtaaaggcctgaacagaacaaaacagatccttgctctgagtaagacagaattcctcttgcctggctgcatttaaactgggatattgactttttcctgcctgtggacttaaaatattggctcttcctgggtctgtaactgctagcctttggaccggaactgtaccacaggctctcctgggtctctagcttgctgacttaccctgcagatcttgggacttgggacttgtcagccttcaataagtgtgagccaattctttgtaataaatctctttacaca

SEQ ID NO: 150139 - DNA, 319 bp, Homo sapiens
tccagaccaacccaggacatgtgatggggaagaggacgtgttgcaaagaataggtggtagggcctgtctggagctaggtagaggggccagcagctgggagggtgcgctggggccacatggctgtgccctcactgcaccgtctgcacagcaggctgtggcaggtgctaggggtttgggagacctgagaagaggctgttgaaattgtcttacttgggcggcagagagctggcttgggaaacaggcggtgcggatgggaaggggaaagcaggtggcagtgtggcctctggagaactgtggcgctgacacgggctaagcagga

SEQ ID NO: 150140 - DNA, 453 bp, Homo sapiens
ttgaggacccccccgactagccgacaggagggaagatgtgaccatgacaggagcacaagaagggcagatggggacacaggtgcaggaggagaaacaggggtctacggggtacagcaggcaggggtagatgggatgcgacacacaaacccaggaacggaaatggaaggccgggagagggaggaagaaagagaggaacaggagagagagggagagagagagagaggaatgcagacagggggaaaatttgaagacacaaaaagggggccaggaaatggattaaaccgagggggaatgggctgaagggaagggggagacctgagaagaggctgttgaaattgtcttacttgggcggcagagagctggcttgggaaacaggcggtgcggatgggaaggggaaagcaggtggcagtgtggcctctggagaactgtggcgctgacacgggctaagcagga

SEQ ID NO: 150141 - DNA, 358 bp, Homo sapiens
gtggtgcaggtggggtcccctcacctgatgggccctcgaggccaggctgtaggcaggcaggagggggctgaagcagtggggtcaggcccggggagcgggggccctgccttccttcctcaacacacggggctgcccaggccccgctcctggggccgggcccacacctcacagacactggtgttggatgcttcggcttgaaggagctccaaatggactagccgcagctgcccctgggtccacctggcccaggcaataccacagaatcaccaaggctcatctagccatgggcccaaacccaaggccctaagaggcaccccgggtgcctcagtcacagtcccaggcagctcaggtcccaggc

SEQ ID NO: 150142 - DNA, 146 bp, Homo sapiens
aacacagcggtcaatgcaaaaggaaaatatagatattatatacctatataggaaaatatatgtgatatataagtgaaaacagcatactactaaattatatgtagttctcggcatgtgcaaaaactagaatgtaattatgtaactat

SEQ ID NO: 150143 - DNA, 361 bp, Homo sapiens
atcagctcggtccatggtgagcagaggccatacaataaataagttaatatatttgattacaaatcaagacacaaagaaatctcagtcctgataggcttaggcaaatactgaagtcctgtcttagactttttttgagacagagtcttgctctgtcacccagactggaatgcagtggcacgatctcagctcactgcaacctctgcctccctggttcaagcgattcttctgcctcagcctctggagtagctgggattacaggcacccgccaccacacctagctaatttttgtatttttagtagagatggtgtttcaccatgttagccaggctgatctcaaactcctgaccttgtgatccgccca

SEQ ID NO: 150144 - DNA, 425 bp, Homo sapiens
cccagtctggtctcaaactcctgggctcaaacaattctcatgcctctcagtctcccaaatttctgggattataagtatgagccaccataccaattcaaaacgcatttttgatgtacataagcattcccatattctagatcagatacctttctttactggtctcctttagccaaagaaaataaatctataccctaatatttacaggacattgatgctttcttatgcattatctgagagataaaaggcgaaatcttctggttttgtaagtgtgtccaagttcaactagactcatatctgttaatgacagcaaagcaggaggggggagtgttttggggagaaacaactcatcttttaaaaatattcttactcattgtgtattggatattgtgttactcatattatatgaaatttaggactagaataat

SEQ ID NO: 150145 - DNA, 439 bp, Homo sapiens
tgcttgaaacattttagtgatttcctaccatcttcaggaaaatttccaaaatccttaagatgttgtacaaggacctacataatctagaaactccaaatccctccagcttcatccagatagcacacataaagtaccattctctttttcacatcaaggccttcatgcattctgttctctttacctggagtgcctcatttatttactttctgttcctcttaaacatttctctgaagactcctactctaattaccccagaccactgaggcgggatcccctatcacatacttccataacattctatacttatgcacacaatccccataattcttactacttgtaaatgtgcttagcttgttcattaaagtataagctaaaataagagcaggggctgagtccttgttcaccattgtgttttaagcacatggcattatacttggca

SEQ ID NO: 150146 - DNA, 376 bp, Homo sapiens
cagcttctccagcctcctgcccttcccacttccagtcctgcacctgctgtcctcactgatgcacctgcccttttccttccgtcctttatgtggcacacccttaagggagacatcttcctgtctgtgttttgcaccctcttaaaactacattcctttcccttcagcattggcatctctgtccttgtgtattacctgggatgactattcagttaacaaatgctttcttcctaggctgtgagcccaagtttgttggatgattggatgggggctatcagcgcgttggaggctatcagcgcgttaggaggctatcagcgcgttaggaggctatcagcgcgttaggaggctatcagcgcgttaggaggctatcagcgcgtta

SEQ ID NO: 150147 - DNA, 426 bp, Homo sapiens
cccgccaccatttacaatgtgcctccctggctccccttgctgcatcagcttcacttctagggctgcgtctcccccagcacacaaatggtatctctccaacattgttcaggttgcaaaagacgggatccagcctaaccttccatccacaggggatgaagggttaaatgcatcatgacacactcatgagacggaataccacgcagtcactccagccaatgaggcaaggccatgtgtcctaagagggaacgatctccaagagatgtggggtgagaatagccagggaggcactccagtgccaccccggtggaaggcagacaaggagctgtaaataagcctcacttgagattatgtgagaaaggacaagcgggaattcacggcatggagaggccctgccctgcggctcactgtctgctgtttcctgggaac

SEQ ID NO: 150148 - DNA, 1416 bp, Homo sapiens
aggccgacataaccagggagggctagctgctccaactgtgtgctcccactgtaattgtatttacccatcctggtgtatatctggtcatttcacaatggcctgtcgctccctgtctgtctccctgttaggctgtgaactccttgggaatactcctgtatcttgctcatctaatactcccagaacctcatgcatacctggcatgtagtagatgttcaatacatttttgaatgagtgaaagtgtgatagagggcagtgcccttacaatttctttctgagatcttgcttcctgaccacaggattcactcgctgaagaggagtgatcagtttcataccagcagcaccctctgcccactgacagatggttctccactgggaaactttcttcatccccggtggtatttgaagggagttctctatacatgtttaccttgtaaaatttccctccgtcagtggccctggccttgctggccttcccattatacctcttggggggcactactaatacccatgtcttctgctgtttctcaaaaggcccctagccttactatccaaatagacactgaaaaggggtggaaatcctgggggcagtcagctctcagagggtgcctttttagtgtctcctgcccctctggtttgccattgcctggctcctgctgagtctggagtggggccctatgtgtgaagcagtagcctcctgttagagtgctccagaccatctcagtgtgaaccaagggctgttgtggccaagagctcggcatcccagagtcagtgacgagaagggaggaggcaggccagggcaagaacatggctcagacttgtgtgggagtgtattagtcggggtttttcagagaagcagaaccaataggttgtatacagaaagagatttattataaggaattggctcatgcaattatgtaggctgacaaatcccaaagtctgcagggtaagttggcaagctggagacctacgagagtgtaggcctggtctgaggaccagcaagctcacaacccaggaagagccaatgtttcagtttgtatctgaaggcaggaagaagccagcatcctagcttgaagccagtcaggcagcagcaattctcttacttgtgggacagtaaactttttgctctattcaggccttcagctgattttttgaggccacttgcattggtgagggcaatctgctttactccaactcattccatttagatgtgaatcacatccagaaacaccctccccaacacacccagaaaaatgtttgaccaaatatctgggcaccctatgacccagtcaagttgacacataaaattaaccatcacagggagcaatagggggatcagatgactctcaactccagctgttggaagtcacacttaacgtacacacacatgtacacacacacacacacacacacacacac

SEQ ID NO: 150149 - DNA, 428 bp, Homo sapiens
aggccgacataaccagggagggctagctgctccaactgtgtgctcccactgtaattgtatttacccatcctggtgtatatctggtcatttcacaatggcctgtcgctccctgtctgtctccctgttaggctgtgaactccttgggaatactcctgtatcttgctcatctaatactcccagaacctcatgcatacctggcatgtagtagatgttcaatacatttttgaatgagtgaaagtgtgatagagggcagtgcccttacaatttctttctgagatcttgcttcctgaccacaggattcactcgctgaagaggagtgatcagtttcataccagcagctcgcccctgagttagcagctcgcccctgagttagcagctcgcccctgagttagcagctcgcccctgagttagcagctcgcccctgagtg

SEQ ID NO: 150150 - DNA, 1074 bp, Homo sapiens
tcaaagtttgaggttaaaaaaatgttaaaagatgtgagttaaagtttatgtgtgtgatgtgacttaactatgcagaaaatatttaagttggatgtacttgttttaggtacatctactatacttattctctcaaacctgggtaatagtttctcagtgttcaggttaccttgagaaaggccatgcttagcgaactggatttctcctttgagaaattttagtatggtttgaggaaatcaagtgataaaggagtatgctgaatatgcaatcatttacttctactgagtgctgcattttaagatgctagatgagaagagtagttggttttgcttcattatgttttatgtctttgagagagatacaggtcttggaattcactttttaaatgttacgttccaaccttatatgttccaaggtgcagtgcactgtgaatcttttatttttaaaaaaatttgtaggtgcttttatgtataactttaatgatttataagatgctaaatgaattgtttttgtacctaaccattgtaatccaaaagataagggtgtggtttacatgcttttcaaaaatttttgttaagaagtagcaaatgaatggtttaggatttcaaatagtgataccctcctgagacatgagcatttggagaggcctgagaacctaatagaactcatatagtgtgagtgaaatttgattaaagatgttggaaaatgaagttggatttttgtattcatgtataaaggaaagtctcccagtgctgtcaaaggaattgtggttactacttgctgttctgagctttgaatatcgttatttttctattaaatatcaattagtaagtatagctaatgaagacatataatgaaagtaattttatgctgtaagattgaattggtacttttccttattaaggctttagtaatttgtatgtaatgtcaaataaaaggaattcaaatctgagtaaataacagcctcctactataggaattagattcttctataaaagtcaccatattgtatcctatagaaaagttaaggtctgagtgcatgtgtgcattaaaaacatttcactacctaaaatctca

SEQ ID NO: 150151 - DNA, 543 bp, Homo sapiens
ccacccggatcattttcttcttccgggtatatttagggccagcaacaggtccagcttaaagacatttccaagctgctggaagccaggcatgatgacatgatcaatatccgggcctgagatgtaagcaccagtgttgtgttgaactccaggaaacctctaagagaaagctgccctgctggggactgagcttctccggcggtcctgcggttccctctcctccacgctgtgactcatccatgacagccatcgacggtcaggtcacggaggtcacacccaagcacacacgagtgaaccacagaaggctgtcctggatgccaagcagtcactaattctgccctagtctgctgaccttctatgtggaaaagaagtgcacttctgtatagttcaggcctcctggtctctttcatattcttgatacggtgaggagtacgtcctaccgctgtttacctccagattctggtgcagccttgtgtatttatcgcagcactagtcacaacagcaaagtcatggaatcaacctaagtgcccatcaacggatgaccgg

SEQ ID NO: 150152 - DNA, 223 bp, Homo sapiens
ctgcctcagcctcctgaatagctgggactacaggcataagccactgtacctcgactcatctcatttttctaccacctatttctagacctcacactgaccctagaaagttgaagggaaggatgcacacaagtatcttaacaaaacatttggagaccataaaaacaacatcaggatgactttgatgcatcccacatttctctccagttctaattcttgtcctgaa

SEQ ID NO: 150153 - DNA, 509 bp, Homo sapiens
aaaaaacagagtattacaagagatgacacatttgaaacacttggaacagtgctgggcatggagtagtcactctgaaatgttagcagcattaccatcttcatgatatggctggcattgtgctggagatgccaaattaataaggcctctgaggctcacagtctgaggagggagggagctaactatccttgtgtgctaccacaccacaagtaaaacataaacaaggtgtgacaggaacccaaaacaaggagcgaccagggtctgggctgggtcagcttcctaaaggctgggccttaaaagacaaataggcttttaagctcttgaggtcggagttggggacagttggaggtgagtagagtcgaacttgggtagggcctgtggtagaaactatctgagggccaaaggccagggtcattgctctcctatatgctccagctgtcagagctgtagaccagatggaaagatggttaggtcttatccagacaagaaccacacggcgtaccgaagctcga

SEQ ID NO: 150154 - DNA, 431 bp, Homo sapiens
aaaatcctgacctttgattcacacaaaatcagactatattgcccactctccctcattctgggaagatctgggttcctggttccctgtcactcttcatcactcctgtggccatgactctaagtgaattcagtagccacagagatgatcattccaataccctggcttttcagtccctgttctctgccctaactccaaggtcacacaccacttcttagctgaaattcctccatgttgctctcccaccaccaacatctcctgtcagtttcccatctctgataccacaacttcagcaagtctctgaccccagggagacctccaacccattggatactacagcttttcactgtccctcaccctcctcatgtccaaattcacctccttagccaatttaaattccacagtcaattgtcataaccactcccttccataca

SEQ ID NO: 150155 - DNA, 502 bp, Homo sapiens
agactggctcttgttctgttacccaggttggagtgcggtggcgtggtcgtggcttactgcaatctcaaattcctgggctcaggtgatccacccaggtagctgggactgcaggtgtgtgccaccacacccagctaattttttttaattgtttttttgtagagactgggtatcgctatgttgcccgggctggtcttgagctcctggcctcaagcgatcctttcacctcagcttcccaaagtgatgggattgcaggtgggagccactgcatctggcccttgtctcttatttctgtcatactaaacattgtacttctttttctgcattagaattaaattgctccattaaatggacttttatcagctttgataaactgtattcccagcattgagaacattgcttagtggatagtaggtattcacaaaaaaaattagctgggcgtggtggtgggcacctgtaatgccagcttctcaggaggctgaggcaggagaatcacttgaactca

SEQ ID NO: 150156 - DNA, 365 bp, Homo sapiens
acgtttcccaccactgaattgtttttcctccttttctctgaaccctaggtttttcaaatttctcaagaggctataagcagtcctatataattttcttttaggaaatatacctttgtttgactttttcatgtaccttttgggttttgtgccatttctgtttttcctaaatggtaacacatttgcagacatccctgcgaggcattctaagaaacgagctagactgggaagtcgcttagctgaagtctgagtttattgcctctcattctcacggcagcgttttctaatcccttatactccgaagcataatccttaacactccaaagctcactggataacagtggaacagcagggggctaccttttcat

SEQ ID NO: 150157 - DNA, 611 bp, Homo sapiens
aaaagctggggggtagggaagaaaaatcaagtgaatctgttttaaagtttaaaaaaaccggccaggtgtggtggctcacacctgtaaccctaacactttgggaggccaaagcaggcggatcacctgaggtcaggagttcgagatcagcctgaccaacatagtgaaaccccatctgtactaaaaatacaaaaaaattagccggatgtggtggcaggcgcctgtagtcccagctactcgggaggctgaggcaggagaatcacttgaacttgggaggcagaggttgcagtgaactgagattgtgccactgcactccagcctgggtgacagaacaagactccatctcaaaaataataataataaagtttttaaaaacctcaacttactgctcactactatataggcagcatgaccctggacactgtggggtcaaaaagaaatagaagccacaatcactgaaatgctttccaggagctaacaagatagctggagggaggagacttaatagaaatgaaacaaatgaagagcaggaggcccctaacattcaggaaggctacagagcaaaaagccacttcacttccttaaccagcagcatcaccatcacctgtgaatct

SEQ ID NO: 150158 - DNA, 388 bp, Homo sapiens
taagagaaaagacatcatgaattccaactgaggaataagggagggttcatggaggtggtaacatttcagaaaaggcttgaagggtaaatacaattttaacaagcagatatataggctaatggaattctatgtagaagaaagagtattagtgaaagcacagagggtcaagcatgcatggcacatccaggcaaggtgagcaggacaacagggaggctggggaggatgccaaagtctgtgtctcagaatagactgataaaattaattcgagcaggggaatacaaaatagtcttcagctgttctggcttaatctaggaatgtatttctaggaatggacaaaactgaggacttaaatcttatctttcctaagtattatttctctcagctgaac

SEQ ID NO: 150159 - DNA, 272 bp, Homo sapiens
gaattatggggtttctcaggctgggaaaactgggaaatactggattagaagtctttttttgtagtcacggctatctcaatgctagtggccctcacctctcagtctcatctttccacttttagacagagcattcagagtactctgaaacacatattctacatgtagattgctgcttctgtttggaatcagtgtccgccctcataacaatagaagatcttaaaggaaaatgataaccttgaagaggtgacgtgtgttgcaacagactttaggag

SEQ ID NO: 150160 - DNA, 550 bp, Homo sapiens
cactaaaggttcagatgatcgttagcgtttttggcaatacactatttttaagatatgtacaatgttttcttagacataatgctattacgtccaggcgcggtggctcacacctggaatcccagcactttgggaggccgaggcggacagatcacctgaggtcaggagttcgagaccagcctggccaagatggggaaaccctgtctctattaaaaatacaaaaattagccaggcgtggtggtgtgtgcttgtaatcccagctactcgggaggctgaggcaggagaatcacttgaatccaggaggtggagattgcagtgagcagagatcacgccactacacttcagcctgggtgacaaagcgagaccgtatctcaaaaaagaaaaagacataatactattgcacacttaagagactacaggatagtgtaaacatatgcttttggtttggtcttttatttttgagacagggtctcattctcttgcctgggcttcagtgcagtggcgcattctcggctcactgcagcctcgacctcccgagctccagtgatcctat

SEQ ID NO: 150161 - DNA, 808 bp, Homo sapiens
gcaaacctgacaggggccctgcccccatggagcctccacctcatggaggatgacattaaatgagctgtcacttgaataacaatgtcactacgatctgaattaagggccagggaagacaacatagggcacactgcatgctgggggcccaggcaggtaggatgtatggctctgggaagacttcctggaagaggtgaatcctgaagttacataaatagcaagtggaagtccaaagagaagggcagactgttcttgacccaggggcagagtggggaatccataagcagaggctgctgtgattgccctgggctcagagagactgtgagctcagcccacactgcccatagaagcagcctaagtggtaaccctctatcctcaaggcctcaggggaagaacatgcgctccccatagatgcagagctccatgctggtgtctttcaggattaacagtactactccgaagatctgccttccagtcagactccgtgtctttctgttttaatgctaatcacaggtttacacccttggtattcattgttctttgtattagactctaagttcaatttgccagaaaaaaccaggtcaaccccgaaacaagagagagtttcccatctaggacaccacgaatcaaccaaaaatgatacattcagatgctgtaacagaagtccttactgcccggacacatttggaaacatttagagcggacatttgatcaattattcagtccaaataaaacacaagaggtcctctcctttctttccacaggcctcatttctacactcgaggatactggctttcaggctcccataccc

SEQ ID NO: 150162 - DNA, 408 bp, Homo sapiens
aataaggacgcactcgggcccagcgcgtatcatgtggaaatctggtcttagtgctgggttcctcgtcctagtccgctgacttagacagactagctttgaccagacttactcaaccacgatgaaatcaacttccatcccagttctacaatgtggtgactttgtatctgataccgcagtctttgtgttgccagcgcttagtcctctgaagatgtacttcagtctacttgaggatcccaaagagatgaccaagaaaacaagctcacttcagaacagttagcaattttccagctactttaagagataagagaaattctctcatacctttcagtcagctgttaagtttcatggtccatgtaaagggaggaattggttactgaaaaatcaaaggatctctttactgccagtgca

SEQ ID NO: 150163 - DNA, 628 bp, Homo sapiens
gaaatacacaggagggtttctttaacttcgttggaggagcttgattagcaagaactgggtggtttcccgaccaatggcctgagttggcggacctcactgtggcagtgtgttcccaccacactcaccacctgggtctgacactcaggggctgagcaagacccgggcatggtatggatgccaaggggagccaagaaccaagaatgggccacagtccccattttctgtcccatccccaccctggtttggcttttctctcttctccaaaacagagctagctgtcaggctgctcacgaaaggggacccccaggacaggcatctgcgttcaaggggaagaaagagagccaccccttctaaccacatctggctccaggccaggttggccttcagggatgaagtcactccagctccccctctcccacacacccaggttaaacaatcctgtcaccccctctcaatggaccttggggctctgcgaaatacaaggggaccagcctgcctcaaaccctcaacacctctcggccgcagaggctgtgtcttgggccagtccctcccgtcccgactccaacatggctgctcctttttaccccagcttatcaagctgcacacgtctaggagcgtaatcggtaca

SEQ ID NO: 150164 - DNA, 651 bp, Homo sapiens
gaaatacacaggagggtttctttaacttcgttggaggagcttgattagcaagaactgggtggtttcccgaccaatggcctgagttggcggacctcactgtggcagtgtgttcccaccacactcaccacctgggtctgacactcaggggctgagcaagacccgggcatggtatggatgccaaggggagccaagaaccaagaatgggccacagtccccattttctgtcccatccccaccctggtttggcttttctctcttctccaaaacagagctagctgtcaggctgctcacgaaaggggacccccaggacaggcatctgcgttcaaggggaagaaagagagccaccccttctaaccacatctggctccaggccaggttggccttcagggatgaagtcactccagctccccctctcccacacacccaggttaaacaatcctgtcaccccctctcaatggaccttggggctctgcgaaatacaaggggaccagcctgcctcaaaccctcaacacctctcggccgcagaggctgtgtcttgggccagtccctcccgtcccgactccaacatggctgctcctttttaccccagcttatcaagctgcacacacccggaacttggggaacttctgatggatctgcctaagccggtcc

SEQ ID NO: 150165 - DNA, 567 bp, Homo sapiens
catttgccagagtaactaggtgctagggaaagagaactagtgaaaaaaaaatgttgaaaattgctttgaacagacataaatccttagtcctagaacataacctttgttcattaatcaagtgcttacgtagtgcaatgaaagggatttttacccaatttgacttcatgggtaggtcagtggcactgtgaaaccattttatctggctatattccaagttccttctgtctatttagttaatatacttagcaaatggtagaatttttaccgtgagtttcttcctaagcttttgagtgagagatattatgatacaaaaacagcaataacagaaacatgtagaagtctctctagtttcccctttcactaactgaaaaccaaaagcaaattttttaccaagttatatcagtaagacaaaatacatgtcaaaagacaggagatcaatttcatggaaacagaaaggcttactcccttattgaaatttgagttccagcagtaagcagcttccaagaaaaatctctgtaaaggtaaagggaaagttactgtaacttggattttgaaagtaacgtatat

SEQ ID NO: 150166 - DNA, 714 bp, Homo sapiens
attcagaatttaaaagctgagaatagtgtaacatattgtggggcccatataaatcagcagtaaaataggattttgtatgctgaatattaatttacagactacatttcaatactgtattctgcttaataaaggatatatgtaataacaagttataaaatgtcaattgttcaataaacatttgtcaagtataaatatttgacctagtacatggtataatatactttatatcccttcttaaggggtataaaaatgattataatagaacctgtgcctttacatatagattaagagggtaaaagagatatataaatgaccacaataaaaaaagacatgtgctaagtaccatgagggatctcaggtcatgtatgtaacttagaatagaaagagagaatttctggcttaggtaatcagagaaggtttcatgttgtttgctgtgtgttgtgaagaatggatgggattatggaagttggaaatgtgaacaaaggccattgctggtagagagactagcacaagcactgagggtgtgagggtgtgtgtgaaagcttgtttggagtaaagcaaattctgtttggcaagggcagtgagtgggaggggaaagagcccagataatggagaatcttgtgtgccagctaagatgtttaaactagtgggggagccatgagtgtttttttggactgaagagcagcttgatcagatctatctcttatatgatgt

SEQ ID NO: 150167 - DNA, 273 bp, Homo sapiens
agtaccaggctccagaccctaaccatcccagggaggggagcgacggtcccatgatcaactagataagggaggaaaggcagtgagatggaaagagaggggtcattatgtggtcactgctctgtcactctgcagctgggggtctgcacagtttgcttcacccctgcaagctgtgtctataaaacaagggtcctggagggagtcaggggacaacttggaagacccgcagggtttgaatccaacaacctgggtttaaattcctgccctgccacaggc

SEQ ID NO: 150168 - DNA, 779 bp, Homo sapiens
tgagttcccgccacatctgatggttttataaggggctcttcccgcttcgctcctcactcttctttctcctgctgcattgtgaaccgggtgcttgcttccccttcgccttctaccgtgattgtgagtttcctgaggcctccccagccatgtggaactgcaagcgaaagtgacctaagatgatgtggaagttcttaagaaacgcctggacctggaaagcctagtcccttttcctgtgtttctctaggaagaaagatgctgcagtaggctttgtggccacctactctcagattatgcccagcactgcctgggactggatggctaaatttaattcagaagtctttgccgggaagtccaattatggccatagaccaaaccaagttattgaatttattgttaacagtaatgaacctggtattttgagctccatctgtctgatacttgcatttacttcttaattagttatgaaaccacagtgtgttgaaaagcgttaacatgatcaccaccaattgcccaccagtaggcagtcaataaattatagctattatcacagacgtttttaactgtaccctcatgctttctgtagtaatttgatctattcagtatacaaaatgtctgtcacttaatgaactccttatggggtattgctgtatactttaattccttattaattaattaggagaaaaatggccattagtatctcctatctgggtgagtagcataactgcctcacagtttgtcaaaagtgaaattcacttcaaattgagaagaaatgttaggtt

SEQ ID NO: 150169 - DNA, 343 bp, Homo sapiens
ggttcaagctattctcctgtctcagcctcctgagtagctaggattacaggcatgtgccactaatcccggctaattttttgtatttttagtagagacgggttttcaccttattggtcaggctggtcttgaacgcctgacctcaggtgatctgcctgcctcggcctcccaaagtgttgggattacaggcatgagcctgcacgcccagccaaactgtagcttttagaaaggcttctgatttcccctcatatgttattgtcaaaaattgagatgccaaactgaagtcagagtatataatgcactgactgtccaatagaatacactgagccacaaatgcaagccaaag

SEQ ID NO: 150170 - DNA, 677 bp, Homo sapiens
cttccaggcaggctccagtagcctggagcgccttatggatattaactccctcaaccctgacggcagcccagtggggagggtgcacttcccttcaagtcttacaggtggagtctcgctctgtcgcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccaactcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaaacagatgcggcaagttcttcctcttttttgtgtgcatttgagataaaaatgagcaaagaa

SEQ ID NO: 150171 - DNA, 827 bp, Homo sapiens
  misc_feature (24)..(24): n is a, c, g, or t
gatgctgagacactctcttaattntcaccgctcagttacagaatcatcactggagctatcccatgggacccagtgctgcgtgtgtcctggaaaccacctgagggaggtcacagcccttatgcacctactgctcactcagccccataatgactgttcttaacccatctgtggattgtgaagtttatctagttgtttataactttttttttagctaaatagaatagaaaacatcaaagtgcatacgtgtagcaaaggtggagtctcgctctgtcgcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccaactcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaaacagatgcggcaagttcttcctcttttttgtgtgcatttgagataaaaatgagcaaagaa

SEQ ID NO: 150172 - DNA, 702 bp, Homo sapiens
tcaaaatggagtttcactcttcgttgcccaggctggagtgcagtggcatgatcttggctgaccgcaacctctacctccggggttcaagtgattctcctgcctcagcctcccgagtagctgggattacaggtggagtctcgctctgtcgcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccaactcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaaacagatgcggcaagttcttcctcttttttgtgtgcatttgagataaaaatgagcaaagaa

SEQ ID NO: 150173 - DNA, 834 bp, Homo sapiens
gtttctaagcgtgactgactctcttctgaaccaccgctacagttacagaatcatcactggagctatcccatgggacccagtgctgcgtgtgtcctggaaaccacctgagggaggtcacagcccttatgcacctactgctcactcagccccataatgactgttcttaacccatctgtggattgtgaagtttatctagttgtttataactttttttttagctaaatagaatagaaaacatcaaagtgcatacgtgtagcaaaggtggagtctcgctctgtcgcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccaactcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaaacagatgcggcaagttcttcctcttttttgtgtgcatttgagataaaaatgagcaaagaa

SEQ ID NO: 150174 - DNA, 648 bp, Homo sapiens
ctctccccgaaggtcctctgaggaggagaaacaaagcaaggcgtgcatgagcaacacgggagattatatggcaaggtggagtctcgctctgtcgcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccaactcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaaacagatgcggcaagttcttcctcttttttgtgtgcatttgagataaaaatgagcaaagaa

SEQ ID NO: 150175 - DNA, 691 bp, Homo sapiens
ctctccccgaaggtcctctgaggaggagaaacaaagcaaggcgtgcatgagcaacacgggagattatatggcaagctaaatagaatagaaaacatcaaagtgcatacgtgtagcaaaggtggagtctcgctctgtcgcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccaactcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaaacagatgcggcaagttcttcctcttttttgtgtgcatttgagataaaaatgagcaaagaa

SEQ ID NO: 150176 - DNA, 818 bp, Homo sapiens
  misc_feature (24)..(24): n is a, c, g, or t
gatgctgagacactctcttaattntcaccgctcagttacagaatcatcactggagctatcccatgggacccagtgctgcgtgtgtcctggaaaccacctgagggaggtcacagcccttatgcacctactgctcactcagccccataatgactgttcttaacccatctgtggattgtgaagtttatctagttgtttataactttttttttagctaaatagaatagaaaacatcaaagtgcatacgtgtagcaaaggtggagtctcgctctgtcgcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccaactcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaaacagatgcggccaatccctctctttcttcttacacctccccgctgtggcac

SEQ ID NO: 150177 - DNA, 604 bp, Homo sapiens
ctctccccgaaggtcctctgaggaggagaaacaaagcaaggcgtgcatgagcaacacgggagattatatggcaaggtggagtctcgctctgtcgcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccaactcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccactataagcccaataaacagtaagcataaaataaaaataaacaaagatcggcagg

SEQ ID NO: 150178 - DNA, 211 bp, Homo sapiens
agaaacactgtgcccatgtggaggaactcatactgagtcctctgtgggtgcgtgggaccgaggaatgtagggggaagattatgtattagatatagaaagagatgtaattttcatttttttttaacctgtgggtcattcatggtataggtttgcgtagagagcttgatggaacttaagaatgacttaggaattatttagttgtaaattaaat

SEQ ID NO: 150179 - DNA, 399 bp, Homo sapiens
ggaatgatgaatctacaagccaaggaaaaccaagaattgccagcagccacaaaaagctagaaaagaggcacagaacagattcttcttcagagcctctagaaggaaccaaccctgctgacactttgatttcagacttctggcctccacaactgtgagagaataaatttctttggttcaatccatggtatttttatgtaacattttgaagtttagagttcatcataaatcccaacaactcagtgaggtagcatttttattattctctttttatagctacagaaactgaagcctaatgacattaagtgagtttttcaaatttacttagtaagttgtaaagctagttttcaaacttgttcatttattcaacaaatattcatctttagtttgcttgtgaaaggc

SEQ ID NO: 150180 - DNA, 1033 bp, Homo sapiens
ttaagtctcgctctgttgcccaggctggagtacagtggtgcaatctcagctcactgcaacctccacctcccaggttcaagtgattcttctcctacctcagtctcccggaatcctttttatatggagcatcttgcaaaattagtgttctgagagtcataacatgggaaacaatgcttaattgttttgaatgtggtccaaggacgcttgcatcagaatcactgtggatgctgattattgatacaaaaaatcatcgccacgtcttgttatgtcagaagctcttctaccagaagctgaaagagaatagcctttcaaggaacatggagaagttaacgtgaggatgtcagaacaagaacacagagggtcccttggtccctaatactttgggggccaccatattatccctggactgcttagcatggaccgttatgtaatagagaaataaatttatctcctgtatttgccattgctatttttgccttcgataatgcagctgatctgaaaactaattaattcagagataaaaagagaacgtacgttctgactaatcatggtgagtagtctctgttctgttctttattaaaaagcatggatttctctgttgtgatgtctttctttttaaggtaaaaagataaggtctttcttctttttttctctttttaaatttcaatatcttttgaggtacaagtggtttttggttacatggatgaggtctgtagcagtgaattctgagattttagtgtacccattacccaagcagtgtacactgtacccaatatgtagtcttttatccctcatccctctcccaaccttccctctgggtcctcaaagtccattatatcactctgtatgtctttgcatcctcatagcttagctgaatcaagatatattttaaaggcaaaaatgttaacacttgataatggattggatatgtggcatttagagattggataggttgggattttttaaacgttctgaattgtaatttatgttagaaattgtccaaagcactttcattaaacttctgatttctcta

SEQ ID NO: 150181 - DNA, 367 bp, Homo sapiens
ccatggatttcagaggggctcattttacataattgtctatttcagtgatttctaaaatggtttcatagcttcctattttcttttgtcttggagtttaacttagtcctgcaagtaactgctttgctgtttatctggtgtttaaaagtttttgttcagtgactgggaagcactgttggatgttaacagtaaaccgagggaggaaccctggactcggaggcagaaagcctgggtttgtgcaaagcaggcttctttattactgtgtgaccttcggcaagctccttgggctttctgaatcactgcttcctcatctgtaaataagggttatgctacctgccccatatgactgtttctattgttaaataaggca

SEQ ID NO: 150182 - DNA, 384 bp, Homo sapiens
cctgggtgatgctgtcattccttctaactaccaaatttcaagcattcttgctatactccatggaacacatctgccttcagtagtctacccttaaaatagaaaagggttaacctcataaagatgtcactccctttgtactgttatgctgcccttgggagactcaaacagcatagcaaatatatatgggcaatgtaattgcattcgatcttctaggtcacagaagactttgttagctggtatagcagacagggaaaagtgagcacattcccatctttaagagcactgcttctaaattctgtcactctttttgataggaaattaccctaacagcctcattttttccatcttagccttcacaacaaataataaataaagaaggagtga

SEQ ID NO: 150183 - DNA, 165 bp, Homo sapiens
gagttttatgtcatttgtagtcagttattaaaacagtataggcttctgggttctttgaacagctagtggtggtactgtcactaagtgttgtagttcatgtggctgtcaaaagacaaaattacagcacacttagtttagagatcttaattgtcttttatttgcaac

SEQ ID NO: 150184 - DNA, 234 bp, Homo sapiens
catggattaaaagggatcttcctgactccatactctgataggcaatgcaccaagcttgtgtctagtctcttggacaagttgttccttttgcctggaatgcttttccctcttcaattatctggtaattggttcttcaagctctcagcttaaatttatgttttctcagaggtgtttcctgacccctccccaaactaaatccttctgctatttgacctagtacctttactttccctt

SEQ ID NO: 150185 - DNA, 297 bp, Homo sapiens
gccacgtctttctgagaatgggagggaagccctttccgaaggcagaggaccggtaagggcccttcaaagctctctgaaacagcaacacggtcggagggaggtcattagcagtgctgtgtggcttcctcatcctcatggtaagtgagcactgggagtaagacaatcagcccttcagaaaccactcgggcctggagaacgcagccagggctgagccacagagatggggcaggagcagttctggcctccaatatacagcggcgctttgctcctctcgcacaagtgaaatcacagctgatg

SEQ ID NO: 150186 - DNA, 268 bp, Homo sapiens
aaattgatatggctggggattaagtaatggaataatttggggtcggaaagaaagtaaagctaaggatcactgagctactcaggaacactagggaacgtagggaagttctttttttttttttttgagatggagtcttgctctgtcatccaggctggagtacaatggtgcgatcttggctcactgcaacctccgcctccgaggttcaagcaattcttcctgcctcagcctcccgagtagctgggattacaggccaccacgcccggctaat

SEQ ID NO: 150187 - DNA, 356 bp, Homo sapiens
catttcagaggaacaagaaaaaagctaatatgttggagagaaagtgaatgaggaagaaagaagaatctgattagggctatgtctcgtttctggcagactccagctggaagaactggaaaacatcttacctttacctttacatattctttgatatttgaatttctgaattttggctacatctcacaacttaaaggaccataaaggttatattatctaagtgactttatatttatctaaaaaagtaatggaaccaccaggatttttaaccagagcagggaaaaactagctctactgcacaaatgcaaagggataatgagaatagaaaataaagttataattttgtattctatctcaat

SEQ ID NO: 150188 - DNA, 125 bp, Homo sapiens
tgggaagtacactaccctacccttactaagtctattcaggaataaactagagaattatgtgatgagatgtaggcaaaaaatcgtaatatcataaaaaggactcatactgcttgaatgaaataaac

SEQ ID NO: 150189 - DNA, 498 bp, Homo sapiens
ccccaagattgcctgggaattgcctgcttgagcttggaatgccaggtaaccacactgggatggccctcagagcccctcacagcccctcacacctcacagagtggacagagcatcagagacttgagtgatctgtccacagtcacacagctagtcccaaagaagagccagggccagaatctacggccggtgacccaggccccagtccagtgaggctgacacagccaccctgggacagtcatttggaaacctcacttggggtagtttgcaaagatgaatcaaaaccctcagggctgcttctaaatttagcaggcaggcactctgcactagagagatggttccttagacaacttgtgaaaacacccgctcaagaagagcatgctgggaaggtacaaaggaactattgcaaaagactgagtgggcagtttgctttacagggaagacgggataggcagaaatatgcagaagtggagattttcccccaaattcacacagaggagt

SEQ ID NO: 150190 - DNA, 1086 bp, Homo sapiens
acagccctgtagagagatcttcctcgtggcacttgccacttgtccagaaataatatgttacgtgttggtggctcccgaaagatggcggccttcaccagtttctggagttacaaatgcacttcaataatgatcaagtcatgctgcaacaggcacagagaacaaagaaacaactgcaacaagaaactgctgaacttgggtctgaaatcccagcattaacaaaaaaggtcttgaagtgttttctagaccagcccattctgctgtcgacatctctgatgaaaagccccactagatgtctttgcccagacttttccttctttttcacctcatctcatgccctggagaggagtagtgcctagtgaccaggaggaaacctgcaggttaagagctatgtccattaaaatcagcaaatattaaataaaattaaacactctggtcctcagttgccaatagccacatttcagacgctcacgctagtggcccctgtattaagcaaaacagatttggaaaattttgaccatcactcaaaactttttttggacagcactgttctagagtcaaatggaataagtgatcactgtattgcccaggctgcagtacagtggtgccatgtcagctcactgcaatctccacctcctgagttcaagcagttctcctgcctcagcttcctgagtagctgggattacaggcgcgcgccactgtgcccggctaatttttgtatttttagtagatacggggttttaccatgttggccaggctggtctagaactcctgatctcaaatgatctgcccaccttggccacccaaagtactgggattacaggcgtgagccactgcatctggactgaagttgagttatatctttaaccctcactgtctaactttgagaaagcaatttagtctttctgtgccttggttttattatctataaaatgagggtataagcatcaacttactggggtaatttatgagaattagatgagttaatatatgaaatatatttagattaatccctggcatataatattttctcaataactgttaacaattgctattcattaaagtcttaataaaacaatacctacttca

SEQ ID NO: 150191 - DNA, 469 bp, Homo sapiens
tcatttgtacaatgtggatcataatgcacattcataatcccttgtctgtaatctgaaaccccaaatcctccaaaaaccttaagttttatcaaaaaataaaaaagtttgacaccaaaatttatttggtgcaaatgccttatctgcatagatgggaggtttttagctatctttgtttcacttaatgtggatattaatgttgcgctgcagaaatattgatgagattgattttggggtgctgttccattttctactggagtgttacataatacatgataagaatagtacttagcatattcatgtttctcttcttccttctgggcacagcaccataccactcttagcattctgatagttaggtggtaccatctgactgagttctggccagtaaaatgtcagttccaatgatgtacaatcgacccttgaacaacactggggttaggggcactgaatctccacgcaatggaaaatc

SEQ ID NO: 150192 - DNA, 393 bp, Homo sapiens
tagcagtggttcgacgatggagtaggaagcgtcccatgttgtggatatatagtagcattacgactcgcgctatggcatatgatgtccgatcctctcagagatctagcgtcagacatgcaaacttatcaccgtccggtcgtgggacaacgtcttgaccgggtgaaaacaccttcatgcgtgacctggcagctgtagcttctgtgggacttccactgctcgggcgtcaggctcaggtagctgctggccgcgtacttgttgttgctctgtttggagggtttggtggtctccactcccgccttgacggggctgccatctgccttccaggccactgtcacagctcccgggtagaagtcactgatcagacacactagtgtggccttgttggcttggagc

SEQ ID NO: 150193 - DNA, 432 bp, Homo sapiens
gagggaaggggaaaggagcagagcctgggaggcagtgagaaggcagaacggccagagaaccttcacacctcttcttgctcctccttggtctcttgaggccccctaatcagagtttgttatgattagaaatacatccatacaagtatgtaaaagaaggatgagggcttaaaacatttcccctccaaggtgtgtttgcattttgacatagatctgaactaaaggaaatgaaaagttaaaagtggaattcctatcacgatgaaaatatcggaaggatagagggtcatggagaaatcaggccacacctctgactatctgaatgggccactgctgcaggatttacaagcactgtgcaggcacaggaagtcctgaacaagcgtttggagggttggagatttcctctgagggccacacatgtgaccagcacagggccac

SEQ ID NO: 150194 - DNA, 280 bp, Homo sapiens
tgcagaaagacatctgagcatcacaccgaagaggatgaagactctaaaaagcctcaagtttagcttcaaaatgagttatgaaaaactttcggttttcagaaatcgtggatttcagaataacagataaagctgccgatctgaacatatgtattggttgtacattgcctgtatgctcaactagaatctaaaccccaggagagcaaaggacttggtccgatgctctggcacatataggtgctcaataaattcctgaggaagaaatgcaggaggaagccaggtg

SEQ ID NO: 150195 - DNA, 133 bp, Homo sapiens
gacggggggaaataaagggcaaagctctcggagtgggctagaactggagggagattagtcccttgtcagggttgcatctgaagtgacggcacaggacaagatggcctcaatggggagagaggatgtctgagga

SEQ ID NO: 150196 - DNA, 730 bp, Homo sapiens
gtttatcttttttctgtaatgatggccatagcaactaggctgtaaattctgctgggcttatcttgcacttttaacaggttttatccatagacactgatgataattgtatggctcattgattatctactgctgtgctgagcactttaaaaacagttgtaattcctaatcctcacagtaaccctgagaggaaggtgctgacattgtcctcattctccttgatgaggacactgaggctccaggttaagtgtgcactcaaaggggtagagccaggattgcaactggcacctctctcccatcacaaaacttggagaacatcttacctgttcagagagttctgatgaggtggttaagtcatgatgctatgtgcctgtggccttggtctctccacatggaggatgggggtgatacgggacccacctcaggatgtggtgagcagtctggcagcaccacttagatatagacacctctgggcactgttgcaggaaaatagagttggaagctgcagtgagcctccaacttgtggattgtaccactgcactccagcctgggtgacaagagaccctgtctctttaaaaataaaacaaaatccagcaaggtcttttgtttcccctttttttttaatgaataaacaaagaggccaggagctgctaagggctacatagattccactggccctgtcttcattccttctaccatgtgatgctgcatttctagcttgtggtctggtgtc

SEQ ID NO: 150197 - DNA, 530 bp, Homo sapiens
cctgagctccgtacaaagggcagttacctcagtgtgtatacttacttccttacttagagttgactttatacctttattttggcttttatatcaataaatttattgaataaagtcctgtcaatgtatcagcctcaatttaatattttgtcacatgggatacctattaacttccacaggaatggcaccaggttcaagagtctgaaaaagagatccagcgccagcaaatgagacataaggtttactgagggtaacttgcatacaggttggtccagtggtggtgggctggacagtagaactgccaccttttgcagaaagcatgcagtttatatagcattttcacttaacctccaccccctaacaacctccacctggcaacttcttttaacccaaaacaaagagtctggactccctgtatggccagcattccacgggacaggccagggactcagatgttcctcacaggtaaggaatgaatctcttgggttggccactgcttggaactgtgaacacacattcaggtgtgtctgccg

SEQ ID NO: 150198 - DNA, 322 bp, Homo sapiens
tattcatttaagacatatttatctacattattaaaggtgcttctgctttctcaactacaaataagaacttgagctttgtaagcaaacagacctgcttagaaatatggctcttccctgtactggcttagtgtccttaagcaacttacttatccccttaaaccagtttccttgcctacaaaatgaggataaaaatcatgtacttgaaccagatgtggtggctcacacctataatcccagcactttgggaggctgaggcgggcggatcacgaggtcaggagttcaagaccagcctggccaacatggtgaaacctcgtctctacta

SEQ ID NO: 150199 - DNA, 301 bp, Homo sapiens
agaacgacatttttttttagattccatttcaaaatgttaactttaaaaagcaagttattaagccacatattttcttcatatgccctactcaaatctagaattgttttgtcttcttgactttaaagtctggaaattttatcaaaaaaagaggttagtttagcatgagaacttcttattgaacccatcctggctccaccaccttgccttactaagagctcaaaaataattggttcaatatttaagcatagaattatgctgcagatggataccaacgtcacctcagtacaatttctggaattta

SEQ ID NO: 150200 - DNA, 201 bp, Homo sapiens
cactgatccagacacgtgactactctgtaaaaatttggtgttaggtataaatgaacatgtagtatcaggaactgagtagcaaaaagatgaaaggcaggggaggatatttttcagttaaaagcactctcatttaatgatctaggagtgggaagtaaatcatgggtcttagaagaccagggtttcctttaaaacacttgcttt

SEQ ID NO: 150201 - DNA, 410 bp, Homo sapiens
gtgtataggcctttggattctgtgaccatccaagtaccgggaggttctgcgattctctgtggagcctattcaaaaggagaggggtcatgtcaggtgaagtaccagcagccctctgggaactcacatcccaaggattgccaggcaattggggttaaaggcctttggatgttactgtgactgcagcaaagtttcctgggttcatccactgcaggaaaatgaatcttggaaaacgtcagggggctcatcaggtttcccctgcatgcagagttaggctcggtctcctgtgtgccagcagcagtctctgttgggcagcagaggctgcaagacgaacagccgctgtttactgagcacttacacagtgccagacactactgtgtggagtgtctcattgcttctttgaattacttcta

SEQ ID NO: 150202 - DNA, 343 bp, Homo sapiens
tgtatagtctagagatcccccacaggtggtagtacagccgggcctcatgttttgccttgtttacagctgacagcgttattattctgattggggctctgctttcttatcatattgttgtgttgagcgagccttttcctctacgtttgtgtttcctggcagggcttttcttgccttattgacagtttgtaaaaatatgcattaatttggagtttcaagcatgtatatcatggtgtctctttgctgtgtttgcttgaagttgattaatgatagaacctcgcttggggtcgtcctctggagagttctttcacaggttctgcatgttaactagcaaagcagaacacac

SEQ ID NO: 150203 - DNA, 220 bp, Homo sapiens
gagtttgatatctacttttccatccacaacagactaaatgctgaaaactcgagagcataggtgagcttgtgtttgatgctagctgcaagcagcctgacacagggagaaatgagagctctcctagagccaatctgtgtccctaccaaatctcatgttgaattgtaatccctaatactggaattgggacctggtgggagacgactggtggcatcgataaaca

SEQ ID NO: 150204 - DNA, 345 bp, Homo sapiens
gtgcatgtgcccacatccactcctgcacccaagacccgtgccagtgcacgtgcgtgctcctgcctgccacacgtccacacactgctgatgtatcggtgcacacgtgtgctcctgcctgcccgcacctccactctgctgtatcggtgcacgcgtgctgctgcctgccacacatccacactctgctgctgatgtatcggtgcacgtgtgctcctgcctgccacacatccacacactgctgatgcgtctttgctcacgtgcatgtgtgtgcacttgttcacgccccatgtcggcacccgtgggtgtggacacagactcacgtgctcatgtggtcacaggcacaccctt

SEQ ID NO: 150205 - DNA, 253 bp, Homo sapiens
cattgtctacctgagctagaatacaagtagttggcgtcttcagagacacttgtatgctagctcaggtagatattgaatgaaaaatctacactagtttaaagaatatcataactttttatggaaaagtataataaaactcaatcacagacacataactagctcaaaaataccttaatgtggatatgtcagaatgttcacgccagcacaagaatcaccccatcatccagacacaatgaaccacaagtgcggtacc

SEQ ID NO: 150206 - DNA, 339 bp, Homo sapiens
gccatgctgtgaaccaccaatgggggcacacggccaggaactgaaggcaaactcaaagctgagagcagttcctggcgaacaggcaacaagaaaacaggaatctcttccacacagctgcaaggaaatcaattctgccaacaatcaatgagcttggaaaaggacccaagcctccggtgagatcagccccctccgacaccttcatttcggcctggtgagaccctagctctgctacctagctacactaggacctagctacactgtatccagacttctggcctcatgaaactgtgagctaatcagtgagtactgttttaagctgctaagtttgtagcaatctgc

SEQ ID NO: 150207 - DNA, 314 bp, Homo sapiens
tgccatgaacccggagcgaggctgggtgagcgaagtcctcaggaggcccttggcacggcaggagcaatggtagtgccttgtgtttgctcctcctcctagaggagcccctgaaacctcaagtgtggtctgcccttccttcttggggctgctgtacagagctgttcctgcagcctgtcagatgggtgcaggcgtctgttaacttcctttctttcatttctgcttttatccagcaaagttattaagtttagtatctatcatctctgctcttcttactataaaaggaagctcttggtcttgcccccaaaccctgcacc

SEQ ID NO: 150208 - DNA, 421 bp, Homo sapiens
cttaaaaccatagctgtcatgtacaggaccaccccatctcatatatacacatgtgtgtgaatatatataaggttttattttatgcaatatgcattttttttcccctgagatggagtctcactcttattgcccaggctggagtgcaatggcgtgatcttggctcactgcaacctctgcctcccaggttcaagtgattctcctgcctcgacctccctagtagctgggattacaggcacctgccaccacgtccagctaattttttgtatttttagtagaaacagcatttcactatgttggccaggctggtctcgaactcctgacctcgagtgatctgcccttctcggcctcccaaagtgctggattacaggcgtgaaccaccgcacccggcccacctgagcatttttagatgtaggcctggtga

SEQ ID NO: 150209 - DNA, 313 bp, Homo sapiens
ggacaggctgaaatccagaagaaaatgggaccaaaattcaagtgccctggctgtgagttttggaaaacactggactgccattgctttgtatagaggaaaaacagtagacagtgtttgaaacagttctccaagcgcctttcctatgttggcctgccctttcaactttcccacatacctgttggccacaccagtggccagactgtcctgggcacagtgggagcgtaagtttccccatattcaccccatggccttgtctgctccacaccactgctccctttgcagcctgaaacacacgtatgattgagaggtaaca

SEQ ID NO: 150210 - DNA, 361 bp, Homo sapiens
ctcctaccagtgatgagtgtggaagaggctttatatctttttagatgagaaagctaaaacttacttctccccctgtgaacagggcaatacccactcttgagggtcataaagggttaatgcaaacagaagctcccagcaaagctcacaggaggtgctcctgaggtcagctgagtgtgacagttaattccatgtgtcaacatgattgggccacagggtgcccagatatttggctaaacaatatatgtgggtgtgtcagtgagggtgtctctgaaaactctggtaaataacatatatgttggctgcattcattaggatatgtgatttgggtaataaaggtctgggagaaaaaaaaaaacaaatt

SEQ ID NO: 150211 - DNA, 376 bp, Homo sapiens
gagtgaagagatgatcagttggtcccacagggtagccatctttctgtggaatgttaggcacgggcatttatgctgagcatctagcctttagtcacctgctactaggaagttacctcttagacgcacattttcattatggcttatcaagtcacttatagttggcaacaaagatgttacatgtgtctaatttgctgacatatctagtcactggaagtaccagccagaatgaggtcagaagaatgactaataaatattttcaggatggcaggtttcccttgaatagggcatgttattaaattcagaactcttatctgtgtgacttaaacatttagctgtttatttttaatctactgaagaacttttcatgggttttgtg

SEQ ID NO: 150212 - DNA, 151 bp, Homo sapiens
atggtggggacaacaaataaagagatcatttctaagagttctcagcacctgaaggagaatctcccaggtattaagcaaaaaagttttgaattttaaaaataaaatagagataactcaggaactcctatcaaccaagtcttctcttagaatt

SEQ ID NO: 150213 - DNA, 431 bp, Homo sapiens
aattgtcaggaaggcctggagaagaaggcgtttcaaaaagcaggggtggtcaaacatatcaagtgctactggaaagtcgagtcatatgaggaggaataactgatcactggcttgtcaatatttaggcagataaaggaatgttggggatgaaagacccattagagtgtcctgggaagagaatggggagggagaaagtggaggcagcaaggcagacagcttttccaagaattttactctggaggagaccagataactagggtgacagttagaaggagatgtggggtcaagagaggttccactacatataaagaaccctcgcaactcagtaataagaagataattagcccaattaaaaaatgcaaaaagatctcaacagttacttcacaaaagagatacatgaatagaaaataagcatatgaaaagttgctcag

SEQ ID NO: 150214 - DNA, 343 bp, Homo sapiens
gtctgcctcctgggttcaagcgattttcctgcctcagtctcccgagtagctgggaccacagacgcacgccaccacacccagctaattttgtatttttagtagcgacagggtttcaccatgttggccaggatggtcagtctccgtctcttgacctcgtgatccgcccgcctaggcctcccaaagtgctgggactacaggcatgagccactgggcccggccgtgataactttttttcaggtagaaatcttttggttctttttttatcaagtattttgtgtgatgcttacagaatacatttattaagtattttgtacagctcttattttttgttgttgttttacaa

SEQ ID NO: 150215 - DNA, 523 bp, Homo sapiens
ccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggcagtttgtaggcttgtgattagatataattaaaagtcacataaagttccaaaaaatatttttcacttgtttcatatctcaacaacttccacttgtttaagttagtgtttttccaagttgcattgtgatgaggagaatttg

SEQ ID NO: 150216 - DNA, 700 bp, Homo sapiens
ccacctctcctctctgcctgactctcccacccctgctcccccacacatacccaaacacaatttacgtcttggcctgtggctcaagaattttgtccagaaatctcttaggccctcaggcccttgcgaaatggtaaacatttgctaatacgaaaaaccaccaggcttagcaggagatagaatcttggagactaagggttgttcagagccccagagccaggtagaagcccagggaaacctgcagccatgatgaaacagtagttgtggtcaggcacggtggctcacacctgtaatcccagcactttgggaggctgaggcgggcagatcacgaggtcaagagatcgagaccatcctgaccaacatggtgaaacccccgtctctactaaaaatacaaaaattagctgtggattacaggcgcctaccataacgcctggctaattcatagtatttttccggtaaaaaaacggcagttcacgccaatgtttaggccacggctgtgtctccgaatccatgacctcagtgtgatccgtacgcctgggccctcaaaagatgcatgggaattgcaggcgtgaaccaccgagcccagactgtaagtttctttgatcaatcgaactgtggccaaagggacatcgatgctagtcctggactaggccacaagaggtctagtctataactaatatgtctcatacgaaggcaactgcta

SEQ ID NO: 150217 - DNA, 374 bp, Homo sapiens
tctgcactcactcattcttgaaaccagacatgccaagttccaggagggacatcggacagaaactgcccctgttcttctgccccttgacacacccacctttggggtgtgaaaacccaccagttccagccaccatctcatttcagcctcccaaggcctttgctctacttgaaaaagcctcagcagagaagaaagccatcccgggaggatgaaggcagcagattctgctctgttcactgacagcactgatgcccagcacctaccaaacacacagagtcttacacatgttatgggacttatctctattaattcactgagttatcctggtaacctgatgagattaggtcacttatcccatttcacagacgggaaactga

SEQ ID NO: 150218 - DNA, 210 bp, Homo sapiens
atcagatttacaaaaatgaaagttcgctttatccagtattaagaaggttatgatcacttgttaataggatgcaagtaaaacctcttagaaggcaattctgttagattgttgaaagatgtaacctttaattcaacaattccacttccagaaatcatcagaaatacacagttggatgaagataaggcataaaggatattcgctgtagcattg

SEQ ID NO: 150219 - DNA, 216 bp, Homo sapiens
gaaagatcgcagagccagttttcaaacagtggaaaaactcaagctctatcacatgactcgaggcagtcagcgtgtaaggtgctggggctctcctggtgcaggaggttcccacaacattctgctttctagtgggagcaaacgcaaaatttgtaataagaatagtgtgtggaatagggaccacaaaaaagctgtattaactgtgcataggtaacccag

SEQ ID NO: 150220 - DNA, 164 bp, Homo sapiens
caggaaagagttccttagactcctgcatggcatcatgaatgctgctgttcttcttaccttggtttttttcctcctcctctaccttttctaccttggtgtgctgggatcagatcctgcttatcttccacttcttaagaaaagctgacatagaagacacattggga

SEQ ID NO: 150221 - DNA, 449 bp, Homo sapiens
tgagaagaccttaggtcaaatcacttgcctaaggtcacagcagtatagaggcaaagccaggactggcacctaggcctgcctgttctgcaaacttcctcccccaagagtttcagacttggaggtcacaccaggctgcctgggatagacaggtgatcgtggggttgtaattacaaccccacgatcacccccttagggcacccaggcaagatccctaagaggcacccaatgcccaggccaggggggctgcagccctcagcccccgccaggattcccgcaggctcctggactggaagctccctccgcggtcggattctggagtgtgggaggcatcttggcctgcagtaagcggtgctgacggggactctggccacagaggtcaggcctcctgaaaacagcactgccttccgcgctgccccagcttgccccattccttgtccgccaacccgccg

SEQ ID NO: 150222 - DNA, 330 bp, Homo sapiens
agtgaggaggcggctgcagggcccggccaggctgggccccattcacagctcagccggagctgaccaggccagccctctctgctggaagcccagtccaaaggagagagtgccctggggtccccatcccgactccgggccagccctgaggctgcagggagggaggtggagatgcccagggggtccctgccccagcctcccttcaggctgcaccacaccgaggcagaagggtagtgagagggacctcggacgggagtcctgagccctgttccccaggccctgtccatcggcagcacccagagaggctgtgggtttagtccaagtcccagtttt

SEQ ID NO: 150223 - DNA, 285 bp, Homo sapiens
ccagcagtttgggtggtcaaggcgggaggaccacttgagcccagtagtttgagtccagcttgggctacagagtgagactccatctcggggggaaaaaaaattagttagtcccagctactccgaaggctgaggtgggaggattgcttgagcccaggaggttgaggctacagtgagccgtgatcacaccactgcactccagcctgggcaacttgacctcctgggctctgctgtattttcttcagagtccttattgcaacctgacatttcatgggaagtttctttctt

SEQ ID NO: 150224 - DNA, 177 bp, Homo sapiens
cgaggccctggggactgtcttgggtatacagttgtccaggggggagggatcctaaagtggggcaaggagagggctgggcgcggtggctcacgcctgtaatcccagcactttgggaggccgaggcgggcggatcacgaggtcaggagatcgagaccatcctggctaacacggtgaaac

SEQ ID NO: 150225 - DNA, 350 bp, Homo sapiens
gaccaagtattctttgtcaaaaccgccttggtcattacattgatccaaggttatcatttaaaaccacactagtacaattcacagataaagtgtaaaacacacatacacgtgcattcacacatgaaccacactgaaatgaagatagtgtgagctttcttaaggaaaaatgaccttatttttattcagaagaagagaaaaaacaaagcaatctgtaccactactcaacggaatgcttctgctcactttttgaaatgaaacatggacagctctccttcatgatattaggtcaaaattagacaaaaagtagagtcaaattgcacaagatcataacagtcagtggaaaggccatg

SEQ ID NO: 150226 - DNA, 357 bp, Homo sapiens
attattcccactttacagatgaggaaacagaggcacagagaggttaagtaacttgcccaaggtcacacagctagaagaggcagggttgggatttgaacacaggcattctgagtcttaacccctgtgcttaacccacccaccttggtgggcagaagtctcagtttccttggggtgcctgggccccccaaagctttctgtctgcgtcagatgtaactcccaggagctcctcttgtttccatgagcacgccttccgggccgaggactgtgttgtgttcatctttgtttccacagtgcctggatcactggcatctagcaggggctcccaattccaggctctctgtatgaggtgctggaggc

SEQ ID NO: 150227 - DNA, 266 bp, Homo sapiens
gctctgtctgctaaacagggttctatataaccagttatattatggatcaaactcttcatcatgctccacttctccaagtacaccataatataattatatatacttcttacatacacacacacacacacacaatgggctttgccatgctacaaaacaaagactccaaaaaccacaagaaggattaaataagaaggagattctaacacacagatgaacttgataatatcctacattccagcctgggcaacagagcaagaccctgtctc

SEQ ID NO: 150228 - DNA, 329 bp, Homo sapiens
tggacccaagagagaaaggtcatgtgagagtagaggtgtgacctccttttccccaggacatgtaggatggccaataagaatcagtacaaatctttccacttcccccttcggccttgtttactttgttttatttcaccctgctttcaccctgttttgttcatcctctttacaggataaaagagaaccaactgagagccacagggttgaactggagaacaaaatactggttacaatggaggcctatgccctggaggctaaggtgtgtagccttccagagaagaccttcataaccaatggttacagcatattttcttcccaggcattgggca

SEQ ID NO: 150229 - DNA, 405 bp, Homo sapiens
gctgctgcggtcgatctagaggctccctcataaaatagtcaccccacacaacacacagtcacactcagtcactctcgctctcacacacactcacacattcactcttacacacattctcacgcgcacacacactcactctcacactcacacaccccacattcttttccacctttctccacagaggagggacagaggcctgggcctggatgcggtgatcgtggggttgtaattacaaccccatgatcaccggggattatgggccatctgttgtctgtttgttagttttgagatggagttttgctcttgttgctcaggctggagtgcaatggcgtgatcttggctcacctgaagctccacctcccaggttcaagcgattctcccgcctcagcctcctgagtagctggg

SEQ ID NO: 150230 - DNA, 620 bp, Homo sapiens
gatcgagctcggaccttacaacccacacaccacacacacacatgctcagtcaccccacacattcataaaagtcaccccacatgccacacatacacacacacactcataagatagtcatcccacaccccacacacactcatagtcaccccacacgccacacacactcataaaatagtcaccacacatactcaaaacagtcacctcacacaccacacacagacacaccagtcacctcaccacactcataaaatagtcaccccacacaacacacagtcacactcagtcactctcgctctcacacacactcacacattcactcttacacacattctcacgcgcacacacactcactctcacactcacacaccccacattcttttccacctttctccacagaggagggacagaggcctgggcctggatgcggtgatcgtggggttgtaattacaaccccatgatcaccggggattatgggccatctgttgtctgtttgttagttttgagatggagttttgctcttgttgctcaggctggagtgcaatggcgtgatcttggctcacctgaagctccacctcccaggttcaagcgattctcccgcctcagcctcctgagtagctggg

SEQ ID NO: 150231 - DNA, 741 bp, Homo sapiens
accgttattgaattcacacaccacaatactatgcaggaacggggagtttgggagaaggtgatcgtggggttgtaattacaacccctacaatcacactcataagccacccacacaccacacacacatgcacacccatagtcaccccacacaccacacacacacatgctcagtcaccccacacattcataaaagtcaccccacatgccacacatacacacacacactcataagatagtcatcccacaccccacacacactcatagtcaccccacacgccacacacactcataaaatagtcaccacacatactcaaaacagtcacctcacacaccacacacagacacaccagtcacctcaccacactcataaaatagtcaccccacacaacacacagtcacactcagtcactctcgctctcacacacactcacacattcactcttacacacattctcacgcgcacacacactcactctcacactcacacaccccacattcttttccacctttctccacagaggagggacagaggcctgggcctggatgcggtgatcgtggggttgtaattacaaccccatgatcaccggggattatgggccatctgttgtctgtttgttagttttgagatggagttttgctcttgttgctcaggctggagtgcaatggcgtgatcttggctcacctgaagctccacctcccaggttcaagcgattctcccgcctcagcctcctgagtagctggg

SEQ ID NO: 150232 - DNA, 267 bp, Homo sapiens
gaaacgaccataatttcagctgtaacgttttgttctgtactgctgtcagcatacttggaattagaaaatccacacctgccatttgaagttcatgtttctttttctccccttgcccttgtgtaccgtgtatggaatgatctatctttaaacgtgattgggaccaaatcaagtcactgggcatggacattcttctggcatactacccctgaagagggatggggagaacttatagaggcagacacactgacagcagaaaaagtgacagat

SEQ ID NO: 150233 - DNA, 226 bp, Homo sapiens
gctctggctgccaataccccttaaaggtttctatcaattctaccttaactactcttggtctgttttgtctctccatcccatgttttaactattagaaaaccagattcattctctatcctctatcaactgttgtttcaagggtatctagaaaaggcttcttttttaaaatcttctattctgctagaagattactttatttatttattttgagacgaagtcttgctct

SEQ ID NO: 150234 - DNA, 229 bp, Homo sapiens
cgcttttgatcactaactctgaatagtgattattcgcattactttctcagtaattgtactagtgccaaagcaaccaaaaatttaccaactgtactgtatgcttttatcactaccatagctattatgtcacttttgtaatctatattataaaagatatagtatatgacataaaatatcagttctgttttttttttttttttttttttttttttttttttttttttttttt

SEQ ID NO: 150235 - DNA, 1240 bp, Homo sapiens
tcatggactctgagcatggactcagaaactactgaggagaggcatcgtggtgctgaggtaatgttttaaacaaagctggtgtttgggtgggtctttgtgtagagaaagtggcagtatcttgtgtcacacttgctaagctattgtgtaatgacagatttctggcatatgctaaaagaaagcaatttgtacctgatgtttgagttggaaagagaatgttatgtaaatgaattgcttttttcctcattgatagtttaaaatgagcttttgatctactatagtctgtatgtgaatttctgactgcagatgttttgtaagtccattcctgattcagaacaccctgtctaaagtacagctccatctctgtgccgtgccccactttactgcactcatagaactcggtctccacctataacgctgtcaggtgcttgtttatttgtgctttttgtcttttctggcagcaaagcaagaggataggtgttgtttttgtgtttttgagatgcggtcttgctctgttgctcaagcacgagtgcagtggtacaatcatagctcaccacagccttgaactcctgggggaccgcaggcgctcactaccacacctgactaatctttttatttttatttctatagagatgaagtttcacactgttttgtgcaggctggtctcaaacacctggcctcaagccatcctcctgcctcagtctctcaaagtgttggcattatagccatgagccactatgcctggcccaagtttgtttgtttgttgtttagcattattattttatagcaaactttaaattcttgtttattggcaggataaatagagggaagaaggacgagcaaataggtaaacatacctgcctcctagtgggtaatcttgggcaagttttttcacctccctctgcctcctcatctgtaaacaagatcctgcgtgcccgcctgggatgcctgctaagatggcacatgggaagcacctggccttatgcctggccctggtcagtaagggctgtgcggttccacttgtacctgataaaattctaatctgattaaaagctttactagctcgtgatggtcattcttttcctctaacttagcagcccgatgaaataatgtagtaagtaaatgtaaccttgttgtttgtccttttgctgccacgatgaacacagctgtcttgctagacctctgttgacttcaacagggatagcatcaggtttattggaaatttacatatgggacagtccag

SEQ ID NO: 150236 - DNA, 205 bp, Homo sapiens
attttgtaaatccagccattcactaaatttcttttaccaggaacaagttaagaggggaacacttattaacatctgagtgaacactgttggtggaaaccctagaaagattttgccaaagtttttaagggtgagatggcctaccaggataaaaaaaaaaaaaaaagacactgataccatccaagtcataacacaggtaatctgaatg

SEQ ID NO: 150237 - DNA, 355 bp, Homo sapiens
  misc_feature (318)..(318): n is a, c, g, or t
gaggctgctccaggatttaggcgttgtagtgcatcatgcttctgtctcggaacaccgtcctccaggggcagccctttgggggtgtccccaccgtgctgtgcctcaacatcgccctgtgggtgctcgtccttgtggtttactccttcctccggaaagctgcgtgggactatgggcgcctggctctgctgatacacaatgacaacgcctgacctcgctgatctatggggagcagagcgagaagacatctccctcggagacttccttggagatggaacgcagagacaagggattctgttcctggttcttcaacagcataanaatgaaggacgaggatctgattaacaagtgtggggac

SEQ ID NO: 150238 - DNA, 885 bp, Homo sapiens
  misc_feature (848)..(848): n is a, c, g, or t
gggttccccggcaggtcagagaagctttggggcggggccaaggttggcccctgcttgggaggagccgggatgcctctctcacagtgatgcagagaggaatttgctgacagtcccttgccaggtggggctggcttcgcccagccggcgaggaggaggacccgctggcagtctcctcccaggtggggagcgtggagcctgtcactgcagcctggcggcctgagcgccgagcctggggctggggccgcggtgctgaggacgcaaatgtgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtgctcgtccttgtggtttactccttcctccggaaagctgcgtgggactatgggcgcctggctctgctgatacacaatgacaacgcctgacctcgctgatctatggggagcagagcgagaagacatctccctcggagacttccttggagatggaacgcagagacaagggattctgttcctggttcttcaacagcataanaatgaaggacgaggatctgattaacaagtgtggggac

SEQ ID NO: 150239 - DNA, 774 bp, Homo sapiens
tacaaaaaataaaaaaattacccaggtgtggtgatgcgtgcctgtggtaccagttactttggaggctgaggtaggaggatagcttgaacccagaaggttgaggctgtagtgagttgtgattgtaccactgcactccagcctgggtgacagtgcaagactctgtcttaaaaaaaaaagaaaggagagagagagaaaaggaaggaaggaaactcttctactatatatctctaaccctgctacttcctaaaatttagtcttgtagctccaccactccaatagtgtcattattacccatatccttcaagaataatgcttgtattcaacatgaaaagagaagaagttggctgggcacggtggttcacacctctaatcccagcactttgggaggctgaggcaggtggatctcttgagtccaggagtttgagaccagcctgggcaacatggtgaaacctgtctctacaaaaaatacaaaaattagcccggtgtggtggggcatgcctgtagtcctagctacttgggaggctgagaggggaggattgcttgagcccaggaggcagaggctgcagtgagctgagattgtgccaatgcactccagcctgggggacagtgagactatgtctccgaaaaaaaagaaaagaaaaattaaagagaagagattaagaacagcatgaagtaacctcaacattaaaggggctggaagaggaagttctaagaggagccagtttagatataagatgactgagaaggacctacttactggagaaggtaggaaga

SEQ ID NO: 150240 - DNA, 169 bp, Homo sapiens
ctgaagcaaaagagattatagttaccagaagtatggcctctaatggtgttgagccttttcaagaaccaacaaattatctttgtgattacagtagtttaactatggttaaatgttactgctgttgcgctgctttatttaatgcactgtggaacaaaatataagggtactg

SEQ ID NO: 150241 - DNA, 389 bp, Homo sapiens
gttttcctccctcagcctcccgagtagctgggactacaggtgcatgctgccatgcccggctaagtttttgtatttttagtagagataggggttcaccagtttcacgtgttagccaggatggtctcgatctcctgacctcatgatccacctgccttggcctcccaaagtgctgagattacaggcatgagccaccacacctggctgagcgttctgattttctactttctcaccaatccttggaatctttttgtcttttacattttggttatttagtagatttgtggttataatgcattattttctagttgctaataattaattaatgtgagcaactttatttattggccacttggctatccttttttgagaagtacctgtttaaatctttt

SEQ ID NO: 150242 - DNA, 343 bp, Homo sapiens
cagccattttttcaagtaaaaatggtattccatttaaaaagctcacaactcaactgcacaagttcttttccttgagttaaccatcagatttgatattcaataaaagtgttttacaggtacttttcatttcatcatacaaaatatatttttaaatgtactcaaggattgagatacaataaaattagtaagttttattgcttcatcaaggacataaagtttaactggcattttttttttttaattccaagtgcacagtgatgaagaacacaactactagtacaatttagtaccaatgccttaatttgtgccaaggtgctggcagttttacccaccactgattttg

SEQ ID NO: 150243 - DNA, 428 bp, Homo sapiens
ttgattcacacaccacaatactctggggttgtgacgtggggttgtaatacaaccccacgaccaccttctcaaagcctgagcagaggctgcggaccagcatgcagctgaccgcagggctgacaccctgtcccctttactctggcaggaaaatgcggtctcacgggccccgtcctcacccctccactcttgagtctcagatcccccatttccacattctgaagtccctcaccctctctttcccattctctctacgtaaactcaaatgttctctcactgttttcaccagagcagcaatccctgcgtcagctttggcgttcaggctgtgccaagggcagaacatcgttctcattagtagaacccccttctgggtggatccttcccaggtgcatcctgccctgtctccaaggcagccctggctattgtcagcc

SEQ ID NO: 150244 - DNA, 371 bp, Homo sapiens
atccttccttgtgatatgaagctcagaagatccatggtaagttaaaatgaactaatcatttatgcggttagaaaaagatataatgtaagttaaattcagacttaaacttgaatttggaaaaggaggtatgggttgttacaaacagtcaaacaaacacacctcactaacctggatttgagtgctgacttttcctaaaactttgagcaaatcactgaatttgttcaagcctttgtttctttttctgtacaaatagggatgctacatatatctctcacaaggatgttttaagggttaaatgatgtaacctaaatgctctcataaatatcaaatggtatgtgacatcataaattatcattattaaattcctcata

SEQ ID NO: 150245 - DNA, 275 bp, Homo sapiens
gcccaggctgcgttgtcgctcatgtctgagatctcactggccccatggatgccatgccctgccctcttagactcaaatgcggtggggacctacgcctagcccccgtgcatgcactggccacgtcctgcttgaactccactttgggaggccaacttgatcagagacctcagcaaaccagcttcaccttggcaggcggctccacactctcagatcagacccagacctctgtgtacaactggtggggcccctgcctggggggctgcctcctctgtgtg

SEQ ID NO: 150246 - DNA, 308 bp, Homo sapiens
gtaaattcctgtatctactcaaaacactacccacagattcatcctcattcaggaactacctgcaacttacccaccacctgtctacctataagctgatcttaccgcatcctggcagaagctgagggagtgtgcacgcccaaggtggcaacggagtgtgtgccacatcagcgtcttcatgacaccaacggccagcaggagagagcgcaccgggcaactgccgcactgcagaatcccgctcagctctgcagagccaggccctgagtctggtgctaactctgacagaaaggaacccaacataggttttctga

SEQ ID NO: 150247 - DNA, 891 bp, Homo sapiens
tcaagagcaaagttctcaatatttgtacgtttcagttttctctctgaaaaagtggagataattcctgtctcaaaagattacaaatgatcggttgagaggatgtgtatagaacgttttgtacactgtttcatacatagtaaatgctctattcctattctcctggcattcagtgctttcataatctggcttcaacttattcttctagcctcatcttctgtgactctcttccagtcatctgatgctgtaccttatcaaattatagttgaattctaagtaataatattttttatgagaaagtcagaatttttttgttactgtaattttttaaagtttgctctattttagtatgtttggaagacaggatggaaactttcctgcgagatgtatctctaattttataatggaagtcatgaagaaattagaatttacttaaatttgctttaaagttcttgtaatactttagttgtaataaatgagaatattcatataaagaaaaacacggtttccagttttaagataggtaatgtggtttcaattctttctcttgataatcaccaacagaaaaaaagctgaaataaaattcccatctttaatttaaactagaggtatctccaacccttgagctaaaaatccaaagagaaagataaataactaaggaagagcatcaaacttgagcgcttaagaacctacaggatactgataaaaagcaccttgttttacctgcaaactcagaaaggcttagagcttagaaggactggtactacagaatataggagtgaggcaggggccatcaacatagagattgcttgaaaacactgaataaggattcctatgttcccacctcacaggaaatatactgtctggtttaacaatatgtattatatttaacag

SEQ ID NO: 150248 - DNA, 477 bp, Homo sapiens
tctgcccagttgtcacctcagccaagagaacctctctgtctgccatatacaatatcattcacatctttccccatccttttcactctccagccccacctcattgtctccccagtacttgccaccatatcaccaatgtatattaccggtgaacttgttgttctctacttcctacactataatgtgtgctccatgaaggcagggactttgttcactccagtatgcccagagtctggccaaaatgcctgatccctgagatggacctgcccaataactatttgctgacttaataatgagtgagtgaactgccaaaccctatctgctggcatgtgaaggacactaacatcctgaactggtacagacaaaaccaggaccttacgaaggtcacaggtactagttgctagtaggttgggaactggggaggagagggctgagtttacagagggcagtagcctaccttgactcccatctacctgcttc

SEQ ID NO: 150249 - DNA, 405 bp, Homo sapiens
tctcccagtctttaccttgtctttttgttctaacaatgttttttgatgagcagagatttgaagtccagtttaccattttattcttttgtggattgtgcttttagcgttatgtcaaatccaaggtcacaaaggaagttttatagttttaggttttacatttaggtctaccatccatttttagatttttctatatagttacgggtttttttttttttttgcattttatgtatacgttggttctaccaccacttgttgaaaagacaatatgctttctacactgaattgcctttgcacttttgtcaaaagccagttgtccatatatgtgttggagtagagcctttttgagctaataaattttgtaaaattttaaataataatactaggcagattaatagggattaaatt

SEQ ID NO: 150250 - DNA, 834 bp, Homo sapiens
ccctcttctgggttacagactgcttatttctcatgcttcctcacagggcaggatgacagtgagagagccctataggatcccttttacaagggcactaatcccactcatgatctaattacctctcaaagtatccacctcataatactatcatattggaggttagaattttaacatataaatgtgaggggggacacagacattcagtccttaacagattacactgatctgcagagaaatgcagaggtagaggctcaatgaaatgaaagtgaaaagaacctgactttacttcatctttcttttgattaacttgtgatcttgagccagtaacttaaagcctaaagtctcacagctgcctactcactcaccttaatccgaacagtacaaagacaaatatgtaattttacatattaactttaccataattaggtacatgtaaaggaaatgaaattcaaagttggttaagaaagtgcctaagaaggtagcacatttccaggtgtacctcatcccaaatttggagaccaaattataatcttctatcccacaagtcctcagccaccatgtactctggcaactcagcaacagacctattgagagcagacaagaagcacagaggtgaagaggtttatcctaacccagctttggtatcccaggagttgccatcaattggaatcatgaggttaagtttggtgatttgaaaatgagacttggctttaaacaagtttgttgtcaataccatgattccagagaattctagccatttgtcaaagatatggaaatcatggaccagcccctagagtaagggaggctggcaaaacccaggtaggaggtcaggga

SEQ ID NO: 150251 - DNA, 372 bp, Homo sapiens
ctcaccctcccgagtagctgggattacaggctcacgccaccatgcccagctagttttcttctttattttttgttgagatggggtttcaccatgttggccaggctggtctcgaactcttgagctcgtgatccacctgccttggcctcccaaagtgctcacaggcttgagccaccatgcccggccctaatttttaaatttgttgtagaaacaaggtcttgctatgttgtccaggctggtctcaagcgcctggtctcaagtaagcctcccaaagtgctggggttctaggcttgagccacctcgcctggcacttgcaccgtttttctgtgcatgcatctccactcccactgcccaggacctgtggacttagatttg

SEQ ID NO: 150252 - DNA, 126 bp, Homo sapiens
agaagtgctttgcccaggttaagctgaaagacaagaactcagggcttctaattccaatggtataattcttaaatgcaattgggaaataattgcccatctccacaaatgtaagtttagttttggcag

SEQ ID NO: 150253 - DNA, 576 bp, Homo sapiens
aaatattggcccagctagactttcttccattaacaatcagttgagacacatttttaaagcaacagcttaaatgaatggctgtgtgtctgtaataattttgacttaaaatgtcaactggatttgagatgccatgtgcatttaatcaatgtctctatattgtaaaataaatatacttcagcgtgactgctgtgccagccataaatcataattcacaaagagaagaacatcttatcctctctattgatagttgttaatgacaatgctgattaaaatggcatctgcctgccatattattgttaaacagtctattagaatttctattacatcctataacctaccactatttccctatgtgctgatacgtctcttatggaataaaacatgatagacagttagatttagagtttaacacttaaaatgcaaaactgaagagcagagctcactagtacattctaacacatattatttccaaaattaagagggttccttccagcagagattccagtgatcaaggtagtgttcaaggacttgttcctctcttttagaattaatatttgagtctcccttccttccttc

SEQ ID NO: 150254 - DNA, 568 bp, Homo sapiens
ttcatggataaatcagaaaacatttggatatgttacactgccttagggtcattgttataatcaactatcattatttactatgttggactgcttttgcccatgtactcagtaaggaagtttcagttgaagtaatactaggcagaccaacttttaccacaggacattaaaaccaagagaactgacagctcaaccctaaaagctgaacatctttttttttctctctctttttttttttaaataaaataggcaattcacctgtctggatctttcctcaaatctgtttccaggtcctgcaaagtttacctttaaaaaagcatgattgtacatgagcaaaaatacatggcctaaatatgtgtcaggcttgcttactggaagaagggatataatttccagaaaaatacagtaacatgtctatagaaaaatcatatgtaggatgtaaagctcttacaaattaactgttaagtaaacagaatttctgccttagaacttcattaactatgttaaatgaaggtaagtttagcctccctttcctcatcctctttattctctagtgtgtcctctaaaaagg

SEQ ID NO: 150255 - DNA, 343 bp, Homo sapiens
aaaaagtacctgggatatctacagacactcagtaaaactaagttgaatacatgaacacatacttgcttgtttcttttcttttattttctacctacaatgctaaaatttatgttcaggcactgtattaaccacaggaataacatatcctcgcaaatgccctatgaggtaggcatcatttctgccttcattttacacataaggcgagaggcgcagagagcttcttacactaacagtttgttcagagttttggagctctggtaaactgtggagccaggatcaaactcaagtctcctgactccagagacctttgctgtaactattatctctgcagtggtccccaaca

SEQ ID NO: 150256 - DNA, 451 bp, Homo sapiens
gtaacgtggtaagtaagacaggcccacttccatttgggtagctatgtaaacttggtaagctacttaacctcttggtgtcccagttaccttatatgtaaaatggtggaaccaatagtacctatttcataggattgttatgaggatgtaagagttttatgtgaaagagtttagaacagtgaaggcagaaggtgggtgagtcgccaagagatctgtcttgaggtagtggtgcctgctgtggtcatcttagatatgagggatatctgaggaagaatcgactggcttggagaatgatagaagattgtcaacaccggatgtgggaatcaaagctgagaaccaggtaatccaggtcaatggggattggtggtacccgtcttagacctggagaatttggagggtggtattagagtttgcattagaagatttcaaccctagagttggactagttgagctt

SEQ ID NO: 150257 - DNA, 255 bp, Homo sapiens
taagacaaaagtcaaatagatttagcatcaaggaagcggtaattttggtgacaagagttccaatggagtctgaggtagaagctaaactgaagagcaactaggatataagtagtcagcaaccaagcccaattcctaaatgataaaaattccaaactctaggccaggtgcggtggctcacgaggtcaggagatagagacggggtttcaccctgttggccaggatggtctcgatctcttgatctcatgatccacccac

SEQ ID NO: 150258 - DNA, 151 bp, Homo sapiens
gcggccgcctactactactactactactgctcgaattcaagcttctaacgatgtacggggacatgttcctgaatccaaggagtttcctccgtggcagtggcaccagtgctcccttactctcgccaaaaatacatttcacaccgaccgcctg

SEQ ID NO: 150259 - DNA, 291 bp, Homo sapiens
taggtgtgagccaccgtgcccagcatagcagttattatactttccatgatgaatggagtaatctttccagcagtaatctttggggtgggaaggggtacttgcacacacacacacacacaccccatcccagagattgtgaggcatgctccctagtccccctgggagtgactgccttggaaaaaattgttcctgaagggcaggatggagggtcacaatccctcatccttttccaccatgaggtggaaaaatggtcaagagtctctgccttaaaaatggagcttaggagataaa

SEQ ID NO: 150260 - DNA, 270 bp, Homo sapiens
aggccccacgcatgcccaggctgccttcggttctcaggcgctggtggctgttcccagggtctgggggccctggggggccaggatgctgttgtcctctgctcccgcctggagaccactgtctcctccaaagctctgtaaactgtcagtagtgcaggcccctcagaagccaatgaggttaacgggcaggtcagcgtcaggggctcacccagccaccccagaaccccttgctgttgattgccagctggcaatccacgcatggcactgccctca

SEQ ID NO: 150261 - DNA, 654 bp, Homo sapiens
cctgtcatgcatgtactgcctcatggctctaagatggctgccaccgctccaggcttcacaacctcacacaactgtgtccagaaataaggacacagcttctcttcttgcatagctctgttgcccaggctggagtgctgtggcacgatctcagctcactggaacctccatctcctgtgttcaagcaattctcctgcctcagcctcctgagtagctaggattacaggtgtgcaccaccacacctggctaatttttgtatttttagtagatatgggatttcaccattttgcccaggctggtcttgaactcctgacctcaggtgatcctcctgcctcggcctcccagagtgctgggattacaggtataagctaccacacctggctaaattttgtatttttaatagagacagagtttcaccatgttgcccaggctggtctcaaactcctgacctcagctgatcctcctgcctcaacctctcagagtgctaggattacaggcgtgagccattgtgccccgccttcattctaattttgaacatgcattcccatgggaaataatctgatcacaaaatatgttagaaacaacataagaatcataaagttgtttcttccaatacacagtttatgtataattagttcttccatggcccccgctgcc

SEQ ID NO: 150262 - DNA, 115 bp, Homo sapiens
tcgagctcggtacctcataaacaattaccaacatgcaagaactccaagagttattcctgggagcacctactgaggaccctattagaaaacaagcgtcaggcaaccaaagtgacta

SEQ ID NO: 150263 - DNA, 438 bp, Homo sapiens
gataatctcctttgtgcaccatgtaatttgccctgaggaacatgtaggagagtgcatttaagttattgatactatttgctttgaggtgcctggctctagatgtgctccatgtgatgcatccacacagaaaaaaagctttatagatgaatataaaggcatgtgtaatggtctgtgggtaaagtttctggacaatggaaagagaataggaaggaaagttatgtatttctgttgactgttagttttatcaaaggacccttcgcaaagatttctgctattctttgtcactgtcacagtctcttgctaagagcactttgtcttaaatatcctgttgctcctttactactattacctgaaattgatggaactaataacacgataatacaaggatactgctccttggtgtttttttctgcagtggcattcagaaatgccttgtat

SEQ ID NO: 150264 - DNA, 679 bp, Homo sapiens
agttaccaaaacatctccacccctagcaaaactagccatctaaggccttcaagttgttctttggtctgaaatatgccaaaagttcatcaaactactgttcaccaaagtctccaccagaagtacaagcttccaagatcatccttcaatataaaagtgttcattcaacactgctctaaatatcctctaatttggccccatcatctatctttcatttccttcctaaatacttccactgtgttgaaaatcatcatctgccatcagcagtatagtgtggttattgcctggaacaccagagggaatcaaatctagcactgccacttccaactctgtgaccaagggcaagttgcttaacttctcaatttcctcattcataaagtgagactaataatagtaccaatattataggattattgtgaggatcacatgagttaatatgtgtttagagttgggaacagttttgcttccggcaaatagtaagtgcttgacaaatgtattaaaatgaactattttttattagaacactcatctataccctcaacctaaaacttaacctgctcatcccctgaggacatggcttctactgaagggctctcaagtaaggctattttttcttctactatgaaccccctcccatatttataatttttaacagtatgtgactttggttgggcgacatatg

SEQ ID NO: 150265 - DNA, 261 bp, Homo sapiens
agttaccaaaacatctccacccctagcaaaactagccatctaaggccttcaagttgttctttggtctgaaatatgccaaaagttcatcaaactactgttcaccaaagtctccaccagaagtacaagcttccaagatcatccttcaatataaaagtgttcattcaacactgctctaaatatcctctaatttggccccatcatctatctttcatttccttcctaaatacttccactgtcttcccttttctcggtgatcgtacc

SEQ ID NO: 150266 - DNA, 223 bp, Homo sapiens
tcccgccttcagtctctccagtgtttccagttacttctcaccgccgagcacctttgcacatgttgttccccgcctggctgaatcctgattctccttcagcttcagctgccctgtcctcaatgcagaaatacgtattcttccttctttaactcctcaaccctaaccctactaaccctaatcccacacccccaaattaaatcctctctggactagattaaatgca

SEQ ID NO: 150267 - DNA, 606 bp, Homo sapiens
caagatggtccccaactcagaaggttcaactcataattttttgactttattacgggtttatcaggttgaaacttcatagttaggtcaagcggcatcaggacttaagatggttcagcttacttacaattttttttttcagtgggcttatcagaggttgtttgttttttgtttttgttttgtttttgagacaagtctcactctgtcacccaagctagagtgcaatggcgcgatctcggttcactgcaacctccgcctccagggctcaagtgattcttcctgcctcagcctcccgagaagctgggattacaggtgcccaccaccatgcccagctaatttttgtatttttagtagagacggagtttcaccatgttagccaggctggtctcttaactcctgacctcaggtgatccgactgcctcggcctcccacagtgctgagattacaggggtgagccaccacgcccagccagacatcattctgtatttgcaacccttattggtggacatttataaaactgacatgagttcatgaatgcttcctgtgagaagggtgcttctaagaaaggagtcagattttatatgtgggaaagccaagctgaggagcatc

SEQ ID NO: 150268 - DNA, 620 bp, Homo sapiens
atgagtctgtgtgggtcaaggtgtagcggtttcagagggcatggatctttcaggaattttgggcagtcttggctgaaaataaaggaaggaatgagggctgggttgggggaagtggacaacggagtatgacagtgagaggagacagattgataggaatcaggtgatggagaactggggtgtcaggataagatgcttggagaagtattggccctctgcctaaaagaaatcagggtgggctgagtgaaaaataagctttcaaacatgcatgttctctttgccttttttttttttcctttctcttttggctgggttttcacgtgtgttagtgttctgggggaattatacgtgcatcagacacgtgcagatgtttggttcactcagctggttgattcagaaagctgcaggaagcagtaggtcaagctaaggaaaaggcatgcatatttcaatatgtgtgtgcggcaggtgtggtttctatgatctgaacagaaatgcaggggaaaaggagagccggtgtatctcccagcaaatgtctccactctgagatgatgggtatgattatggccccaggaatggtgataattcctgatatttgtgcatgagtgtacttgtctgggagtgcc

SEQ ID NO: 150269 - DNA, 402 bp, Homo sapiens
tcaggactggcaggcagactgtgtgtggaagatgagagagaggactggggaatatgtctcagtttggggtttgaggctggagggatgatgtgaactagtcactgaggagagagctggtgggggcctcaaacatctgccttcatgtgtggagccggacaggtcagtgggcagcaggacgtggacgatgatgctacaggtgcttgggcagacagttctcacaggacttgaatggacactgacagatggttaatactgagtgtcaacttgatcacatgccctgtgattcaagttaacgggaaactacaacagcccagtccagacaggatacaaatggctcagactctttaggaatgaaggtttaggtcactccaccgggaaaaaaccacaacctgctgaggtgct

SEQ ID NO: 150270 - DNA, 618 bp, Homo sapiens
ttcacttgttatgcctttggttatgcttatcttcctccattgaatatcttattatctcatcattataaaaattagcttattttctgagaacactttcaagtcttccttgcccctctagtttatattgatttaccattttccccatatctctggtgtgtttcccagagagtctgttttttgtacctctatgtaataggttattagcaaatattttctaaattgagtatctgccactaacaacaggccagcataaattatagaaattagtataatataatctaattttactttgtagtcaaataattaaaactaataaaagaagaggagttattaaacagataagtcagggtaaaattaatcctgttacatatgtccacttagtaagtacattttaaaatcaattttattgaggcataatttacatacaatgaaatgtacccattttaagtgtaatctgatgatttttgacaaatatatacaattaggtaatcattaccgcaattaagatataaaatgtttttataaccctaaaaagttccttatgccccattgcaggtagtcttcctcccatccctggccccaggcaatcactgatttactttctgccactatagatta

SEQ ID NO: 150271 - DNA, 113 bp, Homo sapiens
ctgggagttaaaacttcttataacaaagtcgcttatattaaaagaaattaagtaaataaaccaaacgcagtgactcacgcctgtaatcccagcactttgggaggccgaggcag

SEQ ID NO: 150272 - DNA, 387 bp, Homo sapiens
ctgatccgtgtagagtttatattagccctgtaataatttctatttctctttatagttatctctctttcttttgcataactcatggttcaaaggcaatacaagcatctctctaacattaaaatcagtttagtattttaagacttcgagagaaaggaccataatagggttgccaagtagtattcagatcttgcaacaaccaagaaaattacaaagacttggagaaaacagtaaaaatagcagtgagttgatagtaagcactctattgtaaaggaaaagatagtggtgatatgtctgttaaaattgtggatttcttgttttgaaggaatgtcagctccatttctagggcagtgacagccagcaatgaagattcagcagtacaaagggtat

SEQ ID NO: 150273 - DNA, 245 bp, Homo sapiens
gaattccagctcggtatccctgctaggaatgatagagtgaggtgtgtaaccatttctaagcagctccaggtgatcctaaaggcgctatcggtgctgagatccaccactctaatccctgtggctatgtggaactagcactcaccttttctgtgtttgctctccccgtccttgagattctggtggtgacacgggcaccaggaacacttccctggactgactgatgagatcagggtgcaggcatctca

SEQ ID NO: 150274 - DNA, 381 bp, Homo sapiens
gaaaaaaagtgtacattgaagtattaggtatagtattttttaaaggagggtttattgatatttaagtttaggtgcacatatataaatgcagacagtaatgagcaattaaatgtaacagtttggggatttagggagcttttaatttttttatatttgctgctgcttaattattatactttgtcatctttaaagacaactagttaagtatgtaggtgtgtctagcaatcgtttctaaactcggtctttataggctagatatcacatctatcaatttccttggccttattaagttccttggatcttacattgtagccctttagctcatacttttatgttgtttgagagtgttttgttgttaaaaacatggaaatcttaaaaagg

SEQ ID NO: 150275 - DNA, 442 bp, Homo sapiens
  misc_feature (11)..(11): n is a, c, g, or t
  misc_feature (18)..(18): n is a, c, g, or t
aggtgactctnaggatcnccaaacaccgcaatctgaaattctcagtagaccacatataaccagtaagatggtccagaagggaggcttttcttaccctttgaagagggccaacctcttaattagttttttgcattaaaatgatataaactttggtctctacaaaagctattctggcatgtgggatgatgtgatagtagtggtattgatgtggatgagtagtgaggtgagagataactgttcacacaagacaaaacctttccttcattaaaggccagttttttttttaacaaaaagagaagaaattgaatattgatctctaatgggtaaattctaaccattaaaaaaatactgagtggaatctgtgtgaatcagttaattttataattggccacaccacttattttggcacctactcatagattgcggtgtgctgctggatatc

SEQ ID NO: 150276 - DNA, 646 bp, Homo sapiens
gagcgtaacgctctatgtggtggacgttcgtgtctcggcatagacacacagatgtaagaagcctatgaccatgctactagctcctatctaaatccaggtcttgtcacatcccattggctgaccgagtcatatggctaggctaagctcagaaacaagaggtatcaaagtacactttgcctgtgatgaggctaatgtaatatttggatatatagtactattgcagaagaacgaagaatctgaaattctcagtagaccacatataaccagtaagatggtccagaagggaggcttttcttaccctttgaagagggccaacctcttaattagttttttgcattaaaatgatataaactttggtctctacaaaagctattctggcatgtgggatgatgtgatagtagtggtattgatgtggatgagtagtgaggtgagagataactgttcacacaagacaaaacctttccttcattaaaggccagttttttttttaacaaaaagagaagaaattgaatattgatctctaatgggtaaattctaaccattaaaaaaatactgagtggaatctgtgtgaatcagttaattttataattggccacaccacttattttggcacctactcatagattgcggtgtgctgctggatatc

SEQ ID NO: 150277 - DNA, 352 bp, Homo sapiens
ctgttgagtgcctctgggacctgtatttttcttgctggggtgggatttattccgcttctcccgtactcctgcatctccaaggccagtggaggacaccaggggacagctggctgagatcaaggattaacgtcaaggaatttcttcatcgtctccatcatcaaattctacttaacatgctctgcccattccaagaaaaaaagaggaatgaatgtgaactctttttgtacatacagccatttactcaaaaaatgcagccggcagagattccacagctgggaagctgactggtaagcaccctgtgtaagtgaacgcgctcagtgggatggaaggaagagtactgaggggacgcggg

SEQ ID NO: 150278 - DNA, 174 bp, Homo sapiens
aatgctgtttagcacttgagcggaaacaggcatccataagttaacacattagggagaattaggccgaagctgatcaataggtgactacttaaggcagtctagtatttggttattaaactttgttgtgtcctacaaagcacagttgttgctttttatagcttaattgttttttgg

SEQ ID NO: 150279 - DNA, 595 bp, Homo sapiens
gatctatccaagcgaactgctgaaactatctgtgtctctgtttcctcttctataaaatgggaataacaatagtgcctacctcttagctgctatgagaattaaaagagctattagctgtaaaacactgagaaacagcaactgcaaaataaaaagcactaaaaaacagctcgttaaataacaacttaacaagcatttcattattagtcatttaagataatggcataagtgcaaaaaataataataataaatctgaaatgcatgctcaggactgttcacctgagtagtgctttttgatcagagagaaaattttaaaacaattctaaatgcccatcaactagagaccaatgaagcaaaatgaggtatgcccatgcatatgaagaaatgctgtacagcctttaaaaatgacaacaagtaacactgttttgggtaaggacacacagcaaagcagtcaaaagcacagaccctggagccagcccacctcgctcacaaccagctccaccacatatgggctgtgtgaccaaagccaacggctgaaacatctgtgccttagtttgctcttctataaaatgggaataacaatagtgcataccttggc

SEQ ID NO: 150280 - DNA, 339 bp, Homo sapiens
tcctacggaaactcccaggttcactccaaagcttaattcagatgcaccatggccgtttatctgccactgcagctgtttatcacatggcaccatcatggtcaattatttgtctaagctcaccttgcagtgctggcttcttcaagtcaggaactgtgtttgaatccttgtagcatcccctcccctcacacacttcatagcacataggagcctggaacacacttaagaacttagaacagtgcctggcacagtagagattcaactaatatttgaattaatgagtaagtaataggtgcacaataaatgttggttaagtaaaagatagacaggttgtatatatgg

SEQ ID NO: 150281 - DNA, 392 bp, Homo sapiens
tggcctcccacagtgcccggccataagtgtgaaaatgtctttaaccgcctggcccattgggactttgaagaaattaatgaaaacagataatactaatagaagaggatgtacagagggttaaagaatatatttggtttgagatccatttgtttaagatgcatgaaatctcacgaaatggactttatcttggtatgcttttatttttttaattttaactttgaaataatttttcctttatacttctttctgtacactgctgctttcatttttttttaagagacctaaaggtatgatagggacaaggaaagagagggtggtgatcctgttgcccttgtgggtaaggactgcggaggcagtggtgcagttctcaagcatgaccacaaggtggagtc

SEQ ID NO: 150282 - DNA, 432 bp, Homo sapiens
acccacccattttttctatcttaccatgtctctgaaacagttttagaataacaataccaaaactactaccaacactatgatttctgaaaacagtttaagattttcttttctttttttttttttgtagttgttttgactgtaggatatatcccaattaccgatttttttttttttttttcagagacagaggctcactgtcatccaagctggagtgcagtggcaagaacataccagttactgaattttaaaatcacttgaaatagttcttttattttgagtcaagctggcaaccaaggtaggcttgaccacaaagaaaagaattattccaagtgacaacatttagatttaagctcagaggctccattttattttctatgctttgggattgctttttataaattttttattttgctttatagaattatgagaaat

SEQ ID NO: 150283 - DNA, 295 bp, Homo sapiens
ttgtggcttctgccattaacttgtttcagtttgtctttttgatgatttggggtaaagcaaaatgctgtttcattgttatctatgtttggggaaacctaaaaccccctcaaagagttacgtatgcactgaatggaagggtatccattagcaacagagcggttttttagacatcatccaactgtaacaattcacttggaatctgaattacattttctagaattctacatatcacccagtgcagtcttatttgttgatgtgttgtttaggtttcaaggcactaatgtactgcagattt

SEQ ID NO: 150284 - DNA, 430 bp, Homo sapiens
cgaggtggggaggggccccacccatgttttcagccattccagacttgaccacagttggggatcggcccagcccagcccaatcagcctgagcagcgacagcaatggtgacgctgctctgcagagatggccctgaggggcttcacggccaggccctgcgccccaactgttggcccagaacctggcccaccactcacttggaccccagcaggccaaggggctgactccctctgagtctcagtggctcctttgctaaatgggagtaataacagcaccttctcagagctgccaagagaactaaatgaatgagggcctcacacaggcaagtgcccagtgtcagatggcactgttacccagccaggagaagggagtagtgggggtagtcactctcaccagagggttgcaaaggaaaataataaatctcaggaccccc

SEQ ID NO: 150285 - DNA, 801 bp, Homo sapiens
atatttagttgcttgatttttaattacaacattgacttgtaaaggatgttcccaactaaaaaataaaatgaagtacatgattataaaaataaatattagaattttttctagttttactactttgaacatgttttttctttcactgagaatgtgttaataggcgaaaatgaagttatataatagataacttgcaggatagcaaaagataaagcatatatggtatctgttgttttgcttttcatgatttcggtatccatggtcaatcatggtcagaaaataggtgagtagagtacaataaaggtattaatattttaagagagagaaagaatattcacataacttttattatattgttgtaagtgttctattttattactagttattgttgttaatctttttctaatgcattaattaaactttataataactatgctataggaaaaaaatagaatatatatacgggatatatggggctaaatactattagcagttccagacatccactgaaggttttgaaacatattcactgtggataatgggggaatactgtataccttacttgagataaactgcatatgaattatagagctgtttgtataaatgattataaattttatgtgctgaaagttgtaacaaataaaataaaattaaaataatgtccatttttattattattagaaatgctgctaattggttggtaaaaattagttgttgcctctgttacttataccaattagcagaatttggaatctgatattttgcaataattttattatactttaataataataaaagtaatag

SEQ ID NO: 150286 - DNA, 439 bp, Homo sapiens
cccctgtcccaccaatgctgccacagcacacatttgagggggtccttgcagttatgcccccttttcctttgtctatactctctctgacttatgcttagtcttctcagaaatctggagaagctgagtcatctttctgggtatccgtaagaaccacgtgaaaggcgggttattgctccttaagcctcgttagagcaatgacctgatatgggttggtaagagtagaaccgcagccatgtgcctcgatttcctcaaatgcaaaatgaaagaattggatgtaggccatgtttcagggtcctctcttgctctggggttccaggagtagaaaacacccaagagacagaggagaaagggagctgattgattatttgctatctctgctgggcagggctaagcaattgccatgaaatctctattaattctcagaaagatcataggaggt

SEQ ID NO: 150287 - DNA, 392 bp, Homo sapiens
aagggcaaactttacatttaagcaattaaattaaaacccagtcattcacatcagattttgaggtacacaaacatttgtgagcagaagacaagtcaaagttctggtgggaaattctggtgggaacactttgttaagtctgttgaaaaaaatgagttacaaaaccaatactcaagggccctcaatggccaaaaaacaaaagcagctcacaggcccagtcccagagacatgggcaatgttaattctctccttgcttacctacagaaaagcatcagaacaaggcctgccttgaagaaagaggagggaaacaaaccgcagttcaggccacataagcagcttgcgatttctttccctgtcttctgcctaccactcagtgttataaaataaaccggaga

SEQ ID NO: 150288 - DNA, 104 bp, Homo sapiens
gcctggctaattttttgtatttttagtacaaaatacaaaatagagaaatacattagaaatacaagtacgatgctcttgtcagggaagaaaaactctttctttat

SEQ ID NO: 150289 - DNA, 839 bp, Homo sapiens
gtcctggccacgccatcggcaacctgctcgtcttgtctgtgaggccttcccagctggccgggctcaccctcagctcccgcacctgtgcctgccccgggaatctggggccgtttcccactcctcttcaaccgtcagcgacaccttgggccttcttttccagtcaggtgggacggcgcccctgtcaggctgtgtcttatctctcggaacacgggcaccccacagaaggtcctgcctcctgtggtctggagccccacctcaaggaagaaacccatgctgtctgctcgcaactccatgatgtttggacacctcagccccgtgaggatccctcgtctcagagattcgggggcacatgtatcccctgggcatattgtgtgatgctgaggtttgggatgcaaatgatcctgtcactgagatggagttttgctcttgttgcccaggttggagtgcaatggcatgacctcagctgactgcaacctccacgtcccagcttcaagtgattctcctgcctcagcctcccaagtatggcttttaagtgctattttaatcaaagaatattaaaataagtaagcaaataaagtagtacaagaagctagaaaaagcaacaaagtaacactaagaaggcaggatgaagaaagtgataatgattgtggtggtcaattttatggattgacttgactggaccacagagtgcccagatatttggttagatattatctctgagtgtgtctctgggggtatttctggatgagattgacattgaaaacattacattgagtaaagcagtaaaacattcatccaatctgttgaatgcctgaataaaataaaaaccgatgcgtaag

SEQ ID NO: 150290 - DNA, 258 bp, Homo sapiens
tgccaaggcaggtggatcatttgagctgagaagttcaagaccagcctgggcaacatggcaaaaccccgtctctaccaaatacttagctgggcatggtggtgtgcacccatggccccagctacttgggaggctgatggggaggattgcttaagcctgggaggtggatcgcgccacttcactccaacgtgggtgacagaacgagaccccatctaaaaaaagcaaccggggtcaggcacagtggctcacacccgtaatccc

SEQ ID NO: 150291 - DNA, 340 bp, Homo sapiens
gccatagtgcatacatttgctgtttttcatctgattcacctttacctctctacttgatgctatagtacatttacaaatctgcaagtatgctgcagaatacaaaatattgcaatgcagtgccatagattatactcaggcaccatagtaataatcagaacaagtagttcttaggaaaaattatggagaagagttcataattggaatgaacatgtttcttgttgcctctaatatctcatggctaattattatgaacatagaattgtcagatgaacctagaaatgactcatatcacattggtacactgattctcttaatgaaataatataggctggtattgggt

SEQ ID NO: 150292 - DNA, 510 bp, Homo sapiens
ggaatattcatacacatcaattatccctctacggcaagaacaaggggctcctgcatcatggtgacaaaaacattcagaaggcagggacgtgatgacttgcacatcagaaagatttatagctttttttttctttattgctagaacttgtcatctttagattaagacaatttgcagcactaatgatcagccttcatccctccatagtagcacatttggtgcataaatgtgtgagtaaacccattcactcacacacacaaatgtgagcgcatatgaatgcatttgtatggccccaaggccctgctctctgtcttacttatggactatgcttagactgtcttgattctccatggagtgatgtgataacccaagagtaaagattttctataagcaaagtttggccctcaatgcccaaacttatttagtctgagtcctttcggtggtgaggaagaagaatagaaattatctaaccagctttcttcacataaaagaaaatgtcttaaaagccataag

SEQ ID NO: 150293 - DNA, 197 bp, Homo sapiens
aggtagaagtgagagatgagctgaaaacaggacaagtgcttgaagtaagaagcttttaaactcacccatattggggaataagacctataatttactctagtaaggctgaaccagctctgctctcaaggacaccaaggcagggataaggcatcctaaggaaaacatgggggctaagacaaagtcaacatactaactag

SEQ ID NO: 150294 - DNA, 382 bp, Homo sapiens
  misc_feature (365)..(365): n is a, c, g, or t
tagtagcgctggcccaagttatagaaaaaaaaagtggcttacttgagggtatgcttcaagttcttagtgaggcaaggctggaagacagcctgatgtcatgctctgcagaaaccccaagcgtaccatgagctacatctgcactctccaggaggctgtgccactactatgttttcaatcctgataatgcaatgtgggcaattcaacaattaaaaacaggccctggccaggtgtggtggctcatgcccataatcccagcactctggggggccgaggcaggaggatcatttaagtccaggagttcaaagaccagcctgggcagcaaagtgagaccccatcttttttttttttttttttccttttttttncaaaaaactgggggaat

SEQ ID NO: 150295 - DNA, 418 bp, Homo sapiens
agtagagatgggagtttcgccatgttggccaggctggtcttgaactcctgacctcaagtgatccacgtgcctcccaaagtgctgggatttcagatgtgagccaccgtgcccggcccatttgtctcaatttttgttttcttttttcctctctcttgcctctttaggattgaatatttttaaacgattctactgtatcttctttgttagcttattgtctacaacttttgggagaggttgctttagggtgtatagtatgtctttaagtgatgaccttacaataatgcatttctgtttttcttatcctgattcttgtgccatcatcatcatgatatattttacctttacatattttataacctccagatatactttctttccttcatacagttatcttttaaagaaatataaaataccagaa

SEQ ID NO: 150296 - DNA, 200 bp, Homo sapiens
tgacatctctgcaaaccttctccctatagttgcataaagtttgaggtggacagtaagtagtggaaagatgggttgaaccttatttcagagtgggatcttcataggtttttctcatcttgtttttagaattttttgttgtttgtgtaaagatggtattacggaaacataaggttcagtgaaggaactcaggatgaaggtgg

SEQ ID NO: 150297 - DNA, 349 bp, Homo sapiens
atggaatgatttttgcctatccttattactgataatatatgcatacagagtttgaatacatctaaattaggctgatgggaatcacttagggatctagtctagttcccttcttgtaaagtggggaaattgaggcccagtaagttcaggtgccctaatccaagtctttcagctttttaggaacaggcttgtacaagtttggagatttgactcccactcaatttgttgcatgtttcttttattcctctaggttgttttcactttttatttttcatgtttcttttctttttgggacttctgtataggcttgctgtttgggtatagaaggaacagagaaaatgtgccatggaag

SEQ ID NO: 150298 - DNA, 293 bp, Homo sapiens
gcagtgctgggagcaggagaagatgcctggatggatgcccatgccgaagacactggatgggggaaataggagtcagcacgcaagacagggaagctacaggagaacctgaaaaaacaccataatgggagtcaaacaagaaaccaaaccaaggccaacccaactcagggtcagagcccaagaaggggttacagacagacttcaagccaagttcttcctgcaggttcagagcttggtgcatggccagggtcttggactaggggtcataatatgcttatctccataggttattttag

SEQ ID NO: 150299 - DNA, 174 bp, Homo sapiens
tgagggcagggaccaactactgaatccctccattactcctggatcccataacacccaatgcctgccacgtgacagacacatacttttcctttctcctgactgagccagatagttgaattctctgatctgcctccttatttttaatttataagactctacttaaaaaatagcttt

SEQ ID NO: 150300 - DNA, 405 bp, Homo sapiens
catagttgattcctagagtatcactgccgttgttcataccatagcagaggtgtgactctggggatagaagtgggaacaacagcttcatgatttaatgagcagctccttgttgtggtagaagcagccgttcccttaacagatcagttctgggatgtgactctgggagtctttttctggaaactcagtctaggacctgcttttccagcacccccaaggattctggagaatactgtaaccactagggctgcacacaaggaggaagtgtgatgttgaggaagtgagaaaagcccagcccagtggagcacaaagggtgaaacataggttggaggtcagcaggggccagattgctataggccactgaccttcttggctcaacctacggcactgtaaagccatgcttttgga

SEQ ID NO: 150301 - DNA, 381 bp, Homo sapiens
agggctggctgaaaaattgttctcccaaacctatcctccccaccaaccaccctcatctcagaaaacggcaccccactgagtgcacctggcttagccctcgactaggcatttcctgagttccctctttcctctacccccatgtcccaggacccagtgctgccaatcctacatcgagaccacactgggaacccagcatttctctccatcaacactgctcctaccccatcatctccccagacactgccagagcctccctgaggggtgagccacttcccttctgccctgtaccacctggtccatcctggttgtacatggcaaccagagtgattgtttaataaggcaacccacccctgcttggagccttttcctctctttctacag

SEQ ID NO: 150302 - DNA, 332 bp, Homo sapiens
ttttagccagctttcacttctttatagtcttctgggtctatagaagtttaagataataattttgtgtattgcttgtgcaatgttttttttttttaaatagagacagggtttccttatgttgcccaggctggtctggaactcctgggctcaaatgatcctcctgcctcaaccccccaaagtttagggattacagatgtgaaccactgtgcctggttcacttgtgcaatttttaaaaattgacaaatcacgcagaaaaaccagcaacttatgtcatgatcaaatttattacataggccaggtgtggtggctcacacctgtaattccagcagttt

SEQ ID NO: 150303 - DNA, 439 bp, Homo sapiens
gcagctggagccagcaaagatattggacagacaaaccgcctgccagccaagaagcagctggtgcttcccaggtccccctggccctccagcaggttctggtttcctaggcgatgccggagatgggtattccttctggctctcctccctgctctgccttgttcctcccagtttcatgttgctgcaggctggtcccaccctgagccctactccttggctttgtttcatctcccatgcataagcgaatcattcaggcactgtctggtgccccgatactgtctctttgtgggcccttggtttcctcaaactctcatgattacttcaaatatctcccttcctcctccatgctgattgagagcctgaccctgccctggccttaaggaattcatgatcaatggtaatttcactgtctgccctctttggaagagctgcaggaacccag

SEQ ID NO: 150304 - DNA, 382 bp, Homo sapiens
gaaatcccttttcacctgttgactggcctgtctcccccaactaacatgtcggctccgtgaacacacagctctgtctgccagagccgccactggacagctggtgtccagcacagggcaggcatacagtaggtgctcagtaagtactcgagaaagagcaaatggccccaggtccttcctatgccaggcgctccttggcagccccaccgcactttccccgtttgctgggcagcagcagtcgcagctgtcgtagctggtgagatacaatatctgttgcactaaatcatgacctccttggggaccgtggcctcccctttcttcattcatccaccacatatattaagaaccagtgccgtgccctgtcccatgtgctatccctggcctg

SEQ ID NO: 150305 - DNA, 244 bp, Homo sapiens
aagtctgcccaggaggtccccctcaacccaagcaactggagcaacttgaagacccccgcactgccgtacagccctttctgtgatgcctccagagccaccaggaatctctctcccatggccagtgggcggccagaaggagctgtgcccctgacctgtcagaggggccagatgccctcattcccagcctgtccctcaccccaggaaactggatccagagccccaggccctactcctcaacgagagg

SEQ ID NO: 150306 - DNA, 311 bp, Homo sapiens
tctgcctttggccatttaagcttcttcctttctgaatttcagcctctagtgctcaggaggaggtcagggatctggctcttaaagggtgttggagaaaggtctcctttccatattgcttctgaggacttcttagaccattggcagcacacgtcctcacatgaaggtgggcgtatgatctgggagactctgcttaagaaaccggatctctttattgatagagccatctcatgagcaagtaatgcaagctgttggtaattacagaaaacctactgtggaatttcatctaaaattaatgaagagtcagcactgtg

SEQ ID NO: 150307 - DNA, 317 bp, Homo sapiens
cgggatttgtttgcacatctacaaacacaaattatttgcattactctcacttttctacacattatcttctgtttacagagttggaaaatagctcagaaaccaaggtacaaaccccctagaatcagataacttggcatgtgctctaaacaatacagagttttaagagatatttagttttttgggtttcatttaaaaatatttcagtatccttacataactagcgttgaaaggtaaatattagctaagtttattacttaaatcctgcgttttgtaccataaatgacaatgtgcagaaagtacctgaattggcccaagtc

SEQ ID NO: 150308 - DNA, 398 bp, Homo sapiens
ttccttcagtgctcacaccgaccctatgagtggggcggtcaaactgtccccattttacacacagggaaacttagtgaatggcaaggctgggtttgagcccagctctattgcccccaaagataaggctccattccctgctccatttcccaggcatagggacttgtagggggctggaaccccaggatcaactctgggctcagagggccccagcaataagtgactgttgattactcctgatcccaaagctgacttcaggcaagctccttggaggtcgcagccccttcttgctatgcccagtggcaatgatgttcataatcccactcctcagtgcagggttccactaagaacccatgatctcctacctcaaatggacctcatgctttctgagtaagcctccc

SEQ ID NO: 150309 - DNA, 266 bp, Homo sapiens
ttagaaaagtgcctccaggaagaagagtcactccaaggggtgagactatcaaaaaaggaagtgtgtttttcctgaactgggctgatgagagcacactgattaattcaatagcttgcatatagagggaaaagattggggagttaagataacgtgccaatacagaatataccatcaagaatgaataggtgttagagcaaggactaagttgtttggagattattttgagatttcatgaattaccatgaatagaaggacattaacccagg

SEQ ID NO: 150310 - DNA, 449 bp, Homo sapiens
tcctgcagctgttgctggagcaccaggactgcattgcccctgatcaccaagaccccctgcatgagctcctggaggatcttggggagctgcccaccatccctgaccttattggtgagagcatcgctgcagatgggcacacggacctgagcaagctagaagtgtccctgacgctgaccaacaagtttgaaggactagaggcagatgctgatgactccaacacccgtagcctgcttctgagcaccaagcagctgttggccgatatcatacagttccatcctggggacaccctcaaggagatcctgtccctctcggcttccagagagcaagaagcagcccacaagcagctgatgagccgacgccaggcctgtacagcccagacaccggagccactgcgacgacaccgctcactgacagctcactccctcctgccactggcagagaagcagcgg

SEQ ID NO: 150311 - DNA, 387 bp, Homo sapiens
aaaagctctgtgggtgattctaatagccagtctgggaccttattgtgggccagattatgagaactactataacaggaagacatagacctgggctggctctaatggaaaggggccttctagagcgcctgggggttttgaactgtttgggtacagataactctttttagtctggattcttacagtgatcctgaaaatgtatattatgccttttctctttaggaaatctttgggaaggctttgttagagaacgtctttgtggatgaaaggggctctctttctccacatctcttagacccactccaatccactccaaaccaccagagaaagtcctcattgttcagtagaaatccagctgccacactggatcattcccatcagcacaacaca

SEQ ID NO: 150312 - DNA, 255 bp, Homo sapiens
acccactaatatagccagattttcaacctgctgttcaaaaaagttcactacattgtttggagaaatcctagccatgataaaccaatgcttggtcagaaatacttagttttaaatggagaaaggggggaaacagggcaaccctttatgtcctccaataaattacacagagtcattccataggttatatatattgaaaaaataagctttaaaatatcaaagataaatttactttaaaaattagtacaaatgtaccta

SEQ ID NO: 150313 - DNA, 838 bp, Homo sapiens
  misc_feature (37)..(38): n is a, c, g, or t
  misc_feature (58)..(58): n is a, c, g, or t
  misc_feature (99)..(99): n is a, c, g, or t
  misc_feature (122)..(122): n is a, c, g, or t
gaccaacaggcctgggtggggacagcagtggctgganngcatgcagagaagccgagcnacagcctaagagaagagcgaattaaagtgacagaagccctntgggaggcggaggagggctgacngctagagcccaggagtatgagaccagcctggacaacatagcaacctcacctctacaacatagcgacctcatctcaacaaacaataaaaaaagttagctggggccagccaccatgccaggccacaaagcatattttaaaggatgcaaatgaagagctatatagggcaaggtttggaagagacccaattgtaggagcttctgttcccatggagttgaagtgtgccaccctcccatcacctgaatacattcttgctctccagcccagaaactctcagaacctagtcgttttgggtgtttatggaagcatcattatgtatgcacaattgattaaatcattggtcattggtgatcagatcaaccttcagcccatctcctctcctgaggtcagggagtaggttcccctggtaccagcctccatcctgagaccatccaggagtccccccattcatctatctcccatcagtcattcattagcatacaaaaagacataacacattggagattccaagggttttaggagctatgtgccaggaaaccaaatatttacagttggcctttagaactgagaaagtccacttataggaggattttcttctgcctccaccacccctgagacagcaaggccaaccgctcctcttcctcctcctcctgatccatttccacttaatgagtagtaaatacatttttcttctttctgcttttcctctagcttacttt

SEQ ID NO: 150314 - DNA, 341 bp, Homo sapiens
accccacgtcaacttctcccacctgaccacaaaggactacatggagatgtacaatgtcatcatgaccgtgaaggaggaccagttctcagccctgggccttgacccctgccttctggaggacgagctggacaagtccgtgcagggcacaggcctggccttcatcgccttcactgaggccatgacgcacttccccgcctccccgttctggtccgtcatgttcttcttgatgcttatcaacctgggcctgggcagcatgatcgggaccatggcaggcatcaccacgcccatcatcgacaccttcaaggtgcccaaggagatgttcacaggtaactcctccctgc

SEQ ID NO: 150315 - DNA, 330 bp, Homo sapiens
ctgttcacaaagcgtttaaaagttggatttaatgtaactggactccttgggcttaaatgcatggagacctccccctactctgtgctccttccccttcctcattctttccaccccttgtcttagctcagtattagattcttctttgagaatttctccggctcccggtggagtatttttctgcagttattgtttttttttttgtaatgggaagtacagttcagccatgtacaggaaaggaacgtgtttactcaggtatctttcgtgaatcccattttatgccctgacagttgcaagtactgcaggtccattttcgttgagatttagacatat

SEQ ID NO: 150316 - DNA, 345 bp, Homo sapiens
gtcatctgagatcccagtcgacggagactctcccagtgtttgtcatccagaacactgggagagatcctaggagaactctgggtgatagtttccattttcagaagtctgggtgatagttcccttttcttcccatatcttactttgaatgaagcctccatggatgaggtagcccaggggaaacctccagctattatcttgtggggttaggtcgtatgaagctcttacaggagaactgggtctttagggtgttgtgtaggggggtaacttaggaaaattcagccataacaccttatacaggagattatgctgcatataaaccctcttggagagagtctccctcgaact

SEQ ID NO: 150317 - DNA, 412 bp, Homo sapiens
aaaaaaatgagaattaaggtaaatctttcagaaaatagtacaaaaacatgaagatatagaaaaatagaaaaaaatgagaaatttaccataccgggtcagaagattctagagacaaataataggggtcccagaaggagaaataaaaaaagcagagggatggccaggctcagtggcccacgcctggaatcccagcactttgggaagccgaggctggtgaatcacatgaggccaggagttcaagaccagcctggccaacatggtcaaatctcatctctattaaaaacacaaaaattagctggacctggtagtgcatgcctgtaatcccagctactcaggaggctgaggtgggcgtgattcttcactaaacctttagggtgcccaaccccctatggcccccacacttctaaccaag

SEQ ID NO: 150318 - DNA, 183 bp, Homo sapiens
aatctcattgactcttacatataggttgtttgatgacctccaaatcttcagcacatacaccagtatagtgctccaaccttatttctaaatgtcgacaggcacccatctccattcataaaaccaaaacagttttttcctactaatattcccctactgcgtttaacaaccaatcattctccatgc

SEQ ID NO: 150319 - DNA, 377 bp, Homo sapiens
ttgaggccctaaaatcttaataattactaacagaattccacaactgaccttctttctaccacccttctcttttacctaatagttaaaataattaacaattacttctaacagccaggcactgttctaagagctttatgtagagtaagtcatttatttctcagaactagcttatgctatgaaagaggttgtattattatgctcattttacaaatgagcaaagtaaggcacaaagaaattaagtaatctgcccaagaaacagtagagcagatatgaactcatgaagtctggctccagagtgtgaacccttatagacttctgttgagaacatttgtagtagtttcctaacacctcatgacaatacttaagtaggtaccatt

SEQ ID NO: 150320 - DNA, 763 bp, Homo sapiens
tagatacaagttcctcatcaggtatatgatttgcaactacagtatcttctcccattagtgggttgtcttttccctttcttaaaaagctttttgagacatggtcttgctctgtcgcccaggctagagtgcagtggtacagtcgtaactcactgcagcctcaaactcctgggcttaagcaatcctcccacctcaaccttccaagtaactaggactgcaggtttgcattaccacatctggctaattttttaatttttttgtagagcaagccccttgctatgttgtccaggctggtcatgaactcctgggctcaaatgatcctcctgcttcagcctcccaaagtcctgggattacaggtgcgagccaccgcacctggccagcataatgttttcaaggtttatccatgttgttgcatctatcgatacttcatttctctttattgtcaaatactattcattggatgaatataccacattttatttattcattagttggttgatacttgggtttccaccttttggctattatgagtaatgctgctgtgaacatttgtgtaccagtttttgcatctgttttcatttctcttgggtacataagtaggagtgcaattgctgggtgatgtggtaattctatgtttaaccatttaagtaactgccagactgcttcctacagcagctgcaattttcattccccacagcagtgtatgaggatgccaatttctccacattctcgccaacacttgttttttttattatagccattctaa

SEQ ID NO: 150321 - DNA, 518 bp, Homo sapiens
aaatccagtgtggaatggttctgtcatctacccagttactcatgctagaaactgacagccacccttgacacctcccacttcttccacatcctgtcaatcattaagtcttgtccactcaattttctaagatgtcttcaatctgtccacttctgtctgtttctgctaccatcaccctagctagtctcggccaccatcatctcttaaatggctatcgcaataacttccagactgctctccctgaggccattcgacaacccttctcattttttcatgctatcccctactcacccttcaggtcccatgcctctctcccactactaactaggttagagtcccttagtatgtgctcccatgctaccccatacttcttccctatagtctgtgctctagtaattaattacttgaagcaaaccatttatgtcttccactgctagagaaggttcatgaatgtaggggctgcatttttattcagtgctaaattcccaccacctagtagagtacctggcatagagtagatg

SEQ ID NO: 150322 - DNA, 561 bp, Homo sapiens
gacatatgcagaagagtgaaactagactcctatctctcaccacatacaaaaatcaaatcaacatggtcagatttcaggtcttcaatataagatctgaaacaatgaaagtagtagaagataacattggggaaatgcttcaggacattggtctgggaaaaatttcttgagtgcaacctcaaaagcacaggcaaccaaaggaaaaaatgaacaaatgagatcacatcaagctaaaaatctttagaacagcaaaggaaacaacaacgtgaagagacaacctatagaataggagaaaatataagccaactattcaattgacaaggggttaataaacagtctatagagtcaagtgaggtggctcactcctgtagttccagctactctggtggctgaggtgggaggatttcttgagcccaggagtccaaggcagcagtgagctatgatcatgccactgcattccggcctgggagacaatgaccttatctctaaataaataaataaatgtattttttaaaaaaacagaatatataaggaactcaaacaacttgataacagcaaaataaa

SEQ ID NO: 150323 - DNA, 457 bp, Homo sapiens
tttgtttgtcagtctggtttgcttgactagtcaatgcagttgtgaaagcattttagaaaaagttatttgtaggttttttcctagctatttctgacccttgcatggcagattaatttttttttatgccagacagagttaccttatattattgctcaagatttttacctgttcgacctatgagcctaacttttataaatttatttagtttatttctttcagaatagcaatccttcaattaactgtttcatcactctaagctattattagccaaatttacattttcaaaaggtttgactcttagatgtctaggttatttatttccacagagctattgtaatttgtaaagtcattaatttaaaagtcttttaagatttctttttttatgttggctggaatgtcaaaagcagagaatttgtcttaataccggtagaaaagtcagcagattcaaagtaggcag

SEQ ID NO: 150324 - DNA, 352 bp, Homo sapiens
tcagtatcgccttaccggtgttatcgatgcacctgccagtcgtgctggttcaagggcaggtggcaggtggacaatgtcaagggatagtgtgactggcgtattgtgctgtgggtggttctgaggatcgagggcttgaggagtcaggcttgctctgccgtccgggtgcatctgctacgtgctccctctcttccagaagcttctttaggaccactctaagtgccatgccctcatggccctagcttgccaatgccccccaaaacttgatgttacatcctgtccctacctgacttttggttccattggccatggcctgagtgacaaaggaatgctgtggaagtgtggcttctggcct

SEQ ID NO: 150325 - DNA, 255 bp, Homo sapiens
actcctcgattggaattattctggggtgtgtattttacactgttgcccgagctctcccctaaatttaagcttcagaaccactgtgggagcttaagagtgacatttcttgttggctcccttcctccctctcttatcacccccattccaccgcagaaccacccgcataaactacttgctctcaatcctcgcagcaagttctgcttctggttaagttggtgcgggtccaactgagacatctcaaatactaccccctcc

SEQ ID NO: 150326 - DNA, 212 bp, Homo sapiens
tcaaccaatcacagcacacagtcggcgctcaaccaatccctgcacacagtcggcgctcaacaaatcactgcacacagtcggcgctcaaccaatccctgcacacagtcagcgctcaacaaatcactgcacacagtcggcgctgaagctccgctgcccgcctattttacaccaacccctgttcggttgaggggagatgttcggttgagcggaga

SEQ ID NO: 150327 - DNA, 569 bp, Homo sapiens
ctacatactttaaacttcctcaacatgacaaaacttttaatgacttcacattctcaaatgaacatcaattattattctgtattcttttaaatacctaaatatgtaccacaacataatgtatatggaactgcctggcaattattcatagtttgttgatgctttatttttcctgtgtccatttacatcaactatcatttcagtactctaaatatgctatggattgcaaacacaccaacataaaacgcaggctagggccgggcacagtggctcacgactataatcccagcactttgggaggccgaggcagatggatcacgagatcaggagttcgagaccagcctgaccaacatggtgaaaccccatctctattaaaaatacaacaatttgtcgggtggggtggcacactcctgtaatcccagctactcaggaggctgaggcaggagaaaatcgcttgaacccaggaggcggatgttgtggtgagctgaaatcacaccactgctctccagcctgggcaacagagcaaaactccatctcaaaaaaaaaaaaaagaaaaaaaaacaactaatagc

SEQ ID NO: 150328 - DNA, 228 bp, Homo sapiens
accaatatatgtcaatctgacgatgttgtccaaaatatttttagctttgaatttttttcagccagtatcaaaagtgagactctaaaatacttactatatgtctatgtcaaatactaagtcctttatttttttctggaaatattcttaagtaaattctgattagaatcactcctaaaacaccattatcctgattctagatactcagggcagaataaacggtaaagtgaa

SEQ ID NO: 150329 - DNA, 625 bp, Homo sapiens
tttcttcccctgacaataactgcatttttttctctaaggtagctttccctccaaccgttgcttgttgttcttacccaagacccagtatctgccaaaacaaatgtatgtgagtgataaacgctgagaggaatgtctgttggaccacaggaaatttcctgttcaggaagagatcttgggaacttcctgtggaggagtgcattgtgggacttttggctgcagtcccttgaccacagctgcaattaactaaaggcagagggggaggggagaggaagaagaggagacagctacccacagacattcttatccatgtagcccgaggagagaatgggctcatacaggttcacaactttgcaagtgaactagatgtctagtgcagaacaagatcactgtgcccaacctcctttactgccatccatctttcacagccttcccggtgctttcctagggctcctaaaaacagtcactgtcacattatccatgtgcattccccagtccctcataagcacacatgaagtgtccatgccctctgtagccccaccaactgtttggaatctcttgattagcttctagaatccaggcattggagttggtggtctttctccatcccaacttaagtatgaaagag

SEQ ID NO: 150330 - DNA, 667 bp, Homo sapiens
gattcatttgtactaaaatgaggtaaaccagtgtttcttttaatactcccaaattttactcaacatatgggttaaacattgttaaagcttctaaactgatataggcaattgaagccaatccaagcaatacatattcgagtaatacatagtcactggccaaatcaattcgtgggttatgagaaaacaatgccatttggctgaaatattccctatgtacaggcagagaagagcaggtagccaagtgccactttggtgttctgccatgtcaacattcaaaacagggccatagaaaagcaaaacgctctgtccaccctctccttcccttaataagttcacctatgtaggaagaggacaagtgccctgacttctggctgtccacgtaagtgtcaaatgtaggggccctttcacactagggcttctacatgagtgtctccctttaaactctcatgtcttccctggaatttagatcaattatcatccattgagttatgtacaaatagcagacatactcatggtctccacctaagaggagatagaacatttcacttttcttgagagaaaagtcaactttatctatttttttgtttgtctgtttttctattttaagattacataaagtactagggtttggaggtaagagatctgagccaagtcatggttttgctgt

SEQ ID NO: 150331 - DNA, 254 bp, Homo sapiens
ttgataatcactagctcactgtcgcccagtgattaaggtaacagaagctgctaattcattctataagccttgcactttgaactcagccctctgtaagtaaggtatttgtgttaaatgcttttgttctatttaataaacttttatcctgcctctccggggtatggcagatgtaaaattacctgttgttctggaaaatggatgactcagacactaattaaagttactgttaatattagccacaggtggaaatgagg

SEQ ID NO: 150332 - DNA, 171 bp, Homo sapiens
gggacagttaactttctccactcatgaagttgtttaagcgtctccccggccataacaactttctgaagagagtcattttatttttagtccacattgcctctgccttttgcttctcaactttttgctcccagattgcgattcttctctcaaagacatgatatattttttcta

SEQ ID NO: 150333 - DNA, 483 bp, Homo sapiens
tagctgttctagaggtccccgacaggtggtgctcccgggtcagggatccaatcgaagccaggagctgtgacctaagccaaaaagatgcagcgatgccagatccttaacctactaccctaggccaggatcaaacctgggctgcacagagacaacaccagatccttaacctgctgtgccacagcagaaactctactaaggctatatctgaaatatgactgcactgtataatttaggcacaaacaagatattaatattaatagagtataggaaagcaaagttaggaggcccaaagttagggcagaaggtcagagaagcttcttaaggtaatgcctaacctaagttcttaaagtgagaagttagtcaagcaagggaaaggtaaaaacagaaggaagatgaagggattccagactgagaacactgcacgagaaaataccaatcacattatgagttgataaacaaggggttaagagcatatctcagcat

SEQ ID NO: 150334 - DNA, 331 bp, Homo sapiens
cggtgatctagaggatcccgtagtccttaggacgtacatgtcatgtgacttttcctcttggtgcagaactgccaaagatgctaagtattcccccatttaaagaaaactccccatgggtctgctaaagcaggaaaaagacatgtacttagtaagatgaggccaaactgtcactgcaactaccaactatcgtgacacttcctctgtagaatctgtgaagaaacagggttgtcctcaagtcctctgtcttctgggatgtactggttcattattaaaggctgttgtttttcctcgaagtcaagatgtgaaggtatggctgaccaactctaagggg

SEQ ID NO: 150335 - DNA, 716 bp, Homo sapiens
gaacatagtaagcaggtatatgaatagtttgctagtatctaggggagcttttgttttgttccccgttggttactaatacttaaggttcatctttttccaatgtctgggcttcagatgttcagaagtttaatcacattccacttgtggactgcttttcttcttgttcatctttcctggtaggatatcacttttttggtttcaagcccaaaggagggggtcatttactcaagcctcttgtcttgtcttgtcttgtcttgtcttttctcttctaatagagatagagtctcactgtgctacctagatagactgtgttacttgaactcctgggcttaagcagtccttccacctcgcctcccaaaatgctgggattacagacacagtgcccacccagccacaaagcccccagtgttgatggtccctggattcccacttttgtccctggggcctatagcctcagcttctaaatctgctacttctctgctagatcagcaaatgaccccagagcaaaagtggcctagaatgcaaagcttcctccttatggaatttcatcctcttcttcatcttgatcaccttatcttgttctatgattcttttaaggagaggttttcccttccttccagcttttttagttttgtgggtgtcaagtaggagagagataattagtttgaattatatactcatctattacccaaaataaagtcctttaaaaaaaaaaa

SEQ ID NO: 150336 - DNA, 291 bp, Homo sapiens
gagaagagtatacgcttttcttttgtaaattctaatatttagcactttttgttgttttgtcagtcatattgttaaaaaggtaaaggcagagtacaaagttggtactggagaaactagtttggggaaacaaccgatgttctgtcaggacgatcctgaaattcatattaattactttttaaaataattgtgccttgagttatgaagaaagctataatcctgagccatgtaatcccacacggcttccatgcagccaggagacatggagtgctgggcactgggcatggctttagg

SEQ ID NO: 150337 - DNA, 362 bp, Homo sapiens
gggctggaggaagtggggaaccaaggaggaagtgtggtttgtgagaaaatgattagcaagaaccagagtctgcttgggtctgggtcccccaggacacccagtgggcagaagcttgggcatttggctggccgggctgtggacaaggactatcagcctcatgttccctctaggaccagaacagtgtcctggtccccagccctctcctgatcccgctgcccgcaccgggcgaatgtctgttcataggtgtgctgccatccactcctccgttgcctgcggtggctgcaggcctgatgcagcaagcagggacctgagagcccaggggacacagcctcaggttcagtagccaccccagaggtccccag

SEQ ID NO: 150338 - DNA, 489 bp, Homo sapiens
atgtgtcatctgaaatcatattttttattctttttttgtttttcgagacagggtctcactctgtcacccaggctggagtgcagtggtgcaatcacggcaccctgcagcttgaccatgtaggctcaggtcatcttccacctcagcctccagagtagcggggaccacaggtacgtgacacctcacctggccaatttttatattttgtagagatggggtttcaccatgttgccccagctggtcttgaactcctgggctcaatctatctactcaccttgacctcccaaagtacagagactacacgtgtgagccactgtgcatagccttgaaattgtatcaacaagctttttatactctgttacattaaaatccattgatttgtcctgcaatttgaatggaacttttactcatgcatgatttttataacatcatgcactgaccatctggaaaatactggttccagagaattacgtatatcatccaatttttatc

SEQ ID NO: 150339 - DNA, 564 bp, Homo sapiens
  misc_feature (86)..(86): n is a, c, g, or t
tcgcagagtctcagcttccagtgagattacaggcatgcaccaccacactccagctcatttctgtgtttttagcagagacggggttntggcatgttgggccaggctagtctcaaactcctgacctcagggaatctgcccgccttggccttccaaagtgctgagattacaggcatgagcttaatttttatatttttagtagggatagagtttcaccatgtttcccaggctggtctctaactcctgggctcaaagcaatccacccacctcggcctcccaagaagtgctgggattacagatgtgagccactgcgcctggcctgttaccaagttactatctataaaggtgtatcatttaaccctctcccactgttaagtgtgtatgtgcctgtctgatcaaactctgaaagaatttaatattaccagtttaaaaatctttgctattttgttgagtgatagataaactttgaggtatctgtcaaaaggagtagggaaggtatgtcatatacagagcagcatgagcgaaggtggcatgctggcagtgtgtgagcggcactgtctgccagag

SEQ ID NO: 150340 - DNA, 181 bp, Homo sapiens
ccttcctccctggcctgctcccttccactcaggggtcaagggtccctgtgacctattctcataggagcctctgctttcagggtctcagcagttatcacattctgttgtcgctgagtttttagaaattcggctgtctcccctcgcagtctcaggccccgcctgcctgccactgggctgtggg

SEQ ID NO: 150341 - DNA, 563 bp, Homo sapiens
cgcgtcatgacactggtggcaggactgctttgcggctgctgccctgctttcctctgtgagccgagtgtcctgtcttgtctccagccctggcccagggctgcctcggaccctgcccagcgccacagggtgggttttggccccctgtgctcccccgttccatccctccctccgcgctgagaggcacttccagctctgccagggactttgactcggtgctgtgccgagtgtcccaggacacccgaagcttctcctgaatctctgggcagcacagacggtggcagtgctctgatcagttggtgtgaagtgttctctcctgtgagacttcattagcattcctgtcctgtcgcttgctgggtgttatggtaaatacctcgggagtgtaaacgggaaactcacccatggtgagcagcggctgggcgccatcgggtcaccgagggcaggttccacacgggagctttccgctccctccagggcggtattgcacttgcctggcagtgcgcgctgggggctctggtggcccctctcgggcctgtgggctggctcacttggcctgactgtcactg

SEQ ID NO: 150342 - DNA, 772 bp, Homo sapiens
gtcttagtgcctgtggggtcccccaagaacccaaatggtggttgtcgtttagcccacatgtgccagggtcggggggatgggggagcccgggcttccccatgtttcaagtccgtgcttggtgggcacggggggctgaagaccacaagaatggtccctgagtctctgtggtgccatgcgggtgccccgtgcgtggtggcagggtgtgagttctgagaaagcagcagcctggtggagaggtgggaggtgggcggcagagtaatggcctgtaacagcaggcagcacccgcctgcttcctggctgctggctgctccgtgcagagttggttggccagggaggccggaattgtggccctgtgctcccccgttccatccctccctccgcgctgagaggcacttccagctctgccagggactttgactcggtgctgtgccgagtgtcccaggacacccgaagcttctcctgaatctctgggcagcacagacggtggcagtgctctgatcagttggtgtgaagtgttctctcctgtgagacttcattagcattcctgtcctgtcgcttgctgggtgttatggtaaatacctcgggagtgtaaacgggaaactcacccatggtgagcagcggctgggcgccatcgggtcaccgagggcaggttccacacgggagctttccgctccctccagggcggtattgcacttgcctggcagtgcgcgctgggggctctggtggcccctctcgggcctgtgggctggctcacttggcctgactgtcactg

SEQ ID NO: 150343 - DNA, 744 bp, Homo sapiens
  misc_feature (548)..(548): n is a, c, g, or t
aaggttcaatgcaaaaagaacagagtctggcctaagaggaatgtacaacctcagaaggagggcaaaggggccagcagtgtctttcctgctttcctcaaggggtcttgggaggtggatcccattcagcttgccagaactctcaaaagacaaaattacaacaaatttagtttaaagatcttatttagcttttatttattatttcagaatcaactttgaaacccagtctggataaaaaaattggcttaaacaaatgcatagctcaaaacacaaattcttggagcttcaaaatttgagagagaacttgcccaggacccctgctgctgtgagagatctgtgtgcacaatgggcctggtgggtcgctgtgcttggccactccatgcttctggggtttgatggaagttctacttcagattgcatttcctacacgaatcttgcatcccaggcataaaccctgcttgattatggtggattagctttttgatgtgctggtagattcagtttgctagtattttgttgaggatttttgcatctgtgttcatcaaggatantggcctgtagttttttctttgctgtgtctctgccaggctttggtatcagaatgatgcttgcctcatagaatgagttagtgaggagtctctggtcctcaattgtttggaatagtttcaagcagggatggtagcagctcttctttatacgtctggtagaatttggctgtgaattcatctgatcctgggctttttcttg

SEQ ID NO: 150344 - DNA, 563 bp, Homo sapiens
  misc_feature (511)..(511): n is a, c, g, or t
  misc_feature (523)..(524): n is a, c, g, or t
  misc_feature (544)..(544): n is a, c, g, or t
  misc_feature (553)..(553): n is a, c, g, or t
aaggttcaatgcaaaaagaacagagtctggcctaagaggaatgtacaacctcagaaggagggcaaaggggccagcagtgtctttcctgctttcctcaaggggtcttgggaggtggatcccattcagcttgccagaactctcaaaagacaaaattacaacaaatttagtttaaagatcttatttagcttttatttattatttcagaatcaactttgaaacccagtctggataaaaaaattggcttaaacaaatgcatagctcaaaacacaaattcttggagcttcaaaatttgagagagaacttgcccaggacccctgctgctgtgagagatctgtgtgcacaatgggcctggtgggtcgctgtgcttggccactccatgcttctggggtttgatggaagttctacttcagattgcatttcctacacgaatctgaatttaccaaacagttgatgttggagaagcatgtccagctgacgcaagctcaaggaacctgactcgaaaaagaaaagncgggccaggggnnggggagaggaggaggggggngggagggangggggggggg

SEQ ID NO: 150345 - DNA, 188 bp, Homo sapiens
tcccctgagtgtgcaggcctgcatttttgctcagttcagctagcgcagtggcctgctcataaagttttccaaaacctgtaggctgtatgaagaatagcggttactcctaagctgcttttaactttcaccttgtgattctcatcatatttttgttgatttccctcctttgagttcttttatgtatttcc

SEQ ID NO: 150346 - DNA, 194 bp, Homo sapiens
tacacccacgtccctaacagcattattcacaacagccaaaacatgagagcaacctgtgtccatcaacccgtgtccatcacatggatatataaaatgtggcatatctacatggcggaatattattcagccttaaaaagcaaagaaatcatgtcaatgctacaatgttgttgtaatcctacaacattagacgaacc

SEQ ID NO: 150347 - DNA, 295 bp, Homo sapiens
ggccagagtggaagtcaccaatacctatggcatgaattgcactagggagaatggtagtatgcgaagagctagcagtcttcaggacatgaaggcggggtcaaagataaaggggttcatcttgtgtttcaggagcagtgagttgcagagtcttcctctggaagttttaaaatttgaaaaaatcattaagaagaagagttcagcttaattaaaaaaatcagaaaaactgattaactctttacagaacattaaatatgataatgccaaaataattctaatgattgaaatgctttgagtc

SEQ ID NO: 150348 - DNA, 318 bp, Homo sapiens
tatggagtgtttgtataggctcatgtatttttttaattcatcaattttgtaagctcataattcttttgaggactactatcctaagttaagtggacatactttccttacagctccttcttcctcttgttcatgggcacctttcatttctttccttaaatactaatagtctcacagatactagattatatttcagtgcattaccagtcctcttaatctagctgggtaggctgagctgtggtcatggttatttgcagcttggaaactctacttgcatgctttctatttttgtgcagtttgagaagtcccttttcctcatgg

SEQ ID NO: 150349 - DNA, 459 bp, Homo sapiens
aaatgagacgattttctcattaaataactcgagttaaagaaggatgcaaaagagaagttgcaggatatctagaaagtaacatacagtggaatgcaactaaaacggtgctcaaaggacattcacaagctcaaaggacattcacaaccttaaacacctaggtaactattatatgatcaatgtatttagtctttaagtcaagaaactagcaaaaagacaaattacccaatgaaagaaatacatagcaaagataaaagcacaaattattctattagaaaatatggaataatagaattgatagataaatgcaattgcaagttcttaaaaaccagtaaagcccaaatacacaaagttagaaattttaaaaaagaaaattactacatataagaaagtttactttgcaaaactagatacaaatgaatttgaagatataacttaatagataattttctaggaaaatgt

SEQ ID NO: 150350 - DNA, 191 bp, Homo sapiens
ctggccactgtgaacgtgtgtgggggtgggaggctcacgtgatgtgtgtgtgtcatggattccatggggctgagggccagaacgtgttaggacgtgtggagcaggggtgagacggggcttcccacctggggaaaggacaggggtggcaccaaagaaccgaagcagaggcaaccctgtggccaacctctgct

SEQ ID NO: 150351 - DNA, 604 bp, Homo sapiens
gtcatgtcggtacctgcttacttacccagtgtgtgttgtcccctccattttccatgcgatctccttgtgcagcatgatttatagtcctttgggtatgtacccagtaatgggatggctgggtcaaatggtatttctggttctagatccccaaggaatcgccaccctgacttccccaatggttgaactagtttacagtcccaccaacagtgtaaaagtgttcctatttctccacatcctctccagcacctgttgtttcctgactttttagtgattgccattctaaatggtgtgagatggtatctcattgtggttttgatttgcatttctctgatggccagtgatggtgagcattttttcatgtgttttttcgctgcataaatgtcttcttttgagaagcgtctgttcatgttccaaggtacttttaaggaacatctcaaaatgaacgctgggaccatctttcagtgtgtgtgtgtgtgtgtgtgtgtgtgtgtgtggtgtagaagcacaaatctgcttaaaacatcacactcatcctggtaaaatcattttgaagcctttgttatttttttttttttacagagcaaggtagaagtcaaagaggact

SEQ ID NO: 150352 - DNA, 291 bp, Homo sapiens
ataatcagatcccttcaaactagtaataaagcgcaaaatcagaaaagcagtcagagaaaaaaagatacattatgtacagaaaattaaagaaaaaaacaacagcagatttcctgtcagaaataatgcaaaccagaagatactggagcagtatctttaaagaacagaaagaaaaacctatcaacttataattttatacccagagaaaatttctttcaagaactgggataaaatacagacttttaagttatatcaacctgaaagaatttataagtagcgtgtgcactctcaatg

SEQ ID NO: 150353 - DNA, 397 bp, Homo sapiens
cttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagt

SEQ ID NO: 150354 - DNA, 364 bp, Homo sapiens
caagctaacaaaataaaatgtaattacttcactgaaaagttcaagaaagaatggcggttggcctagttaaccccaggagctcatggctcaaattatattgtcagctttctctctctctctttctacttgtgtttcttcctctctcggtctttcttctgtgttggcgtcattctcaagcaagacttctgacaggaggcctcagaaagccccagctcccattactcctacagctatgaaatgaagtgaaaaaaaaaaaaaaaaagaaggttctctctcttaaaaatgctaaccaaattcctggcatggagtcccattacaccagcttgaggaacctgctcatccctgcaccaagcacaatgtccag

SEQ ID NO: 150355 - DNA, 693 bp, Homo sapiens
gattatcagatccagcatcctgggcctgagatgtaagcacttttcagagaggaaaaaagtgttggctgtcctctttcctcactcctctctcatcaacaatataaaggtatcagtgaagaaaacgtttttaacactagtgtccgtgtatactgacttctggttgggaaggtgcctgtgattcccacctcctctgccagatctgccgaaaaaagctaagaactggatgctgaaatggatgaacttgagcaaagcctcatactgtttctgggtggttatgatctctaggccacttactggttttgaaattactgcctcttcctactctgtccttcctatcacagacagcaggtttattgcatagactaggcggtgccctttacattgtcttcctctttcaggtaaatgaagaggttgctttccagttttaaggtgcccttttacaaataattattagatgaatcgaaactcttaggagtaataattaaagaaatggaatttgaaaaagttattcagctttgtttgtactttaggttcctggcttttatagtaatgctttatatttgctgttgttcctgtaatcagaggccccaactcttggataaatgggcagtgtccttatttcgaggatatgggaactgaggaactgagcactcaggtgccttttatcagagctactcagtgattggggaaatt

SEQ ID NO: 150356 - DNA, 432 bp, Homo sapiens
  misc_feature (361)..(361): n is a, c, g, or t
  misc_feature (385)..(385): n is a, c, g, or t
  misc_feature (401)..(401): n is a, c, g, or t
  misc_feature (404)..(404): n is a, c, g, or t
  misc_feature (412)..(412): n is a, c, g, or t
  misc_feature (414)..(414): n is a, c, g, or t
  misc_feature (416)..(416): n is a, c, g, or t
  misc_feature (422)..(422): n is a, c, g, or t
acttcaggatctcaggtgctactccacaaacagaaagataagcataagcaaaggtgaagaggtggaaaaagtttttcgagaaacagtcggtagtctagtttgatgagagtgaaaggtacatcgtaggatgttctgggagataaagccagaaaggtaggctggcatcagattcataaaaggccttcagcaaaagaatagagagtctgagaatggcgtgaaccccggggggcagagcctgcagtaagccgagatcgcgccactgcaacctccgcctcccaggttcaagcaattctcctgcatcagcctccggagtagctgggactacaggcatatgccatcacgccccactaatttttatatncccagtagatacagggctcaccgncgtcggccaggctggnctngaacctgncngnggaggnagcaccgggt

SEQ ID NO: 150357 - DNA, 465 bp, Homo sapiens
cttttttcttttctaaaacaggcatttctacaagttccctccaagtactgcctcagcagcatcctacagattctatgacattgtgttttcattttcatttggtccaaaatattttgtaatttcatttttgattgcttatttgccccatagattatttagaagtgtgctattaatttctgaatatttagagattttccagaaatctttttgttattgaatttaattccactgtagttagaaaacaaaacatgtataacttgtatccctttaactttagtaagacttgtcttatggcccagaatatggtctgtgctatagtctaaatatttatgtcctcctcaaattgttacagtgaaattcttaccctagggtgatgatattacaagataaggcctttgggagatgattaggtcatgatggcagagcccttatgaatgggattaatgcccttataaaagagatccc

SEQ ID NO: 150358 - DNA, 458 bp, Homo sapiens
agccccagtttacaacagctcaaggtggttcatacaaagcattgaagcttaaagttgctgtgagttcagcaagcaggagggttgagaagacaggcagatggtttaaaactaaaggtcaataagtgggcaagactagttaaatgaggcagatactccccaaagatggaattccagaaaggtgcttgaaaaggactgaattcttaaagcctactgctgttagtatgtagagttcttgaggaaacaagcagtttggcataacttaatctactaagaaactataagaaggtgaaggaagttggaacatcttactggaaaaagaatgagggagtgaagagggaatcttgtgaattcaaaacttgcagaaaagctattctgtttcctttttgtttaggttctcatgcactagcagctgctagaatagatattggaaggcagggccaaaataggtcagttgttca

SEQ ID NO: 150359 - DNA, 552 bp, Homo sapiens
agccccagtttacaacagctcaaggtggttcatacaaagcattgaagcttaaagttgctgtgagttcagcaagcaggagggttgagaagacaggcagatggtttaaaactaaaggtcaataagtgggcaagactagttaaatgaggcagatactccccaaagatggaattccagaaaggtgcttgaaaaggactgaattcttaaagcctactgctgttagtatgtagagttcttgaggaaacaagcagtttggcataacttaatctactaagaaactataagaaggtgaaggaagttggaacatcttactggaaaaagaatgagggagtgaagagggaatctccagtcatgcacgtatgtcacagcgacagctaattggcaatgctttcaggctagcagtctcgactcatagaggatctcctagaatagataacggtagatgggaccataagagatgagtatttcagttaggcaagacataggcgactataatggcatatgactggcatcgtctcttcgcacacatcacgagtagcacagtatgcatatgct

SEQ ID NO: 150360 - DNA, 279 bp, Homo sapiens
catatgtggacattgttgtcaaactaaaaacacagtgatttttgtatcttgtttagttttaaaatgttcccagcttagggtttgtaaaaacattttaaaattgtgaaatatagcctatatacagaaaagtgcataaaacgggtatgcacaatttagcaagtaattataaaggtgtcactcatgtaaccaccaccctgggtaagaattggtaggtactgccttaaagtagtgtagctacgtaacacagcgcttctccacagggggcaattttggctgtca

SEQ ID NO: 150361 - DNA, 129 bp, Homo sapiens
catgctagatgcttttgcataaattaccttacttcatctaaaatatgaccctgggagatcattattgcaggtgaggaacttggagctctgagaaattaaggttggcaaatgatagaatcagaataccag

SEQ ID NO: 150362 - DNA, 551 bp, Homo sapiens
gtcctgcaactgtaattcaggcttaacaatatttggctgaggttgtgagagtctatacagccattccccaggatgcatctggtttctgccagagtggcaaattaaatacagttatgctaggggcatcctctggctctctaagagcatcactaatctctgccaccccacctaggatatggtactggctttcattgatgtttttagctgatgcaggcagtttctgaggtttgcacttctccctctccactgtactatatcttactatagaggtcagggactcaatgtgggggttactccaattgtcaatccaaattatacattcagaggaaataaccactgggtgggtctgttgacccagtggaataaaaaagtgcatttttctaggactccacttattatctgacacccactaaccttcatttgaggaggggagccatgacggcagttcagctctacaggtatcagtgtcaattcagactgtgtgtgcaatagtccttgaatgcctacccagacatttcctttcctccagtgcactgtagctacagtaaatg

SEQ ID NO: 150363 - DNA, 215 bp, Homo sapiens
ttaggctttcccatgggggttttggattgggtagttacaagaaaacacgtgcgcaggggaaatttattgacacgaccctgatagaagcacagcccctcaggcttgctcactctcactctctccccacctcttggttgagctctgctgtcactgcctccagacctctcatgaaggccccgccaccaccctccctggaatctgtaagtaagatattt

SEQ ID NO: 150364 - DNA, 472 bp, Homo sapiens
atggagctaaatgatccaccaacttctagattcagctccagagttaagaccagctgggccatgcaatatcgttctaagggctttcaggggaggatgcagcccctttcagtgtgggcagcccctgtatggtgctgcattctccctaggatctggtggggatgggctgccaggatcagcaaagaagagaccccatctcagagtagatgggcacctgcctctgtgatttggccataggtcagcccaatggccccttggctgaggatctactgtgagccacccctgtgcaaaccagacaagtttcccaccgttgggggctctcggtccaagagaggtagccaattggactacaaactctaggtggtcaagacttggtcttgtttactgcttccttttcggtccaggaactctgactgaaacctagcaggcattcaatacccatctgttagatgaatgggtgggtcggtgggccaat

SEQ ID NO: 150365 - DNA, 281 bp, Homo sapiens
ctcgcgctactgcccagctttccttccaggaacgggggcacacatcatggtctaacctacttaagaataacagacgataggcaccgtctgttaatttcagctgcttcttataagaaataagagtctgatacacggtgatgtcaggcctcgagatcataaaaagatttcccacagggtctcctaaaataggagagacaaccggaagtcattttggttgaggtaatcgagtacagaacactcctccagctgcaggggataaataacactttcccaatatagat

SEQ ID NO: 150366 - DNA, 528 bp, Homo sapiens
atggggctctgccttgtgccctcagaatgtcagtgtgtgccagccccagtgagtcatttaacacgatgacactatttacagactcattggcactattggtgacaggacccttcagcactgatgcttagatcagcaaggactaggcagtgataggaagggccagccttgggcttaaggaaaacaagatacctcttcctacaccctgtggaaaagattcctgaaggaccactggtgtggctgcttgttgagctccagagccataagaggggtaattaggtgattagcagtcattgacacttttcttggagcgagttttcagtctttctttagaagagattggggagaaaagggggattcgatgcaggagaatgtgtggatcaaagcccaacctaaccagtttcctattgcgcctgggcccagcacaagagcaggtggaatgctgggagcctgccctatcccagcagcaccagctctgccatgttctcccagtgcaaggcagcacagagcagcaactgacagcctcagctt

SEQ ID NO: 150367 - DNA, 378 bp, Homo sapiens
gcctaggaataatagactgtatcacttaggtttgtctgagtacactccatgatgttcacacaaagacaaaattgcctaataatgcatttctcaggatgtatgcacgttgttaagcgacacatgactgtacaatggcctaaactaaaacttgttttatttgaaattcgtatactatccatgaatccagtagtaatcataaaagaagagacagaaaataagacgtataataaaagtcagcttttttttttactagaaataacaggtgtcctatgaaaagcagttattctcttcagattgcttccttgaggagaatctggtttccttcttttgatgaaaaaatatgagacaagtataatcatgatctgtgagaatacaaat

SEQ ID NO: 150368 - DNA, 231 bp, Homo sapiens
ggaaagcgacatagaggagggaaaaggcatgtgacgtagtaatcatctgccttcattcaacacagtggtccagaccctcagcctcttggaggctctagatttagaataatctatatcatctgaaggaaagatacatttcacttgaaacagaagcttttctataccaacagcctctccttcaagcccttctatggaaagcgctcatttcacatccggcctctattcagtttt

SEQ ID NO: 150369 - DNA, 329 bp, Homo sapiens
gtaattttcatcacatcatgtcaagggtatatgctgctgttaacattatcattcatttaagattctattttaatgtgtggacaataattatttataactggtaatttaatgtaccatattaaagtaaacttctttgctatatgtatgcattgtatagaacagatgactttctttgaataagtcataatgctaaaatatatttaccttactttcttggtttaaaaaacacccctttatcactgttaaaaggtaagtgaaaaatccattactacttaaaaattaatagtattcctatctttatggagtcaagttctacatattaaatttaa

SEQ ID NO: 150370 - DNA, 460 bp, Homo sapiens
ctcccaaagtgctgggattacaggcatgagccacgacacccggcccaaaactgcaatttatagtgcactgagcagcaaagaaaagtgacgagagcaccacttacgatctctgttccaacaactcgactctgctgttggaacccaaaagcagacacaggcaccatgtaacagatgaaccaggctacatttcaataaaactccatgtctgcacactgaaattagaattttagataactttaatgtgtcacaaaatagcctccattcgattttttttcattgtggttcacgcctgtaatcctggccctttgggaggccaaggcaagaagatgacttaaacccaggagttggagacgcagcctgggcaacatcaggagaccctatctctacaaaaaaaattttaaattagctgagtgtggtggtgcgcacctgtagtccctaccctttgggaggctgaggcagg

SEQ ID NO: 150371 - DNA, 423 bp, Homo sapiens
tctctctctgtctcacacacttgcaggctataagggcttttctttctccgaatctccaaacttattcccacctggggattttgcactcactgctccttctgccaggaatgctcttcctctacatcatcccatttgtttcagctcaaagttccccttcagagaaggtgcccctgaccaccttcctaaggaagactcctcctctaagcgtccctccatcgtatcatcctctttcctttgttgcacagcattgctcacagtctgtggttattttgcccttttctgtgttttattgggatttgtctgcctctccctgctggaatgaatgctttacaagaccctgctcttcactcaccctacatcgcccaggaccacaacagaaaccagcatgcactactggttttctagataattattgactaatta

SEQ ID NO: 150372 - DNA, 428 bp, Homo sapiens
gttttagggtatatgtgcacaacgtgcaggtttgttacatatgtatacatgtgccatgttggtgtgctgcacccaataactcgtcatttagcattaggtatatctcctaatgccatccctcccccctccccccaccccacattagttgaagtaagttacaagtttatccgggttcccaaggaagagacctacctccccactccaccttgaacagaggaatgtaaaagagttttacagccatttagaaaaccccgcatccccagtttttagaaactgagccctagaattccaacacaaggaaatctcaccttatttcattgccctttgagcatcattttcattaatacctagcatttctttttgtgagggaagaaccaggtccccagcctcccaatacacctagaatgtgctggcaacattgtggcaag

SEQ ID NO: 150373 - DNA, 487 bp, Homo sapiens
taccatgatcagattcattctgatttttgtccttaaatagctttctattagcatgtgtttcattatcctggaattaggaaattcaatttaaaattgctgtgtttttcaattatcccttttatgccctgtcaatgtgaaagcttgtgttctacttcagctctgtaaacttttcttttatgactgttttgattgtttcattctgtctgttgtctctttgctgtctgtttatggaactccttttggatactatgttggaatttctacacctatctatctgataatttccaactttttcttcttctgtactatggtttgggataatttcttcaccttagtgagtgtttgaatgaagtgcttttgaaaactgactagaggaacagatatcattgattgtttccggacagtaggttaaatatatttttgctgccctgaggaagctgtccattgttcctgccctggagaattatactagctgggatttttcaaa

SEQ ID NO: 150374 - DNA, 472 bp, Homo sapiens
aatacactttagcccgacatacacacagtgtggtacctagagcagcaatattagaatcaccagggagcttgttagaaataaatctcaggatccacttcagactgactcaacaagaatgtgcattttaaaaggacccccaaataattcctatgcatattaaagactgagaaacagtgatctagaccattttaaaagacacggttctctacttagccccaaacagaaccatcagcacttccaaaccccatgccagttttcctctaacaaattgcaggcctggtttcccaagccaatatcctaaatagggagcaagcagacttcagacatggtaagtctacagcccatcatagttattgtgcactctctaataccaggtctcctgatgtcctattctagccctttctacaggataagaaatagcatcagcaggactatccaacaagacatattagatttggccttcttccctgac

SEQ ID NO: 150375 - DNA, 406 bp, Homo sapiens
tttccatcatcacccggcaccagcaaggcttttctagaagatactggcaggctgtggagaagggagtcagacacggggcttcttccagccggtccctctgtctcccttccagggacccaaacatctcccagcacaagcatcccagggagctgccgtgtgggagcgtgggaaacggctcactctctcgagccgccagaagttggcagtaagcagttggaagtgatcacagggaggccacatccagacaatttagttttaaaaagctgctttccagtgaaatttaaatcagtccattaattttgaaaacactctcagtgtcttttattatttggaatctaggcatgggaatatttctattttcacaaggaatgttttaagagtcaggttttaggacaaatgtcatgca

SEQ ID NO: 150376 - DNA, 911 bp, Homo sapiens
cgccgtaactgcacaatacacgaatcaaaacgacaaacgccaagctcagtatttcttcagaaatttgaagtggcccattgatgtctccaactattattgcagaactacgtattctctccctaaattttgccaatatttgcttcgtatattttggggggccctgttgtttagtgtgtgcatatttataattgttatatcttcttgataaattgatccttttattagtgtttaatgcccttgttccaattgtaacagtggttaaattaaagtcaattcatgtcatactagtagagccacaccacctctcttttggttaccatttgtatggaatatatttttctgtttttcactttcaatttatttgtggcttgcaactaaattgagtctcttataaaaaaaatgtagttgtgtgatttttaaaatccattacactgacttttgcctctcaattggaaagtttacttcatttacttttatagaaattattgatgagaattactactgccattttgctttttgttttctatatggcttacaattttttgttcatttcttcccttaatagtttttttgtgattagttgatttttatagtaaaatgttttaaaaacctctgtcattttcttatgtgtgcattttaaaaatattgtctctaactgccataaggattctgtttaatatcttaaatttataatcctctatgttttaattaatgccaacataatttcaatagcatgaaacactccatatctgtgcagtccccttacccatttcatgttgtttcacaaattacattcatatacattctgtgctgaataacataaatttataattatttttataaattttttcaacatgtatagaaaataaaaatggagttataaactaaaaataaaataatgctaagtttta

SEQ ID NO: 150377 - DNA, 235 bp, Homo sapiens
gggaagacaccaaatctgtatgatctctcctttttccttaaccccacttctcaggtcctcctctcagccctgttccttcctgtccccaaagctctgccttatcctcttcccctctaacccagtgctgtccaatggagatagaatgtgagccatgtaagtaatcttaaattgtgtaacacacatattaaaaagagaaacaggtgaaattaatcttaatatatttaattcaacccag

SEQ ID NO: 150378 - DNA, 382 bp, Homo sapiens
atgcagtcttccaaaatgtgcatggggctgtaattccatctagtgtttacaatgacactataagccttggatggaattacaatcttaatgggaacaatcagagtgcactactccatatgctcagagaattcaggatgaactcaacttctaaaataaaaagcaccaagccattggcatgtaattacaaccaggaggccaagctgtctgcttgctagtatatgagaaatgctcaattgaaagtaccatctcaccttattgtagcaaaacctatttaatgtatctgaaaaacctcttcctctccaaaattaaactttcgactttcgtgatgagaaaatttccacaagggtctaccacatagaggtgatatatatcgggtgatgac

SEQ ID NO: 150379 - DNA, 249 bp, Homo sapiens
ttccgggacttgagctggaagaaaaaaatacggactccttagaggccaaataggaaaaagaataagcaggtaacccaagcataggagcgttcaagctagccttggctctaacggtgtctacaaaccttggtgaacttgagcaggcgacagtctagagcctcagaacgttggcagctatggaggacacatggctcagactgccctttaggaatgaaggtcttattccagctgctgagacagccccaagcc

SEQ ID NO: 150380 - DNA, 563 bp, Homo sapiens
atcaacactctaacatcgaaattaaaagaactagagaagcaataacaaacaaattcaaaagctagcagaagacaagaaataactaagatcagagcagaactgaaggaggcagagacacgaaaaacccttcaaaaaatcaatgaatgcaggagctgtttttttgaaaagatcagcaaaatagaccgctagccagactaatgaagaaaagagagaagaatcaaatagatgcaataaaaaaaaatgacataggggatatcaaatgattagcaacttaactatgaatatgaaagacaaaattataaacagctagatagcaatctcattttaacatggaaagttttgtgaggtttggtaaattgcttgaggtcagaagctcttaaagagttaagttgggattcagactcatatctgctgactccaaaccgtatttgccttccattatgtcacaatgttccctattttatttaggtttagttgttgtgcaactgctgattattgaagtagagggtggaggacatatgtatttcatataaggaatttactttcatttaaggaatttattt

SEQ ID NO: 150381 - DNA, 580 bp, Homo sapiens
  misc_feature (70)..(70): n is a, c, g, or t
atcacttgagctcaggagttcaagaccagcctagcccacatggtgaaaccctgtctttactggaaatacnaacattagctgggcgtgatggaaggtgcacgcctgtaatcccagccactctggaggcagagacacgaaaaacccttcaaaaaatcaatgaatgcaggagctgtttttttgaaaagatcagcaaaatagaccgctagccagactaatgaagaaaagagagaagaatcaaatagatgcaataaaaaaaaatgacataggggatatcaaatgattagcaacttaactatgaatatgaaagacaaaattataaacagctagatagcaatctcattttaacatggaaagttttgtgaggtttggtaaattgcttgaggtcagaagctcttaaagagttaagttgggattcagactcatatctgctgactccaaaccgtatttgccttccattatgtcacaatgttccctattttatttaggtttagttgttgtgcaactgctgattattgaagtagagggtggaggacatatgtatttcatataaggaatttactttcatttaaggaatttattt

SEQ ID NO: 150382 - DNA, 346 bp, Homo sapiens
caacaagcaaaactcaatctgtttcactagagcctggagtcagttacttcctgggcttggtttgtgaagaggggcttcctgcctgctggttggctgaatcctggatgaatgcccagtgggattaacatgattcatccatttgttttgctcaactcaaagagcacactgggtctttctgaacaggaaccacctcaattaacccgtaccgttgttgaaactattcccgttcagttgtttgaattctgacacttctaagttggcttcatctcagctgcctgccacatttgcaccttctaagtgaaggagccccatcctcagccacgctgcctgcctgcctgtgatgctg

SEQ ID NO: 150383 - DNA, 1034 bp, Homo sapiens
cttagtgtaatgggtaaaaaagggtgactgtttcaggctccacttcccctccaccccatccccacttaacttttgattttttaattccaaaaaataaatactattgtagcgagtcaagaaaaagtagttctttttaatacggaaagtgctaacaagtgcttttaatatggaaggatatacttcaccacctctggtttggggtgtatccttccatacctcccctttcgctcagccctggtggtgtgtttggcaaaagaggttcccaccctgagccatctctttgttagtggcactctctgctctggaggaagcctacccatgttccctgagagggccgcctctctgtgccatagcatggtgtgaatgtgaactttcttgatactacctcactctttcacctggcccattgctgggtttctgggtctgatttgagccccagccagtccgggagtgacagccaagaggtctacggagcaggcagcccaccccagggcctcctcagaccccagtcctgtggttgctctaaatcatggctcaggaagggcacaacctcaggacccatgtgcagagctcagcgagggtcacgtggtccccactctgctgcccaggggtctctctgctatgaaccccactcatcctagggacaacttggtccccaccaagccctccagagctggatcagtggaatcaggggaagaaggaggaagcttcacagtccaccccatgggagcggcccctacccactgcgaaagaccaagtggagatggcaagtcatgtgcccgtgcacacgcgtgtggatgcgcatgcgcgtacccagcccagggacagccgagagggaacccgacaaagagatggaggtgggccagcgactgaggcagagacaaatagggctccaggagagcgcgacagacaggaaatccttctaaatcaggacacagccccaaaacgttattgctgttattactattagctctgtgtaaaggagcaagtgggagcaaggatccggtgcgagtgcagcccctgccacgcgcctc

SEQ ID NO: 150384 - DNA, 488 bp, Homo sapiens
gattctcctgcctcagcctcccgagtagctgggattacaggtgcccaccaccacacccagctaatttttgtatttttagtagagacagggtttcaccaggttgtcaaggctggtctcaaactcctgacctcaggtgatccactcgcctcagcctcccaaagtgctgggattacaggcatgagccatggtgcccggcctcagaatttcattttcaacatgttttgcatgatgggtgattttggagaatattttttgctctatcgcaggatgattaagatgtggacaaggtgaagcggatggagggggagctttgaaagttacttgctatttaattgaggaactaaactgctttgagagcctgggggtcagatcctctgccttttcctcctccccacctgcagtgcaaacatcagacaattgatcactattgtatcttggaggtgggagtgaccattgcagtgctgggaccagaagatggcattgtatgt

SEQ ID NO: 150385 - DNA, 182 bp, Homo sapiens
agcctagatggcgccactgcactccagtctgggtgacagagcgagactctgtctcaaacaaatgaaccccaacatagctgttggtggcaaggcctttctccatgaccaagggacggtggccattctctccaagtttcttcatctgtaaaatgggtacaattcagtggccctccctaacaggg

SEQ ID NO: 150386 - DNA, 283 bp, Homo sapiens
gataaacaccttccaaaggctggctactgcctatagagaggataatgctgagctggcaagtaatgtaatcactaacactcactgatgtcagccagctagtaaatgatagaggtgggatttgaagcaagcagtctcactccttaccctgtgttcatagcctcagtgctactcagagagatattgggtcttgggagaacagaaagggacagcaaaattgtggagttcattctttttgtttgttcttgagacagggtctctccctgttgcctaggctggagtgcag

SEQ ID NO: 150387 - DNA, 255 bp, Homo sapiens
ggatacagctactaaaacagaaagatggttcatcttggataaagtattttaattacttccacaagacgaaagggagtacatgtaaattttaaataaagatcaactccgtagacttaaataggttcaaacagataaattcaaggtgactactgtcattaataactaatatttaggaagtatttttcatgtatgtatattcagcacatttattatacatagatttatagtcaccagttcttgctttccaggagaatg

SEQ ID NO: 150388 - DNA, 296 bp, Homo sapiens
catccactgcccccgcccctgcttcttcggtgaacgtggggctgcggaacagacccctcctcacatcctctccactcctgaccacaggaagttccttctctccccttctgggtttgacagtctttcctgaggtgcaggtgggccaaaaatgtagagctcatcttaggaggtttatttctgtcttgtgagctaatcaagacactgggtgcagatgtttaagttttatcaagggagcagtctcttcagccagatgtgtacagcagcagaaggggcttgcctgcacggtaacgtgaaac

SEQ ID NO: 150389 - DNA, 344 bp, Homo sapiens
taagtatctgttgactgaataaatacaggggagcaacctgccaaaactgtctatcataagtggaaaaggggttatgagcaacagttagtgaagagaagtgaaagaaacaagtcaaagaggggagaggagagtagaaaattttaacacaagctgtggcttaatgaaatccatacaattttagtgtgcttttgtataaataaagacaaccagtaggtctccttttccctacagaagctataaaaagaaatggaattagaatcttagtagttataaagatataaaacatacttcagagcaaaaatgtcaaacaggcatctcaaatttagtatgaccagtgttgttaa

SEQ ID NO: 150390 - DNA, 640 bp, Homo sapiens
  misc_feature (23)..(24): n is a, c, g, or t
caagctgagacgactctctaatnnccaccgctacagtaccccattctgtatttggttcaagctccagcaaactgctcacgtgcctcgtatgttctacaagattcgcacactgggatggctcatgtggtgtcatgaattgtgaacattactgtgcagtcattctcagaaggtggggaaaacaccaaaacaaacaacagaatgcctggcaagcagcagcgatgaggataaagatagactgcaaggcctgttcctacctctggtgatcagggtgggaggagggaagaaaacgggagtgcatctgcctggggcctgtaccggaggaagatgctcaggaggcccagcagacccaggactctctcccacctgtggccccgtggcaagaccaaaggggagctctttggagctgtggcccctttgtgtcttccaaatcatattaattccaaattaaaatgaaggacattatatgcatcttacaaccaagttctagaatcaggccgagtacagtggttcatgcctgtaatcctagaattttgggaggctgaggcaggagaatctcacatgaacccaggagttgaaggctgcaatgagctatgatcacatcactgcactccagcctaagtgacagagcagatcctctcag

SEQ ID NO: 150391 - DNA, 736 bp, Homo sapiens
attttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcaga

SEQ ID NO: 150392 - DNA, 188 bp, Homo sapiens
gcagaaacctgaagttatcctgagaacaaacgtcactgccatggaaacacctcctccacgttcccgatggtgcactggttttctttcctgtctgaccaacaagcctctggagagtggccaccatcttacaggctcactttgtattctgtaaactttcagttggaaaataaacacactgtctccctgtc

SEQ ID NO: 150393 - DNA, 231 bp, Homo sapiens
gaagcagctggctgggacaagaagtttctgattcagagagaccggtgattgaggtgggattaataaagggacatcattatttcctcagctgagcccccaatcaatttttcagttagaatcctggacacataatgttactgtttcgttcttattagtcacatgtgtttggggctaccccatcgtaaccacatgagagtactgttggcaaaacaaaacaaacaggatgtttaa

SEQ ID NO: 150394 - DNA, 465 bp, Homo sapiens
cttttctgtgaagtctttccaaataaaaggctccctctcactgctgaatttctacagcatataatttgtacctcattttctgctctgtacatgcccaagccccctactggtattgtgagctccctgaaggcaggccccaatatttaccctggggtctctgtttccccttctgggccctagaaacagaatcccttgaaaaaatgccaagagctctgtggaggctccagacttagcagctgagaggggctgctaagagaagccaaccaggacgggtgaggcaggtcaccaggcaaaggacttggggtagctcagaatcaggaaacagcacaaagaaagtccctaagacaggagcaagtagggcaggagtaaaggcaaagggtgctgtgtggagaaaaaaaagggaggtgagaggagaggagggggcagggaaggtgtactaaacctgaatgaggagtgagatctgag

SEQ ID NO: 150395 - DNA, 885 bp, Homo sapiens
gctgctgcacagcggggagatgcctttctcctgtgagtgcggcaagggctttgtgaaacactcaaagctcatcgagcacatcagaacgcacacgggagagaagccttttcagtgtcccaagtgtgacaagagtttccgcctgaaggcgcagctgctcagccatcagggcctgcacacaggggagaggccttttcactgccctgagtgtgacaagaacttccgggaaaggggacacatgctgaggcaccagcgcatccacaggcccgagaggccctttgcctgtggcgattgtgggaagggcttcatttacaagtctaagcttgcggagcacatcagagtacacacaaaatcctgtcctgctccaaatgaactggacattaagaaaaggctcagccaactgtttgcaatgatagaggccgattggagttgaggcagagtgggacatccaaagcgttgagcaggattggtattgcccaggaatccacagcaacagtagccagacccgctggtagacgggttttaggagcaggtatccttctttgagcaagagtgtcatgcaagttaggaatatgaagaaccacaaaggattttctcttcagaagcatcaccaattatatttctttctttttttttttttttccaagatggagttttgctctgtcacccaggctggagtgcagtggcgtgatcccagctatattggaaaagacagcattataaaacaaggacataattttatgaaaaaggaggcatctgcaaacgaaaacaatttctacgaggttatatgtgattgttaacatttttaagaaaaggtgcacacagaaatccagataagatgtgattacctttgtgcatttgtataaaaatatatgtgtgtaattataa

SEQ ID NO: 150396 - DNA, 147 bp, Homo sapiens
ggcgatctagaggatcccagatgcaaccaagttcagttcttgctgaaaacacaaatagatacctggtcctcactccctaccttttgagtgagatcctaggagaagagtctggattattaagctctccgagtgattcttatgttcata

SEQ ID NO: 150397 - DNA, 349 bp, Homo sapiens
gccgggaggactgatgctattctgaaggctgcgtttgttgctttggacgctgtcctcaatcttgtcttgtgtatgtgtgttgccttagctagacgtaagcttcagaatgtctaacacctacatgatgcctgtccactgctctggtggacatgaaattactgataaggggaaagggtctggaaaactcctggcattctgtataataacggagaaatttatctggcctgaacttgggttacctggggcaagaggcacctgagcccagcctcagccttctaggattacggcactcataccctggggtgagctgcagggaaagacctccatgggcagcctagagcctgggatg

SEQ ID NO: 150398 - DNA, 508 bp, Homo sapiens
tatatagatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgtttacacaaggagcttgaacatgccctggagaagaatgaagtggacctgcctgttcactccttgaaggacctgcccacctgtgcttcctcctggcttcaccatcggagcctctgcaaggaacccacg

SEQ ID NO: 150399 - DNA, 670 bp, Homo sapiens
tatatagatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatata

SEQ ID NO: 150400 - DNA, 758 bp, Homo sapiens
tgcagagaaaggaacacggaacaccccggagtaagtttttctgtatgtaaattaagcctcaatcactaagaattaataattcttaccagggctcaggcccatctgtttcctggatgagccctgggtaggccctgggggatgccaaacagagctgagcaggtaagcagggaaagaggaggcatggcctccgagaaagacagaaaacagcctggctttgtgtggccaggttcaggaacatgacctgtggccatggtctgcttttggccagcatctcccgttaatctctgggacagctgctgcagcatcacctgagtgccctttggaaatgcaccttctcagccccatcctggatccagactaagggcacgacccagaaacctgtcttcatgagccttccaggtggagctcgggagccccaatacttgggcagctcctatggagctggaaggagcagatttgccttcgatataaagaacactgagcacctgctaactgcctcgttttcccttcttgtgtccatacacacactggtggaaaagggcagcatggtttgcctcatttttaactcagattccttggccatgaaagaaaaacaaaaatcagcaaatccggtctcggttcagttgaggtcaaactcttggtttggtttggtttgctttggtttcattgcctcctggaaatggtgctcatctactttctggttcctggatccaattcaagctgcacaaaataactgagtcagcacataaagtccaaaa

SEQ ID NO: 150401 - DNA, 170 bp, Homo sapiens
aattgagacgcctgataggaatgttcacacatatgtagctgtaatatgacttgtccttcttgagtgcaaggtgatctggctgaggtcggggtgagattggcactgaagccaagggtgcaatccatttctatggaaagccaactggcccatagtggaaggtggtctcacgg

SEQ ID NO: 150402 - DNA, 453 bp, Homo sapiens
ctacctcagcctcccaagtagctgagactacaagcatgggccactacgcctgggtaatttttgtattttttgtagagatggggtttcaccatgttgcccaagctggtcttaaactcctgggctcaggagatccactcgcctcagcctcccaaagtgctgggattacaggtgtgaaccaccataccccgcctgaggatggtgacgtcaaggtgtgggggtgatgggagcccagtgccgtaatcagttggtcagtgttggtagctgacttactcccacgaagacccagctcctgtccctctgcctggggctgtcttgccttgtaccagtcccatgctctcgtcttgtagtttttgagggtcaggaatttacagtggctttgtggggtaaagttggctcagggtctcccacgtggttgcagtcaagctatcatcagtgcatctgagctcccttggg

SEQ ID NO: 150403 - DNA, 404 bp, Homo sapiens
ctactcagacacattagatttaaagatgaatttaccttttcatgagctattggtgagcaaggcactgtgatgggagaaatcttaagactctgagtagcagatatcctgaaggaggcctcttggcaaagaactcttcctttcctatgaagggaaagagagtattggaagattatttgcagtgttttgtgtgtatcatttttggtacacagtttttattcatgtatccctaattaagttttttttttttttggtagaggcagtgtcttgctgtgttgcccaggctggtctcgaactcctggcctcaagtgatccatcccgcccaaaatggtgggattacaggcatgagccaccatgcctggctcctaactttctttaggtataaaaataagacgtcatcttcagga

SEQ ID NO: 150404 - DNA, 417 bp, Homo sapiens
caataactgggaaaaaaaataaactatgaaatgcaaaaaaggaaagttggattcacacctcacaccatacataaaaatagtcttcatgtagcttaaatacttatatgtgaaaggcaaaattttagaatattggacaatatttttatgactctgaggtaagagtagatttctaaaaataagacattgaaaacaatgagaaatccaactatattaaaattaggaatttctattcatcaagagacaccaaaaagagactcaaaggacaagccaaaggcagctgtggtagctcatgcctgtaattccagtactttgggaggcagaggtgggaggatcagttgaggccgggagttcaagttcgaggttgcagtgagctatgactgcactccagcctggatcacagagtaagaccctgtctca

SEQ ID NO: 150405 - DNA, 244 bp, Homo sapiens
gtcaacttgtggttcagcattgttggagcccaaaggggtaggagataagtacatgagggtgtgtgcttgcaagtcatggccttgatggtacagggatagtgggagaggatttatggcaattcttggaggactttacctagcactttctcctaatggagatgggaaggaagcctgatgaagggttttaagcaggcaagtgacaggattagatttggatttttaaaacagttcctctagggtctag

SEQ ID NO: 150406 - DNA, 234 bp, Homo sapiens
aactttcccatcatcaactcacccagaaagcagaacattcactttcccagttctattcaggggccacaggtgctatgagcagatgcaccagggcgctgtctacaatctgtgaccaggagcagcgatgctgacccagcttccctccatcaggtgctgccgtcgtggagatgcactcagcaccagggcacggagcacctgctccttctcggcgatgcgctcagcaccagggcacag

SEQ ID NO: 150407 - DNA, 418 bp, Homo sapiens
attgttaaagaaggactgtattgattattaaaggtaactagaatgggcattcttcacattcatgtaggtttgcttgttcaagttaccactttctgaacaagaaggttagaccatagacttttaagggctgcatactgcaaagggatactctgttctttaggttacatgggcagggatcactgctgagaccatacctgccaaaggaaggcaggctttgctctctagatgctggacttgaaattgtttcccctctgcttagtgctgcattattttttttgcttcttaatctgctgcagagtatctagatcagggtgtccaatcttttggcttccctgggccgtattggaagaagaattgccttgggccatatataaaatacactaacactaatgatagctgatgagcttaaaaaaattac

SEQ ID NO: 150408 - DNA, 457 bp, Homo sapiens
agccctgagcttgactctggcagaaggaagtgcccaagatgggagtctaaccctgccctcaggggactggtgccagggaggcagggatcagggcagcacctgggaagccaccccacagggccagcctgactactggccagccaggccactgtggccatatcctctctgcctgaccctccctctctgagtggacgacagttcagttggcccccaggactgagaggacccagggagctgccatggtcctggtgcgtcagagccctggagccctggagccctcttcaatgggaagagggaggggaggcccacagcaggagcacacctcccagctgaaatgtagttggtccctacactgtgctaaggggcgccatgaggtgggaagagatgcttggggatgcctggtgtgggcccatggacagcctgtggcctgggtcctggcatgactgtgtccccttgc

SEQ ID NO: 150409 - DNA, 426 bp, Homo sapiens
atccatgtacatgtctgtgagcaggtccatgtacacatctttgggtgtgcatgcacaggtccatgcctctgtctgcatgtggttgtgcgtgtgtgcagctgcatgtgtactggtgcatgtgggcatctgcatgtggttgcatgtggcatcctgggagcagagatgccctggagaggaggaaccagctgtggtgtggagctaggctgaggcgactggggcagaagggagatgggtcaggggctctccagcatcccacacttacttgctaaaccatggctttgattctggcacttgggctggggctgctgaatgaggcagatgaagatctattccctatttttgctcaggtgggagggcaggagtcagactacaggcagtaaataagcagcaagtggcagaaggtgcccagtgctacagtggaaatgg

SEQ ID NO: 150410 - DNA, 319 bp, Homo sapiens
tactgtgcactcaccagtaagagcctcctgcgccgccctcttcttctggcggtacctagtgactgctgtcttgattttgctccatgacatcattcttatcccaagttgtcatccctaattttgcttggcttgattaatcaagatgttcctctttggggttagcagtgtgtttgggggcacctttggggcttaatattcctcttatgcagcattacctaagtgctctacaaatatggcagtttggttcagtgaagtagtgagtagctcacaaaataggttaaaaggttttgttgtcagtttggtcatgggtgagaagtta

SEQ ID NO: 150411 - DNA, 355 bp, Homo sapiens
gttattgtcacatttaatttgttcaaaaaaggagaggaaagattgaagacattaagcacagaaatggaagatgtgaaaaagacttaaatctatattctagagatgaatgttacaggacctaagatgaaaaaaatttgctggatggatctgtgacagtttagtctacaaagaaagaaattaatgaggtgacatcataacaatagaaactacccaaaatgaaccacagagagaataatggctaatttaaaaaagagacaatcagtgaactgtaggacaatttcaagtgcctcagtattcatgttattcaagttgctgaagaggaggaaagtgggagagttttagactgaaatatttg

SEQ ID NO: 150412 - DNA, 396 bp, Homo sapiens
ggtagtcacaacatgcctgtgtctacaagacagaaccaatgttccttagctcagcctgtttctcaatctgtagtttctaatatcctgaattccattttcttttttgagtcagggtctcactctgtcaccctggcgggagtgcagtggtgtgatcatagctcattgcagtctccaactcctgggatcaagggatcctcccacttcagcatcccaaggagctgggactataggcacatgccaccacactcggctaattttttttttttttttttttgagatggagtttcgctctgttgcccaggctggagtgcagtggcgggatctctgctcactgtaagctctgccccctcccgggttcatgccattctgcctcagcctcccgggaagctgggacca

SEQ ID NO: 150413 - DNA, 666 bp, Homo sapiens
tttttttttaaatggctatatgaaatggaagctactagtttatctatttgggtctccagatctcctccttgtttatcatccaagtaccaggaaactggagaaactctcatctgggtaccaaccaaagacatctcttgtatgaggggatgaacaaacacagatgactcatttctcttacactgagacagaagcagaattaactcctgtcagcctgacacaattctgcatgggacatctcaaatgcctcaaagacacctaggtgattttgaaggaattcccagtcgccctgggccgctgcccaatgataagccaggctggagagactcaggctgattctaaatagaaaatggaacttccctggtggaactccacaacctggatcacccattctgatttactagctcttgggtaagagaaagaacaaaaatactctactccagtatcacattttacaggtgaatatagttgtggttgtgatcatggctctggatactttgcagccttgatctctcactacagattatgccatcacattctatttcctcctggagcctctgacctcactgtagcaggtcaatgaacaagatgtgaaacatctcaaagagccacactcccaatgcagaaaatgccttttgttagttttctgtacattctctatccaaagtc

SEQ ID NO: 150414 - DNA, 488 bp, Homo sapiens
attgcagtcaggctcaagttattaatcctctgtagcttcatgtttatttatctgcaaactgtgggcaataataactatttatatagagatagtataaagattgcatatgttcatggatgtctagacttaatggctacccacattgaaagtagagttaactctctgtaaatttcagttatcattctcacagtaagacaaaagcaaggtaactggtgtgccctggggtattctaggggcaggggagcagctaagaggattgagaatgtggagctaaaatgtgtagggccctgaatgcccagttaaagattggggcttttttcatacttcagtcacttgggtaacatctttacaattttgtcagtgtctgcagatttcctgtaatattatctattagtaatttaaatagaactaccttttaaaaaatgctacatttcccccatcaatatgtgagctttccagttgcttcacatttcaacaacgcttggtgt

SEQ ID NO: 150415 - DNA, 274 bp, Homo sapiens
aggctctgagcggtctctcgtctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctcccggcaaagcagatgcacggggagagcaaggaccagttccaaggctcccctctgccaagcccaccatgaccacgcatggcccacaggctgagacttg

SEQ ID NO: 150416 - DNA, 499 bp, Homo sapiens
gtgtcatgagagatgttactaaaatgtaaaataactgtatgaatattccagagagaagggaaaaaagttgagaagcaccgatattgaagtatttgataaatgaatgaatgatctgaattttaggtgtcaagttttcttatctatgccacttcaaattttccctctgaggccaggcatggtggctcttgcctgttatcccagctacataggaggctgaggtgggaaggactgcttgagcccaggagtttgtgagctatgactgcacccattctacttctcgacctggaaggtaagccataccctccttgtttctactccacctggtcaccagtggggttcctctaacacaaatgtaaccattaaacactatttctcaaagtgtggttctcagactacctgcaccaagattaccctgagctgctggtttaaatgctgactcctgactagaatataaaagtctctggaaatgggaatgaacatctgtttcatatatctaaga

SEQ ID NO: 150417 - DNA, 203 bp, Homo sapiens
catactgttctatgcctggaacctcttctccccatcccaccactccatcaaagcagtaacttcttactcaggttttgtgattggctctagggcacctcgttggggaagctggcctctcagcccagggcagttgcacagcctccttccacagctcttcttcctgctgctgtggcttacatgttgtctctaccactggactatga

SEQ ID NO: 150418 - DNA, 543 bp, Homo sapiens
tgcgtatgctgatactggggagggggcagagatgggaaaggggcagttataaattgctaagttattgtgtttatattcagcacatcttgcagccaagattctgtttctctctctctctctctctctctctctctcacacacacacacacacacacacatacagacacacacacaatcagtgtaaagattctgacctatgcctggaaatacaatcctaagtctagataaaggggagagctaatgaaggctcacagttgaagttgtctgatttgtacacacccagcacacattcagactcgattgtataggtcaaattttcccagaaacatgcgatcacggctttttgagctcaaaacctgtggataattgttgcttaccccaatatcccactttccttcttttccttagaagtagaaaccttggttttgaggtagacacattgctgcccaactgaatgacctgatcttcttcttgccttgcaagaaggtatgcctagacttgcaagaaggtatgcctagccttgcagctaggtatgcctagact

SEQ ID NO: 150419 - DNA, 494 bp, Homo sapiens
  misc_feature (466)..(466): n is a, c, g, or t
tctccccattccgctacataatttaaaaaacatctcatctctcaggacctggccactgcctctacaacaagcctcctgggaagtctcgttgtcccatcgacacctctcccttctttcgctccattttttttttttttttttggacagagcaagactccctctaaaaaaaaaaaaaaaaaaaaagaaaaaaaaaaaaaaacacccgcacggggggcaaccgcacggcggtcacttcaaacaaagcagggtagaagcataataacaccccggcgtgtaccccacgaacaaaacaaacaagtggtgagcagacctaccccgggacgaaacgacgacatgtgctaccgcgcgtaaacaccaatctggggtgcgcacacacaacactaacagcgcatcacacagacaccgtaccgactgcgagctgcgtgacgccacatagagcgagaccgaacatactatacagccgacncgaaagcacgcagcgccggctagcacag

SEQ ID NO: 150420 - DNA, 984 bp, Homo sapiens
catcctgcagctggagagcagagaaaaccaaagactggccctagaagttaataacacaagcggcagactccgcaaatgggatattgtaaacctttaataacaccatgggacccatatgaagtgccaccagtgatgctggaagtcctcccacgaagcagagaaaagtcatgacattacaagaaaaaactgaattgcttgatacctagcatgaatggaggtctgcatctgcggttgaccgtcatttcaggcagatggttcatcttgcagacaaacgatgagagggaagtagggaagaagcaccaggtgtccttgacactcaagagaatatcccctctgctgcactactggatgcctcctggaaaaactcatcatgtgaaattgataatcagagcattcctgggctagctgctgtacactcaaccaatctccaaagtgcactgtccttccagagagtatggagggaagatcagatcacactgcattttcagacaatagtggatgatgaaatacagaggccattttgaccgtgcgctctccatgtctgacagagccagcagcatcacagcatcaagggggccctcaacttgccacaagttttaggaagtagcttcagggcctctttccaggcttgaacagccatgtctgtctgtctagatgaacaaatgcccttggggaaaacaactccgttatgacctctaccaactaaaaggtaaagttctactctactaagtcataccacgcctcaccttaatggcaccagcatctcagagtaaaacaggatagtttagatagagtccactgattcttagaccttgctggctgctccgggaagggccctttgcaatggatttctgttgttgtatggatagagtccagtaagggatgtggggacgcttcaggtctgaagagttcattttcttaatggcactggaaaggttaattctgatgacttctctccgctgctatatctccatctatagttca

SEQ ID NO: 150421 - DNA, 1150 bp, Homo sapiens
cctgaacacctcttcgaaactgatatctctaaaataaattctccgtttcccagagacctctagaaaagactctctacctcttcatgggaatatacttttgctgcaagaaaataaaatgttttctctttatctcttcatggcagacctaagtgtgagaaaaaggttgctggtgatttaccacaccacagcctgagtacacccaggcacgcatctttaaaacatgcccaaagatatctctgtgaaatgtattcagtagtggattccagtattcacagccttcatttacacagttcactttatttaatttgtacttactggtaatattaagtaatcagagttcatatccttgggaaaattctcccctgaaggccaattcattcgtaataaaaaccacattttgagcagtgagtgaatccagctggttgcactagtaagccattttcattttttatagcacatttcagctttccaagtattgcatatttgtatgggagaaatgttttctgaagtcaagcttaatgaaacatgaagtcaatgatatatgcaaacatctatttattcctctgctgtctgggaagttttgatcaagaaaacacttctgctcattagagaattgaccagatgcagtgctattaacatttctgtgatcaaataaagctcacccagatgaaagaagaattgcaacactaacagcctggaagcactcaaccgtggagatattacccccaaaagtgaagcatgctaagatacaaaacaaactgacttcaagcacatctgattaacatggccattgttaactttcccactacttggcagactttaaacctgcttatggataacagtcatatgatgctggataagaacctcatttatatcagtgtaattctctatgcacatgttcttcatgtttatagaaactgcattgatattttgttactcctcaacatgaccctagaaaactaactgatcatatagaacttaacaaatacagaagcctatggctaaggcgccttcggccttcgtaagggaatatacaccactgtcctgccgtgccggtgggggctccattacggtcagttcacattctacagaatccgcaagcaagcatcgatacgtatataattacctccgtatcaatattgcgcgatag

SEQ ID NO: 150422 - DNA, 1163 bp, Homo sapiens
tcacggcgtccattccgccgcggttcctggggcgcgggagtctaaaataaattctccgtttcccagagacctctagaaaagactctctacctcttcatgggaatatacttttgctgcaagaaaataaaatgttttctctttatctcttcatggcagacctaagtgtgagaaaaaggttgctggtgatttaccacaccacagcctgagtacacccaggcacgcatctttaaaacatgcccaaagatatctctgtgaaatgtattcagtagtggattccagtattcacagccttcatttacacagttcactttatttaatttgtacttactggtaatattaagtaatcagagttcatatccttgggaaaattctcccctgaaggccaattcattcgtaataaaaaccacattttgagcagtgagtgaatccagctggttgcactagtaagccattttcattttttatagcacatttcagctttccaagtattgcatatttgtatgggagaaatgttttctgaagtcaagcttaatgaaacatgaagtcaatgatatatgcaaacatctatttattcctctgctgtctgggaagttttgatcaagaaaacacttctgctcattagagaattgaccagatgcagtgctattaacatttctgtgatcaaataaagctcacccagatgaaagaagaattgcaacactaacagcctggaagcactcaaccgtggagatattacccccaaaagtgaagcatgctaagatacaaaacaaactgacttcaagcacatctgattaacatggccattgttaactttcccactacttggcagactttaaacctgcttatggataacagtcatatgatgctggataagaacctcatttatatcagtgtaattctctatgcacatgttcttcatgtttatagaaactgcattgatattttgttactcctcaacatgaccctagaaaactaactgatcatatagaacttaacaaatacagaagcctatggctaaggcgccttcggccttcgtaagggaatatacaccactgtcctgccgtgccggtgggggctccattacggtcagttcacattctacagaatccgcaagcaagcatcgatacgtatataattacctccgtatcaatattgcgcgatag

SEQ ID NO: 150423 - DNA, 1170 bp, Homo sapiens
ttggactcgcgccgcgctgtacatttgcggtcagggtatgaaaagtctagaaaataaattctccgtttcccagagacctctagaaaagactctctacctcttcatgggaatatacttttgctgcaagaaaataaaatgttttctctttatctcttcatggcagacctaagtgtgagaaaaaggttgctggtgatttaccacaccacagcctgagtacacccaggcacgcatctttaaaacatgcccaaagatatctctgtgaaatgtattcagtagtggattccagtattcacagccttcatttacacagttcactttatttaatttgtacttactggtaatattaagtaatcagagttcatatccttgggaaaattctcccctgaaggccaattcattcgtaataaaaaccacattttgagcagtgagtgaatccagctggttgcactagtaagccattttcattttttatagcacatttcagctttccaagtattgcatatttgtatgggagaaatgttttctgaagtcaagcttaatgaaacatgaagtcaatgatatatgcaaacatctatttattcctctgctgtctgggaagttttgatcaagaaaacacttctgctcattagagaattgaccagatgcagtgctattaacatttctgtgatcaaataaagctcacccagatgaaagaagaattgcaacactaacagcctggaagcactcaaccgtggagatattacccccaaaagtgaagcatgctaagatacaaaacaaactgacttcaagcacatctgattaacatggccattgttaactttcccactacttggcagactttaaacctgcttatggataacagtcatatgatgctggataagaacctcatttatatcagtgtaattctctatgcacatgttcttcatgtttatagaaactgcattgatattttgttactcctcaacatgaccctagaaaactaactgatcatatagaacttaacaaatacagaagcctatggctaaggcgccttcggccttcgtaagggaatatacaccactgtcctgccgtgccggtgggggctccattacggtcagttcacattctacagaatccgcaagcaagcatcgatacgtatataattacctccgtatcaatattgcgcgatag

SEQ ID NO: 150424 - DNA, 1159 bp, Homo sapiens
aagagggaacggtctactttccttccacgtctttgtgagaaaataaattctccgtttcccagagacctctagaaaagactctctacctcttcatgggaatatacttttgctgcaagaaaataaaatgttttctctttatctcttcatggcagacctaagtgtgagaaaaaggttgctggtgatttaccacaccacagcctgagtacacccaggcacgcatctttaaaacatgcccaaagatatctctgtgaaatgtattcagtagtggattccagtattcacagccttcatttacacagttcactttatttaatttgtacttactggtaatattaagtaatcagagttcatatccttgggaaaattctcccctgaaggccaattcattcgtaataaaaaccacattttgagcagtgagtgaatccagctggttgcactagtaagccattttcattttttatagcacatttcagctttccaagtattgcatatttgtatgggagaaatgttttctgaagtcaagcttaatgaaacatgaagtcaatgatatatgcaaacatctatttattcctctgctgtctgggaagttttgatcaagaaaacacttctgctcattagagaattgaccagatgcagtgctattaacatttctgtgatcaaataaagctcacccagatgaaagaagaattgcaacactaacagcctggaagcactcaaccgtggagatattacccccaaaagtgaagcatgctaagatacaaaacaaactgacttcaagcacatctgattaacatggccattgttaactttcccactacttggcagactttaaacctgcttatggataacagtcatatgatgctggataagaacctcatttatatcagtgtaattctctatgcacatgttcttcatgtttatagaaactgcattgatattttgttactcctcaacatgaccctagaaaactaactgatcatatagaacttaacaaatacagaagcctatggctaaggcgccttcggccttcgtaagggaatatacaccactgtcctgccgtgccggtgggggctccattacggtcagttcacattctacagaatccgcaagcaagcatcgatacgtatataattacctccgtatcaatattgcgcgatag

SEQ ID NO: 150425 - DNA, 1161 bp, Homo sapiens
  misc_feature (53)..(53): n is a, c, g, or t
  misc_feature (58)..(58): n is a, c, g, or t
ttgttgttattccccctccttgatgctgcataaagtggaaactcaggataacntctcntttcccagacctctagaaaagactctctacctcttcatgggaatatacttttgctgcaagaaaataaaatgttttctctttatctcttcatggcagacctaagtgtgagaaaaaggttgctggtgatttaccacaccacagcctgagtacacccaggcacgcatctttaaaacatgcccaaagatatctctgtgaaatgtattcagtagtggattccagtattcacagccttcatttacacagttcactttatttaatttgtacttactggtaatattaagtaatcagagttcatatccttgggaaaattctcccctgaaggccaattcattcgtaataaaaaccacattttgagcagtgagtgaatccagctggttgcactagtaagccattttcattttttatagcacatttcagctttccaagtattgcatatttgtatgggagaaatgttttctgaagtcaagcttaatgaaacatgaagtcaatgatatatgcaaacatctatttattcctctgctgtctgggaagttttgatcaagaaaacacttctgctcattagagaattgaccagatgcagtgctattaacatttctgtgatcaaataaagctcacccagatgaaagaagaattgcaacactaacagcctggaagcactcaaccgtggagatattacccccaaaagtgaagcatgctaagatacaaaacaaactgacttcaagcacatctgattaacatggccattgttaactttcccactacttggcagactttaaacctgcttatggataacagtcatatgatgctggataagaacctcatttatatcagtgtaattctctatgcacatgttcttcatgtttatagaaactgcattgatattttgttactcctcaacatgaccctagaaaactaactgatcatatagaacttaacaaatacagaagcctatggctaaggcgccttcggccttcgtaagggaatatacaccactgtcctgccgtgccggtgggggctccattacggtcagttcacattctacagaatccgcaagcaagcatcgatacgtatataattacctccgtatcaatattgcgcgatag

SEQ ID NO: 150426 - DNA, 380 bp, Homo sapiens
agcctcccactgaacccagggccttctccctgaactttccttccaagggactctccgtgccctggtcctgcacctccctccccctcgctgcattccccagtcaggaacactagtctagcaccagctcagccatcctctctactgcagttcctgccttcccccagaggacgctattttccctcaaaaaacccacaactgaacactgcctctgggtctcaggacttctccatatctcttccacccttccccacagccaagcactgcagctcttcataccccgaattgcttcccaaacatccgtatgtagggtacattacaggtctccagcctgtcagccagccttttctggcatttctccctccctagccaagaccccatgt

SEQ ID NO: 150427 - DNA, 409 bp, Homo sapiens
ggcagctaccaaggaccttgaataaaggtgggttatgaaatgttgtacgcaagcatacccagatcagagaggaggaggtgcctgagtgattcccgcccgccaagcaggtcctcccaagctggcctctggctgtgctcccagctcccaggcacacaagctccggtcaggccagcctcccatcctccctgccctctgccctaacctcactcatactcccacagcaccaggtcagctcctctgggagctggaaggaactgagatgaacacaccagctctttttttcacatatttggagaaaacagccatgggaggacagttaagagggtggcagctctccaacacacctagtttgccaacatccttcctaaatgtagtgcccagagatgcgattagcgttaaggagaaacta

SEQ ID NO: 150428 - DNA, 402 bp, Homo sapiens
caaaagccaatggcagaataaggtttccatcctgagcccttccagggtataataacagcaactggatgatcctcaaaaggatcatcagactttcccacagaaggcctccctttaaccctgtcctccccaagaagctgagatagcatagtgcaggaaggcttggcagcttcttggaacttctttattttaaattcagctattttcatcctaaattttaatgtccttgtcttttcatttaattttgaaatctattataggactaataaaataacatttgaaggacatcaggcactaagtggggaatcattttattattatgtctttttttcaaaagataaccttgttttcttttcaatttatacaaattatttatgttcagtggagaaaaaaaaattaacacat

SEQ ID NO: 150429 - DNA, 364 bp, Homo sapiens
tgttgacccgccttttattcttcatctcacttatatcacctgtatgtatcacctggttctgatacctaccaaccttctgaccttgggcaatttccttaatttcctcaagagcctcaatttcttcacctgtaaaatggggatataacagcacccataggaaacttacactttagattcatgagagtggttggctcttgagtgttggggagaaaagaaacggtgatatctacagtgtccacagcagagcttagaacaaagtagaatctcaataatatttgtgggattaaggaaaatattatgttaataaactcatcttcagttggtgccactactcaatagtagaatattgctcaacattgattac

SEQ ID NO: 150430 - DNA, 373 bp, Homo sapiens
tgtagtattgttaggggagcatacctggtgtgctctgacgtgggcttgatttggccgttttcccacctactgcagtatatcaggcactctgcacagcttaaaagaggatttttttggtgacactcagctgcaggcactatgaattgttcttttgtgccctcctgattccaccagggatatattttatatatatacttgattttctattttgcttctattttggttgcctggttagactgagggtatgcctggtattgactgttagttttttgggtctagctgatgattacagaaactctgccatcccaggggtccatttaggtctttgcaattttattctaatccactcagctgttgtactgatgttgttgct

SEQ ID NO: 150431 - DNA, 475 bp, Homo sapiens
gcctggcagggcctcagctggtgcctggcaccgtcccgggccctggcctaggtgctcggtggactgctccttcctagtgccaggtccacttgcagctcctgggagctgccccgggagctcagccctgggtgcccctggctctcccagctcagtgtttcactatgatcaatcagggtatcgccaggaagggtcagggctgccacctccctgggccacctggaccgaaagctgggagaggctgccacagaccacctgggtaggtggtccacaggggcccttctcaccctgggccaggtctacagcctgtgtttagtctggggtggggtggggtggggggctttgctgcttcactgcaccccacatgagccctgttgggagggctgccagatgcagggagacgcagaggcgcgggtacacattgctccaccagccagacccagagcttcctagtggggaccagtctggagcttgaaat

SEQ ID NO: 150432 - DNA, 411 bp, Homo sapiens
cagttctccaagacaagctggatctggggagacttattccaatcagagaaaatggcatagtggtaggattcactgacctgtccaaccattcatccacccatccatccttttattcattcataaaatatttactgagtacaatttttgtgccaggaattgagcttccaatggtgggcaaaagagtaaaggatgtgaggtgaatggtgcatagaatgacccagctagattagaggattggaatgagagaaaggctagaaatgtcatttgagtcagtatatgcggacctccgatatcagactccggtgtttaaggaatttcctgagggcaatgaggcctgatatggtacggtggccccactcatcacctgtggaagacatacggatgacctcctagttcacattaagggagttt

SEQ ID NO: 150433 - DNA, 177 bp, Homo sapiens
aacaataacaacaacaacaacaaaaacaacacaaaaaacaaagaaacttcaggccctggctctcaaggccctcctgttcccctgcacatccctttctcccctagtcccatctctataggcccctacccctgagccatcttccttcaacccccattcaattttggtgccatcatcttg

SEQ ID NO: 150434 - DNA, 173 bp, Homo sapiens
gggacatgccggaatcagaggccttcctcttatttcagccgcaaagaggccttcctcttttactaatcctcctcagcacagaccctttacgggtgttgggctggggaacagtaaggtctttcccttcccacgaggccatatctcaggctgtctcagtggcggggaaaccttgg

SEQ ID NO: 150435 - DNA, 353 bp, Homo sapiens
ataacccatgagttatttagaaacatgttgtttccagatatttggagctattctagatattcttattactgttgatatctagtttcatttcattattattagagaaaatatcctgtatgattttcttcttttgatattcattgggacctttttatggctttgcatatggtctatcttggtgactgttactgtgcatttctgcgtgtcacgttctataaatgttaatggttcaaggtatttgaaagcattacacaaattctgtatatgcttagtgattatttttctaagttgttctattagttgccaagggatgggtattaaaatctctagctatgattgtagattggtctgtt

SEQ ID NO: 150436 - DNA, 513 bp, Homo sapiens
gtttccagcgtgacagcagtggtagagtgttctctgtgagctagtagaatcaggaaggctttatgaatgaagtaggtttaaaaaggtaagatttggcctggataagaggagatgacctccagcagaggaaggagcataagcacagtttagaggattaaaaagggtaaacaaagcatatcatgtggagaggaaagtgggggaaccaggctggggtggggtttagttagggagcgagggaatataaagacatgagtttttgctctaagaacataagttcaagttagtgtgttttacttgtggaaaagtaacagacagttcttatatttctaaaacttttatatatattttttttaccataggtcctgatgtttttagttcaaagagtcttgcgcttcaagcccagaagaagattctgagcaaaatagccagcaaaactgtggccaacatgttgattgatgacaccagcagcgagatctttgatgagctctacaaagtcaccaaagagcacacaca

SEQ ID NO: 150437 - DNA, 633 bp, Homo sapiens
ccacaaaagactccaaagagatcctgagcaaaaggaacaaagttggagacatcacactacttgaccctaaactgcaatgctctagtaaccaaaacagcatggtactggcataaaaacagacatacagaccaatggaacagaatagagaatccggaaatccatgtatttacagtcaactgattttcaacaaaagcaccaagaacatacactggagcaagtgcagtgtttttaataagtggtgctgagaaaactagatatccatttgcagaaataaggagctagaccccctaactctcaccatatataaaaccaactcaaaataaattaaagatataaacgtttacacctgaaactatgaaattattagaagatgatgtaggagaaatgcttcaggacattggtctgggccaagattttaggaagacctcaaaagcacaggcaacaaaagcaaaactaaacaaatgtgattatataaaactaaaatgcttctgcacagtaaaggcaacaattaaaagaataaagaggcattacataatggtaacgggtcaattcacaagagggctaactatcgcaatattatgcaccaataaggagcaccagatcataagcagtctcaggactcaagagactaat

SEQ ID NO: 150438 - DNA, 313 bp, Homo sapiens
tcagcaaaccacaacagctaaaaaccaggatatcagaacattttggatggtatctatgtctctgaaaaagggacagttcagcaggctgatgagtaaaatctaagagttgtacagctacagaaacaagatgtcagataattcctaagacctatttgtgatattttaataatgcaataaaagacagctattgaaaaataaagtagtgatgaggtttcaagacatgaatgatgggatttgctgatggctagcactcaggatgtaagggaaagagaaggattgaggctaactattgagttttggtctaagaactgca

SEQ ID NO: 150439 - DNA, 476 bp, Homo sapiens
ctgcaccccagcaacccttgttcactcttccgcccaagccttagtcctctcttctgaggctcccttcctccctccccacagctgtccctcaaggttccacatctaccttcttgatcatctcatgcaccaccatggtcttccctatctgggagctgtggtccattcattctgttctcgttagtgaatcgctggattgtttatctcacaccttctctcccaactcctggctatgagcccctggatgcctggggctatgtcaatttcactttctcctcctctgcctacatcagaccttcgatatgggtttgctgaatgaataggtggcttctcccttcctgtctccttcgactgaggttgggatggtcaggaggaagcctcaaaattagatgaatgcatatctcatttttcataaccaatagcctacaaaatcagctggggaagagaaaaatcagccacagcatgggaagccttgggga

SEQ ID NO: 150440 - DNA, 209 bp, Homo sapiens
cccgcaactcctgtgaattaaatcttagaaaatgatgcttccaagaaattttctgtatttatttgtacaagggttcatgagtgcttatgtttgagttattggatgctctcacatagcaggtgctcaagaatcctcctttaatagaatttcagaatcataaaaacatgtttttacattgttagacaatacccccaaatcctagggccagg

SEQ ID NO: 150441 - DNA, 223 bp, Homo sapiens
tccccttgcacgacccgttccagcaactgcaggtcaaagtcctgctcacgcttccactggcaacagaacaagaggttaaacgtagtcgcttcctgattgctgaaagagcccggctggtcacctttttccatggggtcctttggaagatgaacctgtgatccccttagggaaaagctgtatgtgcaatagagaatgaagctgctgtccccttcatatgggctgt

SEQ ID NO: 150442 - DNA, 792 bp, Homo sapiens
tactcggggcacttctggtgtaaaggtgggcagatcaactgaggataaggagttcaagaccagcctgaccaacatggtgaaaccccgtctctactaaagaatacaaaaaattagcggggtgtggtggcgcatgcccatagtcccagctactcaggaggctgagacacaagaatcaccactgcactccagcctggaccacacagcaagaccctgtctcaaaaactaaaataaaattcagagctttccttaaggatttgaataaaattacaaatccatctttagaaataaagtgctcaggccaggtgcagtggctcatgcctataatctcagcactttcagaggctgaggccagcagatcacctgaggtcaggagtccaagaccagcctggccaacatggtgaaaccccgtctctactaaaaatacaaaaattagctgggcctggtggcaggtgcctgtagtcccagctactcgggagactgaagcaggagaatggcgttgaacccagggggcagagcctgcagtgagccaagatcgcaccactgcactctagcctgggtgacagcgagattccttctcaaaaaaaaagcacttggaggaagcctcacagagccctgtgctggaccacaccctggggatccagtcctggcctccagccccatttctgtaccaccctgagaccatgggatcttcctcaggttggattaccttgtatccaaggtgtggaccctatgggctcctgctaggtgtaacttgacacaacgggttccgttgtcaggtgcaatttagaaact

SEQ ID NO: 150443 - DNA, 167 bp, Homo sapiens
cattgtaggatgtttaccagcatccctcctggctttgatccactagataccagtagcatgcctgagatatgacaatcaaaaatgtctccagatattgccagactttctctggggggcaaaatcacccagttcagaatcattgttttagtcttagtgatgatccttat

SEQ ID NO: 150444 - DNA, 570 bp, Homo sapiens
gaaacacagatttcttgtcctctgaattgaaaatgtctggacttttgactatagtcattatttaaatccagattgtgaggtgttttttcacctatcttaggcagcattcttttcttcttttatcctttgtgctttaggatatatttttattgcagagattttatgaattcctgaattaaatgtgaacctatttatgtaacactctcttctaaacattgggttaatatacctgagcacagtttatgaacctttgtcctcttctattccatccattaaataaacgagaggatggctgggcatggtggcttacgcctgtaatcccagcactttgggaggccgaggtgggcggatcacagaatcaggagatcgagaccatcctggccaacatggtgaaaccctgtctctactaaaaatacaaaaaattagctgggcgtggtggcgggtgcctgtagtcccagctactcaggaggctgaggcaggagaatggcataaacccgggagtttggagcttgcagtgagccgagatcgcaccattgcactccagcctgggcaacaataagactccatctc

SEQ ID NO: 150445 - DNA, 373 bp, Homo sapiens
ttgtcagggaaggatcctttgagtaggtaacctttgagatcttcctacaaaagagtcagccatggcaaagattagagggatgagcattctaccatagggaaccatgttacacaaagccccttgagctcttggagtatttaaggagcagacaggtcagtgtggctggaatgtaatgggcaaggggtagagtggtgcaaaatgagatcagagatagtcagggtctaaatcatttaaggctttgtaagccagagtaaggagtttctaggtgtaaacgaaagccagtggagggctgtagcagggggaacgccttttgaaaaagattactgtcgctgccgtgtgaagactggattctgaggataagggtaacaagggt

SEQ ID NO: 150446 - DNA, 221 bp, Homo sapiens
acatgctcatctcatatgcttacatgcccagcctcacacacaccctcctaacaagagtctgtccggtttctcagattcctcagctgtcctgcctgctgatcctcagacagggaaccctctggctgttgggcatgaggagtttgcttcaccactttgggtgaaataaaatgggcctggcacctgggcctggcacgtaggcctcagttttccaggccctcccc

SEQ ID NO: 150447 - DNA, 155 bp, Homo sapiens
tttcaaccttcagtaattgtttttcattgctcactacctgtccccaaagccaatgacatatatacattttaatattgttgttttggcagcctcctatttctaatattccaactgtactaattaacttaggctaagctgcattatagtaacaaatg

SEQ ID NO: 150448 - DNA, 153 bp, Homo sapiens
gagttagcggcacagcctcctgaaagattaggagaagagagtgacatatgcaggactgttagaacacctacaatgttatactttgggagggtcaaaaggaaattgggatggaagaggataagaacattatgtcaactaaccaggcatctttgt

SEQ ID NO: 150449 - DNA, 310 bp, Homo sapiens
gattggagtagatatttagacactgtacagaaaatacttgcttgcagaatagcagatattaacatgtgtatgaaatgtgtgtttttaattaatgcattttcattcactcagaaaagaaaagatcgccgagtttagcttaaatgtagcattgtggcatattaaaatggcattcttagactttccacgttgctgttccttttgccttcactaaacagtgctggcctctcatttatccaagttagaaatctagatgcaattctaaaattgtcaacctagaatcctctaccttcatgcttcccactcaataaat

SEQ ID NO: 150450 - DNA, 205 bp, Homo sapiens
taaaataaattacccagtctcgggttatgtctttatcagcactgtgaaaacggactaatacatctagcttcagagtatagtggtcaagtatatggattctggaggcaactttctgggtacacaccctggcctaggcatttattgtgcatcactttctttgtctgcaagatgaagataataacagtaactaccacatgggactgtt

SEQ ID NO: 150451 - DNA, 443 bp, Homo sapiens
acgcaggcacgacgtagagaaacgccccagcgccgagctcataagaacgcccgatggggctctgcctacaggtctttgcgtgactcaggtctcagttccatggcacctcctcctaggcctctcctgtgcccatcctacctgcagaagcagccgcactccctactatttatcccactgccctgatctccctacaccattctactttcttcccggcactgatgcatctgtttgcctgctcagtttctgattccctccactgagataacagccctgtgaaggcaggtgctatgtctgttgtgttcacagctatttctcctataactagaccctgaagcagcccttggcacacagtaggtcctccctacatatttgttgagtgaatgaatatgtaaaggtttgattttttaaaaagtcaaataaattgggcactgtacttctcctta

SEQ ID NO: 150452 - DNA, 774 bp, Homo sapiens
ctactgttatgaattgccacaacttggaggcttagaacaacacaaattagtactctcacagtcctgaaggctacagctctgcaatcaagatatcagcaaggccatcattccactaaggctctaaggaagaatccatttttgcctcttcctgcttctgggatgcatccactttattagacggcaaactagaaaatgcttcctacagtcgccacataaaaagaattatcatcatgccaaacaaattatcatcggtgccaatgatgtgagaattgagcagaaagagcaatgcaacagtttttcttttctggccatgccaaggtggaaggtgatcttaattgaagaaagaatgctcaaagtaggtatgtgcagtttcagaagtacagctatataatatccgctatgccttgtccagtaaccctctccttaatcctggctctcacgtggattgtccttcctatattataatcctccacatgtctttcctttacagagttaatcccgaattacgtatttcaaatatctaatatagttgtgttagaaaaagaaattctcaagttctgagattatggaatatcctgaaagaatgctaaagcaactataccccttaaagaaagatcattatcaacttgtagaaaactaatcctatagtgtggtgagaatttttggcagtcatattgcaccactctcatacttttaacaatgcatttgtgagaaccacctacaataaaaatatggcaataagattagcaactagtgttatttgttatattttcc

SEQ ID NO: 150453 - DNA, 546 bp, Homo sapiens
ctactgttatgaattgccacaacttggaggcttagaacaacacaaattagtactctcacagtcctgaaggctacagctctgcaatcaagatatcagcaaggccatcattccactaaggctctaaggaagaatccatttttgcctcttcctgcttctgggatgcatccactttattagacggcaaactagaaaatgcttcctacagtcgccacataaaaagggtggggcagtaggagacactgaattcacatatcattgaaaaccaaaatattagaagagcttaagttttaaagaatgctggcaaatgtttaagcgatcagcactgctggtttactataaacataatggactacacgttgagtaccttgacatatgagtaaattcatatagtacaaatcattcaacacagatatcttgagaacaagtgagaagacagccatctgcaaaccagagagaaagtcctcataaggaactgaatcaaacttcaccttgatcttgggcttcccagcctttgcaactgtgagaaataaatgtgtctttatgcca

SEQ ID NO: 150454 - DNA, 394 bp, Homo sapiens
agtccttcaccgctcagtttaaatgctgtgatctctcacagaaaactttctctaattctccctacctgtctgtcctctgacacatctgcttagcacttatctcattattttattgcaattgttgtttatatattaatgccccaggttaccctgcttcaaggacagggcctaaagtatttgaaggacaatgcatttatatatacgggcacaaaagtatttgtcagaaagaaagagagagggagggagagaaatgctcacttccctattatgagcaagtgccataaaaatccttacatctggccaggtgtggtggctcacgcctataatcccagcactttgggaggccgaggcaggcagatcacgaggttaggagatcgagaccatcctggctaac

SEQ ID NO: 150455 - DNA, 898 bp, Homo sapiens
cggctaatttttgtatttttatttgtagaggtggggggtctatgttgtctaggctggtcttcaactcctgggctcaagcaacctgcccaccacagcctcccaaagtgctgggattctaggcataagccaaaatgcaggcccttctaaacaagttaatatattttaattttccagtactaaagaatgtggtaataaataacctttagatgcaagcttttgggtgggtacttctcactctacacattttccattcacacatgcctataaacgcttattcaaaattcagacctctctcctgaattacagttccatatttccaaatatctgaatgtcctcatacatctcaaattcaatatgtcctaaaataaactaactgctttactcctcacacccaatcacacaattttccgtattattctatacatgtgtagtggccagtgtctagaaatctgatagttaaaaaaacatactctttcatttttacctttcatcatctaagtggccattactaaatcttttccatttcatctaagtattttaaaaatcaattctatctcatccatcttgagtgcattggtttagacccctgccatcactgatttgctacagtgttcaccagtctccctgtccttcaactcatcttctcttctagggccacaattaccttaccaatactcaaatattatatgacttccctgctaaaaaaccttcagtggttccttgtgctaaactctcttcagcatggagaaataaacaagaaagaaacaaattttatttctggtttctgattacttttctagccttacctcccactatctcttccccctccacacactaaccctagactctagtcatactaaacaatgtattccatcctgcctctgtgtccctgaatgac

SEQ ID NO: 150456 - DNA, 372 bp, Homo sapiens
caccacactctgcctaaatgccacccccacccccgccagtggttccccactgacctctgtgtcgaggtcagtttccctggcgtgacctacaagcctcttctgagattctgcttctcactccctttcctgtgctgacttccagcactcctggcttctcccctcacattccactgtaacaatctgtgcttctcttgcatatctctggacctttgcctaaaccgttccctctgcctagaagtcatccccctcctctatgcttggtgaattctcccacatttcctaagactcagatcccctgggctcttcactgccaccacagcactgatcacactgggctataactggccacttctgagtctgttttcctgtcca

SEQ ID NO: 150457 - DNA, 398 bp, Homo sapiens
cctgctgcagcctgctgagctgacagaggctgtagagtcaactggaaaggattttctggggctcccctcatcattcattggcatctagagcaacatgccattttctccattttcaagcagctaaaaaggaagactaaaggctcacatttgaaaggactacgattttccaactagtttgagcctgcctgcaagtgagctttgtaaactaagaacagtttccagtgcacactttcttccttctccataaggctgggtaataatctcctttctagaagaaagtcacgtaaatctggggctgctatgaattttcaactggtgtcagaccaacatgagagctaaagtgcacaaagcgaaatgcaggcgtggtgtggcctttacaaaacaaaaccagaaagtct

SEQ ID NO: 150458 - DNA, 748 bp, Homo sapiens
attctttctacactatccatttaatgagcatatgttcagtcgtcagacatgtactaaagtctcaaaatttatatctcttgcccatatctatcatctgaactttagacttaattatctcttattgaccctaccattctatctggatgttcagaaagaccacaaacttcatgtccaaaactaaacttaatgttttcctcatacccatctcataaaaccaaaatcaaacaaaaatatagacaaaacatagaacagcctgttttttcggaatcttcttcctcagtaaataggaagaatttgtgtctttggcacttccattttcttcacaaatattcagtctactgttagagcattccacttttatctcttaaatatttctcaaatccatatactaaattttatctccagtgctatcacctctgagtcagtctggtgtgatacttcacctgggccaccagagttaccctcctgactggtcttgcctttctttactccaaatatattaagccagtatgttcttttttaaaatttggagtttactgcttttaagagaaaagctatagcattcttaacatggccttcaaggcctacatagtctggctcctgccaactgtctttaacttgattttgtaacctgatctctgtattctagtcatcttggccttctcttagttctcaaatgcactttccttctttccacctccttactctttgacagactgacgactctgactcttctttcaatatctat

SEQ ID NO: 150459 - DNA, 190 bp, Homo sapiens
actacaggggcaaaggtagatttgctgtaagaggctatgggtgtatgggagagtaaagaggtaacaggagccagggattcccaagaggtcagacagagagtagaactctcatcacagatgtagcaaggaagctgccctcaggaggctttacaaagaacctttgtcttactcacctctaaatctaccgtgg

SEQ ID NO: 150460 - DNA, 310 bp, Homo sapiens
atgaattttaaattgtttgatcagaattagcaacattagtcactgccaatagccttttaatttccacagagctgccaaggggagcaaaaatagaattgtgaggagagttccagcaggcagatgtgctcctggcagaagaggcctcgtggtctgctggaggtgtcttcaggtgctctggggttggtggagcaaggccagggaggtggtcggggggcaagcggttttagccccagctttccacttcctctgggtggcaagggtttgctgtcccaagaaactgtggatcccggccgggcacggtagctcacac

SEQ ID NO: 150461 - DNA, 487 bp, Homo sapiens
ggtcggccagttatacagctccagttacaacagctccagttacaacagcccagttacaacagctggttatgtcatttctccagcctgagtgacagagcaagactctgtctcaaaaaaaacagacagagagaagagcactgggtgtgacagcagccagaggaggaagacagggaatctctctggagggtccccaagaaatcctctgaccagcagaggaggtcaaggaaagggtgtgaggtcacatgattccttgagatccaggattcacacattcccaccccaaccctgagatagagtgtcaagaaggtagcagcatggccaagtgccacagagtagctggagtggatgaagttggaagaaaggttgcaggaaattgactgtgatagtggtgtcaaatcacagggagttaatgagaaaatggattagagaggaactgtacgctgtaaagggaagagccttttcttctcattgagtatggaaatcatag

SEQ ID NO: 150462 - DNA, 401 bp, Homo sapiens
agaggctggaggcaggaatatctattgcaacggtcccatcttggaaacagaaaacaagaaattgatttaaggaggaatttgtggacactggtgatgagaggagacaaagacagaagatgttgagccaggattaccacagagttttaagcctaagtgaaagatatagggaattcagaagtgagacttaatcttgacagatggtgagtttgctttttgatatgttaagtcactttagatgagcaagctgagtagatagaaatgcaggattaagttcaagagaggcctgagctagacttgtagatgtgctggtcatagttaaagttctttaaacttcaaagagatgatagctaaagttaggagagtgaaatgacttagggaaaattggagagagacaagatcaa

SEQ ID NO: 150463 - DNA, 361 bp, Homo sapiens
atatgaggaaacgacctgcttttcaataatcagtgctgggataatttactctccatctctggggaaaagtaaaagttgacctcttgcttatgccgtaccaaaaatcaattccatgtagcttgtagctctacatgtaaaaagtaaaatagaaaaggatctagaaatactttcataacttctggtggtagggagacatttaaacagaatcaaaaggactaattctaaagggaaagatcaataaactggactatatttaaattaggaatttctgttcgttgaaagccttattaagagagccacacatgtcggacagaagtatctagaatatctaaccaattcttacaaatcaattttttaatgg

SEQ ID NO: 150464 - DNA, 323 bp, Homo sapiens
acatgttaactgataaaacatacaaaaacgtcctgtcttggtaacagcaccaagactattatctcattccctgtattaatcagatcttaaaatcttgaaccaaaaatgggcctgtgttgtttgcagagtatggcaaattgtattttccaaacatggccacattaatacacataatatcccacacgcttttcttacaaggtggtgtagatattcccatatcaatgggtataggaggctctgtttcttccccctaaacctggctggacttttgtgacaaccttgccaaacagaacctgaaagaagtgataccttcagggactagg

SEQ ID NO: 150465 - DNA, 482 bp, Homo sapiens
cacactcccacagtgtaatcatcaaatcaaacctactcacttatggagataaaagaacacttcaaaaatatgtaagcacttttctgtcaaaagggagtgactctccgaagactgtggcagagttgggtctgattcttttaggcaagtgtctgaacatctcacagattctccatctggggggaatgggcactaccaggggtgttgatctgcctcctgtcaattagtgtgtggtcaggatgtggtaaccgaggaggcatttgcaggagtggaaggtgtgaaggatcagggtgctcttgtgggtgtgtttaaactatgttggcgtgctctttacccgactccctctcgctcatttgaagttcgtgtcatgctctgccatcttctgccccttcctgttcttgtcatctgtcaacttcctgtctctgagcaattcagctcatggtcaactggccaaccccagccagctcctgccatgccctgggtta

SEQ ID NO: 150466 - DNA, 297 bp, Homo sapiens
aatcaggctgtaaacagaggtgctaccacaaggaccggaagcagagaccacactggtgctcagctgggttgcaggctctgcctggtttcattgtcggggaagccaccaggcctgcccccagccagcgagatgtcacgcatgcagccgggtgtcatccccaaaactcccgggaaactctcggggcaccagggcaggaagaggctgacgtcaactttaactccggggacttcaaacgaaacttttagaaatgattcctttgccctttacttggtgacgtaataaactgatctttctctg

SEQ ID NO: 150467 - DNA, 305 bp, Homo sapiens
gttgattttaacagtgactgataatagttgaaatatctggatattttttctttacattctcctaataggggtgtcatgtttttcaatgtatttaatatttattaatgaataaaatcacctgttttagtagagttttattttgaagggtaggtaaatagtgaaaacagtaaaaattctgctcagttaaccaacgtgaggccaaaacattcttgggctcagtttcccaccagataagatggagatctgttttctgatctcatttaagagtgtcttttgaccagccccattcttccaaatatgggtta

SEQ ID NO: 150468 - DNA, 210 bp, Homo sapiens
cagctaactttaactagaggctagatccaactaattagttttatattattatacctggcacatggctaaaatttcagaacaaaagccatgaatttctgtttgcatctttctgtatgtttacatatatctacacatgtgtatgctatttgtacatattattctatctccagatggtatttattagaaacagtattaaaggagctcaactgg

SEQ ID NO: 150469 - DNA, 260 bp, Homo sapiens
ttctgcgtggaatgagagacctccaaggctggcgtgtgtgggaggagctggctgtggctggggcagagggaccccagcagagaacaggctgctggatattcatctgtgcctgctgaacccctgctgcagtcaggagccccagctctgccattaagcagtccctggatgacagtgggcgttacctggagtggccacgctcaccccaaggagaggctgtctccagagccccagtgctgggcagctcttcctcattcctcggc

SEQ ID NO: 150470 - DNA, 385 bp, Homo sapiens
gtgtagagactgaaaaaggattcccaactttggtcccttcaaaaccagaaacaaaggtgggggatagcccaattaagtggccctagagatttgcccaggagctggagccttccggagaagtccagttttcctatgcagggagaggactgggagttctctggtcacaagcgttctgcctttgttttcatgaagctatgtctcttacctggtaagaaaaatggaaccgcatgcagctgctgaaaactttaaccagaaacccaaagatgttggcacaaagaaaggaggcctgaagaaaacaagtgaccatgaaaacacatttagctcttaatctgacccatttctcatgggccaggcctggtgccaggaatgcggtgatgaataaggc

SEQ ID NO: 150471 - DNA, 364 bp, Homo sapiens
taaaccacggaatttagtggaaatgaacttttcggtcacctgctatccctttcacatctactcagagtgggaagttttctcctggcagtggactgaagggagatgtggacgccagccttttctgctcagtcctaggaaattgtcctgtgatgacttgatgtcacaaacaccatcctggtgcagacccatggagggtttagcccagtggaggcggccacacttcgggctttgctctaaggagaactaattgcacctgcctgccccctcaaggcctgcctgacacagccaccctgtgggggtgtgggatggttggcgtctttcttccacactcatctcctctttgcaagttgggggtgaggtggga

SEQ ID NO: 150472 - DNA, 348 bp, Homo sapiens
gctgttccatccacctgaacactgttctcaagaacagagatctgtgccggcccctcccaccacaggaacagggctgtgggagtgtgggatgtggatctccatctgagcgcagctccatgtctcctgctccctccgtgctttatttctctcctgggcactaagcacttcgcagtataccttgtccactgttgagctccccactgccgaacaagcgcaaggaggcagagctcctgtctgctacgttcactttggcactcccagctccgacggcagagggtggtgcacaccgaggctcagcaaatacctgccaaacacgtgctggcctaaggctgttggggtgagcacagc

SEQ ID NO: 150473 - DNA, 963 bp, Homo sapiens
cgtgtgaggcatttccacagtgaaagcaccaggtctgtagatctgcaccattctgtccacattgcccttagggctgaggacttctctgtagagctagaggtcttgcttaccgggcttggttgtattctgctttttctaacaggttgattccttttaaataagatatatctttcctttcttggtttcagatagggcttgtattcctccacagctagctggttaacatattttccttcaagtgtttgaatttggcttgcttgaatctggaggctttgagtttatgtgttcttatgaagtctctacctagacctgtgtgaagcaagtccttgagtggagaagactaatgcttagttttcccccacaaggtagggagggaccaggaagcttcagggtgtgggcgtgactgttgagtgctgtgtctgcggtgggaaggccagggaattggaggcatgaatgcagagaaaagaggaggccttttgtgcttggaaggactcttctgggtcagttgtaacctaagcatttatggttatttcccctctgctggataattttccagggaactctagctgtggagtggccacactgggcgggctatggcttcattgcttcttcccgcctccactcccaaatgtttggacactgatctttctccattatctgcagcttctcacccttaatgttacccaggctctgtgaatggatagagtgtgcttcattagtgcacaatttcctggtctccttttgtttcttgtgggaggaaataggagagaaaacaatcaataccatgtgtagcaagtctctgtcctgctgttggttaattcaaacatgtgattccactttgaatgcaaaaatagcaacagcaatcatattctgcttctaattgagtgtagaaattatatgtacattaggcatcatcttgtgagcttgctgtggtctttgggccttagcagctgagctggaacc

SEQ ID NO: 150474 - DNA, 489 bp, Homo sapiens
gtcttgtaatctttttgatttaaaatctattttgtctgattacaatatggccacgcagctttttctttcttttttgagactgactctcgctgtgtctcccaggttggagagcagtggcatgatctcagcttactgcaacctctgcctcctggattcaagcaattccccgcacccccgccctccctagcgctgtgctggacgcttctctgtgaggagagtccctcgccccttcttcagatttgggaatggactctcgggcacctgaagcgcctgctcaggatcaggccggcacctggacatgaatcccaaacagaaagcctgagccctgcctggcgctttcgcggctgctggcacggctgcgcagaaacgccagcgtccctggaccgagcgcggggaggggcaggcttccagcagcgctgtccactgggaagaagacacaacccacatttttagattttccagtttccacgttgaaaaagcaaaaaaaaa

SEQ ID NO: 150475 - DNA, 746 bp, Homo sapiens
aggagctgtaacaatcaccgcgaaggtctgcagcttcactcctgaggccagcgagaccatgaacacacctggaggaatgaacagctctggatgggaggaacaaacaactccagacatgccgccttaagagctgtaacgctcaccgcgaaggtctgcagcttcactcctgaagccagcaacaccaacaaaccccccagaaggaagaaactctgaacacgtccgaacatcagaaggaacaaactccagacacaccatttttaagaactgtaacactcaccgcgagggtccacggcttcattcttgaagtcagtgagaccaagaacccaccaaatccagacacaccaccatgtcacttcctcaacacatggggattagaattcgatatgaggtttgggtgggaatgcaaagcaaaaccatatcattctgccccagcccctgccaaatctcatgtcctttttacatttcaaacccaatcatgttatcctgcattagtccaatctcacaatgctataagaacatacccgagactaagtaatttataaaggaaagaggtttaattgactcacacttccacagggctgggtggcctcaggaaacttacaatcatggtggaaatagaagcaaacccatcctttttcacaaggcagcaggagagaaaagaatgaatgctgagtgaagggaaaagccccttataaaacaatcagatcttgtgagaactcactatcatgtgaacagcatggcagaaa

SEQ ID NO: 150476 - DNA, 556 bp, Homo sapiens
aaaagaaagaccccagctaatgatttcctggtccttcaaaatcccacatttggatgaagggaaagatattataaaatggataacagaatatttcaggggggcagtttccatgatatctgctattgtggtatcctaatttcaagctaaagaaaagaaaaaaaattccactaagccataccaagcaaaatagctactatagcaaatcaataccactcctcctccaaacagatacccaaaggatagagggtaactgtcagatgatgtatcaaaggcacatacatcacaggatttcccaaatcttaatactggacagatctacaccttctctcaaaccaaaacaaattcttgttgtgaattcccaaaaacataaggaaattcctataatcaagacacgagaaatatctagacgttttctgctccctagtcatgcttagagagtaataaaaccaaagaaagtatcatagtgctcacacctttacctgctgattacagaacatgaagatctaaggatgtcctgtaacaagttactggaattaggcaccccttgtaatatgtt

SEQ ID NO: 150477 - DNA, 347 bp, Homo sapiens
ggtcttcagatgggattgcttatctgagaagaaactgtcacactgatctttcaagttcacagtgaggacaagggcctcacccagagcagacccccaggtgatgactgcagccctacctctcgaagtgtcctgaaggagtagacatttcaagtatccatttcttataatagaggttactgactaaatccaacacctggtaacttaaatgtgtgggagccttttgctaccacagagcaggggaggggcaggaagccaaaactggatgcaaggcagagggctgggcttgagctctggcctcagtctctccttgtttgtgaagccaggatgatgccacctgccttgctggg

SEQ ID NO: 150478 - DNA, 446 bp, Homo sapiens
tcgcagggtgaccctgggagtctctctccccgtggccaccaatgccttccctaatggaatgataagggctgcccagcagccttatacaaggagtctcaatcctacaagctcacggaaacccagggaggtcatctgggagcattctacaatgtggggttgggggagaatgcacccacagaatgggccaggggtctccactgcagctcacactggctccggggcccacctgacccctctgctctcccccaagcccctgagctctccccttctagacatagacaagcatagaggctgggcatggaggtcacctgcagtgtgcctgtggatgggccaggacacacaggaaggacaccaatgtgcagagtcccagagagctcggggacacacgggcacatgcagagtggcacttactacacaccctgaaactaaagcccacaagaacagat

SEQ ID NO: 150479 - DNA, 661 bp, Homo sapiens
cttgtctgcagatgcctccaggtgtccgaaccaagtccgaagtcaacgacaagcaatgatggcgatggcgatcctagttaataaaaaggggggagatgtgggtggcaagccacccaggtgccgaggcaagagaccaaggacaccagccgttccagtataataaaatataaaacaagaatagttataccagatatagatcttagatatgattatatatgaatgtcattaatcatcagtttgtagcaattactctttattccaatattataataatcctcgctctattatcataacctaggaaaaaccaggccatacagagataggagctgaggggacatagtgggaagtgaccagaagacaagagtgcgagccttctgttatgcccagacagggccaccagagggctccttggtctagtggtaatgccagtgtctgggaagacgcccgcccgttgccaggcggaccgtggtctagcggtagcgtaagtgtcaaaggaaaacacccgctacttagcagaccgggaaagggagtctccctttccccgggggagtttagagaagactctgctcctccacctcttgtggagggcctgacatcagtcaggctcgcccacagttatccggaggcctgaccgtctccctgtgatgctgtgcttcagtgg

SEQ ID NO: 150480 - DNA, 347 bp, Homo sapiens
ctctgaacctgccagttatgacatgacccattttcaagaggaaaccccggggctcagagagacaaaggagctctgcccaggtcacagggccaaggagtggggcaccctgctctgactgccccaaagccctcatcctccgcaccccactgcctctgcgtcccacagagtctaggctcatttcggctcggtggccagcctgaggccctggggaggggaaggggtgtcaggacgcccaggtgcagatgacctgggaggattctgactcagccccacaactggagcaggagagcaccacaccctcctaggcctcctggagcctcgccaaggccttccttagggtatgacat

SEQ ID NO: 150481 - DNA, 488 bp, Homo sapiens
ctggtttcgaactcccgacctcaggtgattcgcccgccttggcctctcaaaatgctgagattacaggcgtgagccccctgcctggtggaggactccttttttaatagttctggcttactactttcttgaaccctctttcttggtatatgtacaatgaacagagtttgactcatagaatcatctaattgtaggactggcgggacttatgggtttattttgccaaaaccctttattttagacttgtggtaagagaggtctaaagaggttaagtactacttttaatcattgaaggcagaactggttgtaacagaggttttatgattctttgcatatcttgaagcccatgtatctggatgaaattctagcaactcagcctcttccttgaagcgtagttgtcatctttatggcaactgacttttctcctcagattcgtttatctctttgctgggctccaataacatttggtatatacctctgttaccttactt

SEQ ID NO: 150482 - DNA, 296 bp, Homo sapiens
tatctttgcagctaacagtttaactgttaaaagctcaagtgttgggagcagtacttatttatccattttccatttacccaacaaatatttattgcatgcctttatgctccagttactgacaattcagcagtgaacaatagccaagcccaaggagctcaaagactagtaagtacaggattatagtcagccaaaacttgatttaaatcctagctcagctacaagaccttagctaacttaatctctttctgagcctcagatttgtcatctgtaaaatgggaaaaatattacctatttca

SEQ ID NO: 150483 - DNA, 421 bp, Homo sapiens
caggaaagcggtcccggcagagggagcctgtagggtgaaggttctgctgcaccaggtgggacaggggtgaggaggaggcggactggtggctggagccaagcaggaggggagaggagagtggtaggaaatgagtcagaaaggcagagcagggagattattctaggcttgttgccactgagggagatgagaaactctgggggaattttgagcagagaagttacatgatctgacttatgccttaaaaatccttttgttgtttacggaataagcaggtatgtagggatggggtcaaggttagaagcagagagatcaatttaagatcaattatgggaggttatgataagccctttgtgtatctgtttgtcctattagcacataaaggggactcagtggtcttcaacctttagaatacataagatgt

SEQ ID NO: 150484 - DNA, 316 bp, Homo sapiens
caaattatcaatcctgtggagggggtcatagtctgatttatagcctgtcaggcagagggacaagtggcccaggactggcaaccggcaaaggatgtaaacaggaatttatccaaagagaaagactgcctcagtggaggcaatcttgtgggactgggtctttaacctgtggcatcagacatgaactccaagtagacagtgtcagaattgaactgaattgctggacacctatagctggtgttgaggagttggagaagtggaattagagaagacaccaggtatttggtctcaggaggaaaaaagactctttttttttttt

SEQ ID NO: 150485 - DNA, 234 bp, Homo sapiens
tgggagcaggtgcagcctgactcttcactcccagccacgcaggtgaagacacaatagcctttctgcagctcaccactaggcctggagcttggggctttaaaaggtccccatacatcctctgagccaccaaaaactgtttgccaaagaaggcaggggtagaaatagctgcattcatagcctgtgctctgtcatcaggcacgcacagctgggttcacgggatcctggggtagtaac

SEQ ID NO: 150486 - DNA, 446 bp, Homo sapiens
gctgtgtgtacatgcttgtgcatttgtgtgtgtgtgtatgtgcacacaagcctgtgccgtccaagtgcccatgtgcatatttaaatgcgctcacccgtgtgcgtgggcaaatgtgtgcacatctacatgtgtgtcagaattattgtgcgtgtgcctatgtgatgtgatttcaccccacccctatggctgtaggacgaaggcagtacacactgagcaccctgcccatgccctcggtagcactccttctttccttactgttccacagtgtatacagagagacctgaatttaatacccagctttgccagttactcattgcatgatctgaggctggtcatgcaagctctctgagcctcagtcttctcatccgtgaaatgggagaataaggaacagcactggtgtggagtggcattgaaggtcatgggtcataggtgtgtgtgtggctggg

SEQ ID NO: 150487 - DNA, 245 bp, Homo sapiens
aattttggttttgctttgggttcaccttgccatttatgctgcccagggatgccttataaaaatgcagaaaacgaccaggcgtcgtggctcacacctgcccacctcgagctccctcgtatgtggtgtataattttaacatgcgtaggtaattacagtgttggtacacaccacaccacacacacacacacacacaccagcaaacatgcacaacagttcatctcatctcccatcaactctcagatcag

SEQ ID NO: 150488 - DNA, 429 bp, Homo sapiens
atttgttttctttcttacagcaaggcatttaatggttgaaaagttgatattttccaagataatttaaaaattattgatggagtgtcactctgtctcccaggctggagtgcagttgtgcgatctcggctcacggcaacctctgcctcccaagttcaagcaattctcctgccacagcctcctgagtagctgggactacagtacaggcatgagacccattttgtttatattataacccatcagatgttgttatccccattgtaaaagtgagacaactgaggcaaaaagatacaaagtaattttcctacaaatgcacagctaaaattagcaaagctgggctttgagagctggcacactggcttgaaaccataaaataattgcctctattcttaaaaaaagtaagtctatttctcattaataaacacaattaat

SEQ ID NO: 150489 - DNA, 370 bp, Homo sapiens
atttgttttctttcttacagcaaggcatttaatggttgaaaagttgatattttccaagataatttaaaaattattgatggagtgtcactctgtctcccaggctggagtgcagttgtgcgatctcggctcacggcaacctctgcctcccaagttcaagcaattctcctgccacatacaggcatgagacccattttgtttatattataacccatcagatgttgttatccccattgtaaaagtgagacaactgagtaattttcctacaaatgcacagctaaaattagcaaagctgggctttgagagctggcacactggcttgaaaccataaaataattgcctcttctatttctcattaataaacacaattaat

SEQ ID NO: 150490 - DNA, 415 bp, Homo sapiens
acaggaggctggagatgagagtgcagcaccaccctgattcacagtcccatgggagccagaactgtgccatcaaaaacaggggtcagggtacctctctcactatggagcgtggcctggagggcagaggatgcagggtttcctctgtctgtccctgcttgtttgctaagtaacatcagcagctgtctcagctggctattctgttggctaaagtaacacattgatttctcacagtcccagaggctgggagtctgaggtcagggtgccagcaggctctggttcttggtgagggccgtcttctgggttctgtccttagacggccttctttggtgtgtgcacttcgcgagagacagtgacagagggcgcaggcatgagcgctcagtctcatttcctataaggacaccaatcccatcacggg

SEQ ID NO: 150491 - DNA, 477 bp, Homo sapiens
  misc_feature (135)..(135): n is a, c, g, or t
tatgtcctaatcagctcaactgacagtaattttcaaaaaatataccgtcttaatttaaacgaatgaaaaatgtgctacaaaaaacttgaagaagtaaaaacttcagccttggacaataacactagcagaactatntatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacaggtattgtacatattttgggaaagaaaaaaaatgaaagcagttatttgtatatatgtgggagcccatacacatctgatgacagtggtgcagggaaaggagggaggatgattaagccccagccaaaggaaaaataagatgacctaatcactgtctctggtttctctgaacttatttttattttttaaaaattaaggtc

SEQ ID NO: 150492 - DNA, 628 bp, Homo sapiens
  misc_feature (135)..(135): n is a, c, g, or t
tatgtcctaatcagctcaactgacagtaattttcaaaaaatataccgtcttaatttaaacgaatgaaaaatgtgctacaaaaaacttgaagaagtaaaaacttcagccttggacaataacactagcagaactatntatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcaggagttcccaagggttgtctcagccatccacccagacgactcagtatccgagagctgacacacccaacaatgcaactcctatcaccagctcctcaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcattggtcgaaacaaagatcaagcttctgaaattcaggtgacaat

SEQ ID NO: 150493 - DNA, 1273 bp, Homo sapiens
agtgagttctagctctttcaggtcccaacaagagctggttgtgaaaaagagcctggcacgcccacttgcctctgctcccaccctgtggtctctgcacgtgccagctcccctttgctttccaccgtgaggggaaatagcctgaagccctcactggatgcccaatcctgaactttcccaaccagcagaaccatgagccaaataaacctcatttctttataaattacccagcctcagatattcctttttggcaacacaaaaatggactaagagaactagagtagctgatagaattttttaaaagaagggtaaagttggaggaactatactacttgattttgaagctacagtaatcaggacaatgtggtgaagggacagacacgtaagtcaatggaatggagacgagagatttctacaaatatggtcaatgggttttttttaacaaaggtacaaaaatcaatttaatggagaaaagacagtcttttcagcaaatgttactggaatagttgtcatccatatctaaaaaacaacacctcaacctcacatctcatacacagctgaacttaaaattgatcatagatctaagtgtgtgaaatgtaaaactataaacctccttgaaaaaatcatagaaaatcttcatcacctggacttgggcaaagactttttactctaaaagcgtgatccatagcagaaaatgttgataaattgaatttcatcaaaactaaaaatgactgctctgcaaaaggatgatgctaagagaataaaaaagacaagctaagattaggagaaaatattgcaaagaacatatccagtgtgtgttctgaatatacagagaaatctcaaaactcaacaggaagaaaacaagccaattgaaaatgggcaaaatacttgaacagacactttaccaaagtggatatacagatatcaaatacacacatgaaaagatgttcagcatagccatcagggaaatgcacattaaagccacagtgagatatcacttacacccattgaaaaatgactacaataaaaaaaaaatctgatagtaataccaactgtcatcgaggatgaggaacagctgaaagtcatgcattgctggagggaacatgccactgtggaaacaggtgggtgctttcttatagacttgtatgtgcactcaccttatgcccaggagtccctctcctgtgtgttcaacccagagatatgcaagctgtgttcacacaaaaacctgtatgtgaatgattatactagctctctttataattgcaaaaaaaaaaaa

SEQ ID NO: 150494 - DNA, 468 bp, Homo sapiens
agtgagttctagctctttcaggtcccaacaagagctggttgtgaaaaagagcctggcacgcccacttgcctctgctcccaccctgtggtctctgcacgtgccagctcccctttgctttccaccgtgaggggaaatagcctgaagccctcactggatgcccaatcctgaactttcccaaccagcagaaccatgagccaaataaacctcatttctttataaattacccagcctcagatattcctttttggcaacacaaaaatggactaagagaactagagtagctgatagaattttttaaaagaagggtaaagttggaggaactatactacttgattttgaagctacagtaatcaggacaatgtggtgaagggacagacacgtaagtcaatggaatggagacgagagatttctacaaatatggtcaatgggtttttttgtacctttgttaaagtcgacgcggccgcgaat

SEQ ID NO: 150495 - DNA, 931 bp, Homo sapiens
tatagcctgtcatcttcccagaggtgacattgtcatcattccagagaggttattatatatattgattacctttgctggtaggacaccgaaacatgtactctaccaatggaaagccattgaagagacgtaaagcagaatgacatgatcagagctgctatttgaaaatgtcatactgtctttagtgtggcaaatgacttggaggtggcaggaggatggtttagaggggcagataattaaaccacatgatggctgagaagccatggtggcctgttcttcagtgaagtcacgtcagtagaacagtgattaaaagtaaagctcaagtcaggtggcctggaattaacttttggctccaccctttgccaggtttgtaaccttgggcaagttactgactgactgtgtcagtcatctctaaaatgagaataatgctgatgtctatctcatagagttattgtgaagatacagggaatacaggtaaagctgtcttgcatgtactgagtgctcagtgaatgtgagctgtgataaggatgacgattcattcaactacaatgttttgagtatctactatgtaccaagccctcttttaagtgctaggacacccagtgaaaaagcatacaaactccctcttatcctgacgcctgaggcttccattctagtgaggagagaaaaataaatgaagaaaagaaaagataacatcagttcatgatcaatgctatgaagagaaagaaaggagaatgaagggattagagagctctggcaattgttctttaatgtagtcaggaaaggcacatatttaccaaatcctactatgttctgggtactgttctaagattaggattcagaaagcagacaggaatccctgccctctatagctgacctgctcatggaaggagaaacacaaaaaataaataagagatgtgatcgtggggtttaa

SEQ ID NO: 150496 - DNA, 477 bp, Homo sapiens
tgctgtgtcctgcagagctctcagtctctgcacttgaggccctgggcctgcatcaacgtgaaggctcttcagtgttatcacgtggagacagatgataggaatcctgcaaatgagcagaaaggatgtgacgattaaagtttcttctgacggtattacaaactgaagtcagtgagttccttctctactagttttttattgccaactggaattctgcactgtgttgcagagtcaggggtggggagcgtggaattgttcccttactatctgctgctttatcgactgaaattgatcaaggctacaacaaaaacatttctagaaatcatttgaatgcggtaggaaaaactctgggaatggagtcagaagaaagtatattttggagtgtgttttcaggtctaaaaatctttgccagaaatactctttaatggaacctccagactgagtaggaaaacagggcatactgttttttgaaaggcatga

SEQ ID NO: 150497 - DNA, 578 bp, Homo sapiens
gactaggacgagacaagagggacagggaggcttcgcggaaccctacgcccacccgacgcgttcgcccgtccgtttttatttttatttttattttggtttttttgttgttgttctcttcttttgtcttttttttttctttagagacggggtctagctatgttggccaggctggtctcgagtccccgggctcaagcgatcctcccgcctcagcctccggaaaagtgggactacaggcgcgcatcgccgcacccggccaatccctgttttaatccttttccttaaaattgcaaaagtggtgtctttttcctgcagatggaccctccctgatacaggaggagaaaaagagacagacacagggaggagagcactgcacgcagctgaaggcagagattggaatgacacctctgcaagccaaggaacacggagcattgctgggaaccaccggaagaagccagaagacaggcctggagctggctttccctcacagccccagaaggaacccaccctggtgccaccttgatttcggacttctggccttcagaactgggagagaataaatttctgttgctttaaacttc

SEQ ID NO: 150498 - DNA, 546 bp, Homo sapiens
cccaagtagctgggattccaggcacatgccaccacgcctggctaatttttgtatttttagtagagacggcgttttgccatgttggccaggctggtctcaaactcctgatctcaagtgatccgcctgcctcggcctcccggagttctgggattacaggtgtgagccactgtgcctggccagagaacagattctttttgaatctatgcaaataaccatgttgctgtaaacataagaataatcgttatgcagccaacagacacatgaaaaaatgctcacatcatcactggccatcagagaaatgcaaatcaaaaccacaatgagataccatctcacaccagttagaatggcgatcattaaaaagtcaggaaacaacaggtgctggagaggatgtggagaacgaggaacacttttacactgttggtgggactgtaaactagttcaaccattgtggaagtcagtgtggcaattcctcagggatctagaactagaattaccatttgacccagccatcccattactgggtatatacccaaaggattataaatc

SEQ ID NO: 150499 - DNA, 230 bp, Homo sapiens
tactcttttaaaatatttattacataccagatttttacatattcagacatcacgttaattattttgacataattaaaaaaggagtgttattatgtccatttttacagaaagcaaatctgatatgcagaaagtattagtaatttgccctgtaatcagctacgaagttgaagaaattggatttgatcccagagctatatgacattaaggcctattattgattcttctttgcc

SEQ ID NO: 150500 - DNA, 457 bp, Homo sapiens
tcgccgaataactacatcgaggctgcaggcgcttgggatggggcgacggtataacggggtccaacccccgaaagcggctgcctttccgccaggctatagcatttcggagatcaaaaccaagtgagctatgaccgaaaggtaatttacagcaagtctatttaaaaaaaaaaaaaaacagccaatgcattatcaattagagtcctgctgggccatattaacacagattccacttaaaagagacaatcaaaggctcagcaacaaataggaatacatttatgctcttcaaggagccaaagaaaatgcaagaacatcttccctagaaaggcttcctaccctcgcataatactttaccactgctcttgatcaatccaggctgacagaatttcagacattagcagggtcttcccacaattcacagggatgggggaagccatgttacctgtcttaaacaaagcag

SEQ ID NO: 150501 - DNA, 190 bp, Homo sapiens
aattgttattggatatcatcattggcccacgctttctgaccttgggaaatcaattaaggggttcataatctcaattctgtcagaattggtacaagaaatagctgcatgtttcttgacattccacttggtaggaaataagaatgtgaaactcttcagttggtgtgtgtcccttgtttttttgcaatttcct

SEQ ID NO: 150502 - DNA, 396 bp, Homo sapiens
taatttataagagacagggtctatctatgttgcccagctggaatccagtggctattcacaggcttgatcccactacttatcagcataggagttttgacttgtgctgtttccaacttaggccagtttacccctctttaggcaacctggtggtgccccactccacagaggtcaccatactgatgctcaacttagatcggcatagatgctcaacatagatcggcactacagcctagaattcccaaacccaaattcaaattccctgcttcagactcccaagcagctgggactacaggcactgccaccacgcccagctcaggtctatgtattcttttcaactttttgcataaataacagcatatgttcattatcttaaagatcactctataccaatataca

SEQ ID NO: 150503 - DNA, 136 bp, Homo sapiens
ttcttttgaggtaggattcatctgactttatcacaatctcagagaacctgaatggcttgctcatgatcacacctttagatgtagctaaggcaggactggatccaagctttagtactcatttccataaagccatttg

SEQ ID NO: 150504 - DNA, 474 bp, Homo sapiens
gaaagggaggacatgagatatggagggaccaggggtggaatgatatggtttggctgtgtcctcacccaaatctcaacttgcactgtagctctcagaattcccacgtgttgcaggagagacccagggggaggtaactgaatcatggaggctggtctttcccatgctattctcgtgatagtgaataagtctcacgagatcggatgggattatcttgtttctggttttgcttcttcctcatttttctcttgccaccacaatgtaataggtgcctttcgcctcctgccatgattctgaagcctccccagccatgtggaactgtaagtccaattaaacctctttttgttcccagtttcggttatgcctttatcagcaacgtgaaaacgaacgaatacatacaccccatctctactaaaaaatacaaaaatcagctggacatagtggcgcacgcctgtagtctcagctactcagaaggct

SEQ ID NO: 150505 - DNA, 178 bp, Homo sapiens
cacaagaccttcatgtgagtagagggtgccctcagctcacccaccactttcgataaactgaggcaggactgaatgtggaatgaggcaggcctgtttactgtgtccaggagggactgattgggcccatttgagataagttaggtagcaagcggcctagctgagcagggggctaggtgca

SEQ ID NO: 150506 - DNA, 234 bp, Homo sapiens
tacattattccccagcacatttttaaaagaggccaaaagagagaatctgcctaatcatcttgcctctttagactatcagctcccactggacagagtattatttttgtcttctccagctgtatggcacctggcatgttgacgttactcaagggataaacagctcattcattacacagtgtcatgtatattaaataatgtccataacgtcctttgaagatgaaaaccacttcaagc

SEQ ID NO: 150507 - DNA, 339 bp, Homo sapiens
gaaccaacagaaattgcaataccaagtgcaaatgagttggaaagtagaacaactgccagcccctgtcccttcccactctatatccaacagttcacacaggggattggccattttcttcatctttctgtcttttcctacccatccttttagacccaattcaaattaagtcttccataaaagtttcttggtaactctagctctaactgattttgctatttttctatacttggtctcacactgtcaattagtactttaatatatgctgccctagaatgtttcatttgatacatcgtaattccttgatatcttttcccaatggctaactggagttaaatcagt

SEQ ID NO: 150508 - DNA, 362 bp, Homo sapiens
ttacctagctaacaaatatacacatgctcctgttaaaaaaaaaagaacctttctctagagtttaaaaaaaatctggaaaattctttatcctaatgaaaatatatgttcacgtgctttatatttatgttcaatatttttattgggattgaatttcaattatttaatatttaatatagaacgttttatgtctaagtaactggaaacttaaaaataaaaaaaatttaatgaaagtatgtacattgttctttagacataatactactgcacacttaacagattacagtgtagtgtaaacataacttttatatgcactgagaaatataaaaatgtgtctgacttgctttattgcagtggcctggaac

SEQ ID NO: 150509 - DNA, 270 bp, Homo sapiens
cagaacacgttgtagacacaggaagactcaaaattcagctccctcattctcctttctaataaagttacttagagatatgcggaacagaatgaggatgtattataaagaataggaagacttgggatctataaatcaacagatccaacaaaggacatcaggccaggaagtttaaggatgagaacaacatacctagaagccactggcacatatcagagcaggagaagggaatgtctagaaggagggtaggacttctcccagaaaaaaacagta

SEQ ID NO: 150510 - DNA, 183 bp, Homo sapiens
acatctaagatctcaatagaacatgcttttgagactaatcacatttacggaagaggaaaggctactcttgattaatatgaatgtaaagcctttgctattatttagaatctacagggaagttttttggctatctttgtatattgatgcatataacaatttgacagaattagaccaaagatataa

SEQ ID NO: 150511 - DNA, 472 bp, Homo sapiens
ctgcagcccaaggccttggggagctgggatgagcgctggactgtgggcactgcctgccatcctgctgggacatcttggccatggtatcagtgtctcagggccttggctgtcctatctagagacctggaggcccaaactagagcactccagagcctttctagctccaacaccctacaactctacttcccccaacagcttctcgtccattagtaacctgctgcagtgccacataagggagggctaacaacactagaatttttttttttttgagatgcagtctcgctctgtcaccaaggctggagtgcagggatgtgatctcagctcactgcaacctctgcctctcgggttcaagtgattctcccgcctcagcctcccaagttgctgggactacaggtgtgcgccaccacgcccagctaatttttgtatttttaatagagagggggtttcaccatgttggccacgatggtctcga

SEQ ID NO: 150512 - DNA, 402 bp, Homo sapiens
ctgcccagaattcacagtagcattcagctactcacaattcatgtgacctcaagaaaattaacatcattttacttccttggggataactcacctactcctcagtctaacatttaacttgtgcatgataaggaaataagatagttgataaaagaatgttcagctaagtgtcaggtttttggaaaaaccaccaccaccttgcaagagttactaaaagaatgttaaattaggtctggtgtatactttccaacagggaagagaatgaactgaaatatatcctagctgggtgcagtagctcacacctgtaatctcagcattttgggaggccaaggcaggaggtctgcttgagaccaggagtttgagaccagcctcggcaacaaatacgtaccctgtctccacaaaaaa

SEQ ID NO: 150513 - DNA, 120 bp, Homo sapiens
atgaaaaaagtggtttagagaaagtataacttgcaacttgttaaacatttgcttgtgtaaacatttgctgagaatcctcagactctcctgagatattttttcttaactgcacattttttc

SEQ ID NO: 150514 - DNA, 325 bp, Homo sapiens
agatgggggtctcactatgtcgcccaggctggtttcaaactcctaggttcaagccatcctccagccttggcctcccaaagtgctgggattacaggcatgagccaccatgctcggcaagccctgtttctttaggacaatatctgaacacaaaggctaatttagaacttttggattctctccaggttgtaaactgggtgcttgttatcagcagggctctggagtcagactttatagggtttgaatccttatcccccttttcccagctttctaatttgggacgagtggcagaacgtgtctttgcctcagcctcctcctctgttcaatg

SEQ ID NO: 150515 - DNA, 378 bp, Homo sapiens
taccaattaactaacccacttccctcccactaccccctaaccttcccagcctccaggaatcacccctttactctctattctacatgttttaactccataatacattgttattatttttgctttttactgtcaattaccatttagaaaaattacaacattagaaaatttcttatgtttacctacatacttactatttttagcattctttattcctttaaattgactcaagtttccattgttatcattttcctcttaccaggagaatgttctttactactttaagcctcagctatttttatatattatcttacatttacccaaatatttggcaattttggtgttcttcctttagtcttgtggatctaaattactgtccat

SEQ ID NO: 150516 - DNA, 407 bp, Homo sapiens
ggtatacagtggggagccctgaggagtttaaagcactggggtggcatggtcagatcttcatatgacgtaggttacttgttgatgtatgaaggctgaattttaggacggaaagactagaggtggggaagtgagtttggaggctgttgtattaattcagccagtagttgatgagggcttaaagttgggcaggagatggggagatagaaggaatatttcaggaggtagaattaaccagacttaatgattgattggcactgtaaggtgaggcagaggccttttataagtggatgctgagggtggcagagaaagggttgaggatgattcctgaggcctggcacgacagatgggagtgctgtaaattgagataggatatatagggagaaaagcaggttgagaaaagcaggtag

SEQ ID NO: 150517 - DNA, 574 bp, Homo sapiens
gatcttagctcgctgcagccttgacttcccaggctcaagcgatcctcccacctcagcctcccaagtagctgggactatgggcatgagccaccatatccagctaatttttgcattttttgtagagatggggttttgctgtgttgccaggctgatctcaaactcttagactcaagcagtctgcctgccttggcctcccaaagtgctgggattacaggtttgagtaactgcacccagctgagtgcttgcttttttttggtggtggttatttgctcttgctctgctcacaacagtgtggggaatggtgaggccagagatatgtaggggcagttaacaacaacaaaaagtaaacagtgatactgtgaagtgctgttctaagtacttttcatatattagtttattgaacccttacaacaatttctattcacatttgagagaactgaggccgtgagtactttgcacaaaattaatatagcaggactagcttctgagactgtgttttggcttcagagactatattcttaaccaccaaaccatgctgcagattgtaagttgcaagttatgagtgtgattaggg

SEQ ID NO: 150518 - DNA, 519 bp, Homo sapiens
tgtcagaggatccgaaactgacatagaggaggacgaggaggaggacaaggaggagcagcagcagccacagccgcagcaaccaaatgtcattatttctaggtcagtaggattctcagtaacttggagttaaactgtctctaatctacaatgactgggcctggtaataattcacgcctctaaataatcccagaactccatggagaagaaagacaacagggtgcgtgacaatggggcgtttcccgctctgtgaacgagctccagggatcagaggcagctgctcttctcacagctccctgggctggatgaggttctcactcaaagaaggttcaaaccaaatcctgctcctgaggagacagaaggggcaggacttccagaattatttttgagattctacttcattcacaaactctacatatatttatgaagcaacctggcaaatcgtgggtcctgagaaacaagaattaaatggatgaacatctgcccgtggaggtcgcagtcagggaaggggcacagaagcaa

SEQ ID NO: 150519 - DNA, 272 bp, Homo sapiens
cctctccatacctctccaaaaatttgctaacagatatcacagtaattgtcttaatcttttctccaatataaaagtccccagagaaatggccaaaaagcaagaatctggatgtggtcaggtgtttggctaggccttgagttgcttaagaagtggctgagggaatgaatagacaaatgtgtgtagtgagagttagttgaatcttgacacaaagtgtttggctgacctaatgtagactagagtgagttgattttggctgccaacatactgtgttg

SEQ ID NO: 150520 - DNA, 568 bp, Homo sapiens
aaggcaagccaagaatctggagtcagcgtggaactgggaaggactccaggatgagcctggaagctagtggtctagaggctaccacagtgcttagggctctctacccacagcctctgctccctcaaatccattctctagtataaagtcacctagctattaaattgtagaaccagaatttgaactccaggatgggcctggaagctcatggtcaatattagctcacaggttatgtgatgatgagcaattcagagtattggtaaacagatgctaaaggtcaaaggttggcagtgggtccgcagtcacagtgtaatagcaagtgaatggactttggacatacaaaggatcttggttttagcccaattctgccatttgctagttatctggctctgggtaagtcatttaactctcttgtactttgacttcctttcctacaaaatagagataacaatatatactgctaagtgctctttggaccttgaataaaaataaaagagctaacaatatctgacagttacagaatcctcactgagtgtattatatgaattaattcatgtaatcctcataatac

SEQ ID NO: 150521 - DNA, 487 bp, Homo sapiens
tctgtctcaaaaaaaaaagaaaaagttatgaattgtttatttctggaattttccatttaatatttttggacagtgggaagtgaagcctcaagtaagggagggctactctagttaggatatgagtgtgagatttttaggacctaaactagggagataatagaaggaatagaacatttagatatttaggagataaaatatttagggtttagtggataatttagtgattaattggtgtttggaggaaaaatgaagcatggataagaggttaggggatgatagtgctgtcaactgagagagaaaaatcaaaggttttttttaagttttaaggttttttgttttttagatgggaggaggtatggagatgtattcaattggacatgttgagtttgagattcttatgtaatctccagtaagaagttcaataggcagttggatatattactaaaacttgaagactaggtctgagatgaagataaaagctgatgat

SEQ ID NO: 150522 - DNA, 590 bp, Homo sapiens
gagaatggccctcaactgagacagggggactgtaggtggagctggctttaggtgcctgtagggtggagctgcagggaggctgctgggttgctgagtgtggaggtcaggagaggtctggcctggttgtggaaggtaagggagctatgggtagttgaagttatctgaggctctgggactgcaggaggtcccctcaggagggagactgtggggagcccaccggtgtgaggagactaagaaggagcagctagggagggaggaggacgcagaggaagggggtcctggaggccagtgtgaggtggcaggcaaggactgaggatggtgaccacacggagcaactggtgggctgtggccagggctgctccagtgggcagtgagggtgaaaacccagcgaccgctctgtgctgcacacagagacaggcgctgtggctctccccattcgcagctgtgaaagcaggcacagggtggtagaggaagtaggggtgcacagctagtaacagctgagctgggatttgaacccagaccacccgaccccagagcacactttttaacctctgcactatcctgtaatggagcctgagtgaaagcatttt

SEQ ID NO: 150523 - DNA, 288 bp, Homo sapiens
tttctagaacacctcacccaacaacagcagaagatatatttttaaactatgcaggaaacatttaccaggatagaccatgttctaggacataaaacaagtctgagtaaatttaaaaggatctaagacataccaagtatgttctctgaacacaatgttgagttaaattataaacatagagcagaaggcggtatctgggaaaaccttaatttttggaaattaagtaacacacatctaggcaggtgcagtggctcatgcctgtaatctcagcactttcagaggctaaggcag

SEQ ID NO: 150524 - DNA, 289 bp, Homo sapiens
ctcctctcaaggcctccccgctcccacccctggccctgtccgtgtgagatgctttccatccaggagcaccagctccacccatatgagatgctttccatccaggagcaccagctccacccagttaggctcttctgtcatacacaccacagcaccccacacttgtcttcagatgattacatttttaatggtaaaactgtgtgactagtaattaacatctatcactcagattctgagtctaggtttctacaagcttcgacctgcagccccagcttgttcaacctacagcccc

SEQ ID NO: 150525 - DNA, 368 bp, Homo sapiens
acatttctcataatgtatctctgtcattacacaagacatgactgtacccttgtacactgtggaggtggagggggctacagatgggagttgttacttcctcaagacagcttggtgtagaggaagagcttaggagatagggtaaagccagttcactttgaagcctacttctcccccttttttttccacaagctgttgagaccttagtgagctaccttagacctgagtttcctaacacttaaggtaggattaaaaatttttactgcagtctgggcaatatggtgagaccctgtctctacaaaataaaaaaattagccaggcatggtggtacgtgcctgtagtcccagctactcgggagactgaggtgggaa

SEQ ID NO: 150526 - DNA, 249 bp, Homo sapiens
  misc_feature (9)..(9): n is a, c, g, or t
  misc_feature (12)..(12): n is a, c, g, or t
ctcgtgcangangagagacttgctgaaggagaaacaaactctgcagtctgaccctagggaatgagtgctatgcggatcagatcaagagagggcggctgcctggctctgatgcttcccagacttgggacccaaaactcaagaagacaacgaaacatagtttttgctcttgttgcccaggctggagtgcaatggcatcatctcagcttaccacaacctctctcccggattcaagcaattctcctgcctcag

SEQ ID NO: 150527 - DNA, 498 bp, Homo sapiens
  misc_feature (49)..(49): n is a, c, g, or t
  misc_feature (59)..(59): n is a, c, g, or t
tttttggccagttatccatgttttggcctgtcaaaccatttgcatgcanggtttttggnaaacaagtcttcaaattagttgggcacatatataggagtgctattgccagctcatacggtaagactatattttgctttgtgaggaactgtcagtcttccaaagtgatttttacattatattttacatttgtaatgcaatgagatttttttgtcacaatctgcatgcccaggatggaatcatttacattttcatatcctgagattgatttttgtgtgtttgctgtaaagttctatgaatttcgacaaatacacaatgccatgtatccaccattatgatatagagaatagtttcgctgctcttaagaaaaaaaaaatcctgtgtctcaactactcatcccttccaacccttccatctctggcaaccactgatctgtttactgtctctattgccttttccagaatatcatgtaattggaatcataacagtatgtagcttttt

SEQ ID NO: 150528 - DNA, 387 bp, Homo sapiens
cagatgcagcagaagttgcaaaatgacctaactgcagaagtagcagctgctactaaatatgaacctggatcctatatagcttctcctctaggatttacacacaaggaaaatctgaatcaagatccagttttggaagtaacaaaagagtatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatgtagtattttaaataatgtttcttggcctcttcagctaacttttaagtggattttgcaaatgaaaaccagtattactgagtttt

SEQ ID NO: 150529 - DNA, 177 bp, Homo sapiens
ctaagatgtcagcatttcctcttggcaggtttcatatttgcttcttagcacttcctgggagggaaaaacaaaagacaccggcagatgtaccttgccatgggccatggcccttcctgtggcccgtgtacctctcacctgggtccctggagacaccagtatccccactgctacactgac

SEQ ID NO: 150530 - DNA, 299 bp, Homo sapiens
aaaattaaccaggatgtgtggttgtgtgagctcctcattttgctctgcttatatgtttccctggtcttgatggttcaggctgcacttacagagctggggtaacagctctaagccagtcctgaactctgtggtattggattgcaataggtgatactactgtgtactcatgttttaaaaatatatacacagggccaggcacagtggctcacgtctgtaatcccagcactttaggaggctgaggcgggtggatcacctgaggtcaggagtttgagaccattcctgaccaacatggagaaacc

SEQ ID NO: 150531 - DNA, 359 bp, Homo sapiens
tttgtgacactttaagccaggcaggaacatttaaaaattgttattgtagaaaaaaaatgtaatttttcaacagaaaaaaattccctattcatcattcaatatatcatcatttaatatgaaggacaataaaatacactctttaattgcctgaataaatttgcattttagagtaatttaattttcactaatgtaatttgaatgactcaagtgaaacataaaggagttaactgaacagattgattattttgggtataaattttacagaaatcaacaacatttattactaaatataacacacatttttatttctaaaacaaattttgagtactttaaaatgaaaatcatgttgcaaaaatcat

SEQ ID NO: 150532 - DNA, 315 bp, Homo sapiens
gaagcctcaaaagatggaatctatccagctactttggttttgtttacttcttaggtgagtgggggaaaagagaaggaatacagttcaacacgtatttatctgttttctcatgcaattcttacaatagtcttataagacagttattctatttttcacattagtaaaatgaagcatagggtaaatgcctcgtttaagtttgcacagccagattctggcagtaaatccagcaatttttctactacactacattgcctcttgatgttgtcgaaaaactggaaataattagattctctttcagtggttaagatataataa

SEQ ID NO: 150533 - DNA, 395 bp, Homo sapiens
aaaacagttgaggtaatattgggttacaggtatttcttaacataatattgaggaaaaaaataaaggaatcctactgaaaaatccttctgattgatatatatcaaaacaagtttggaaaatttcactcatgattaatttttttttaatagagaaaaaaaaacagaatcattaagttgaggactggtaaaagcaaggaaatctctcccaattcttggccagacattcacaaaaccatgttctctcctattcaacatattgtattcgaaggcaaaccatgaaggcaaaacagatgttcctaaaaggcaacctagagtcagaagagaatgttagtaggtaagctgtcgagatttgggggtatgaggtggtagagtcacctccttttcctccaaacctgc

SEQ ID NO: 150534 - DNA, 295 bp, Homo sapiens
gacagcattaacattctttcggttataatttaaaaccaacttgagatatgatatcatcacagcttgaaacttcataaacaattcttcaggtgaatgtagcgtgttatctaaaattagctaaaagggtagacttgtaagtatacatggaaatgagtactatatatctcccaaaggttttaaattttaactaatcactaaaagagaaactaattgtcagcttgcttaatattgtgcattcaatttcatgttcagagcagcaagttttttaacatgaaaattaacccccgtctagaga

SEQ ID NO: 150535 - DNA, 469 bp, Homo sapiens
ctaacccagtctgagctctcccagagctgaggctgagaccaattctacccaatcacatagcttgagagtaggggagggagtgattacccaggataaaatctttgtattatttcaccaaaagaagggtgttcaacccagcgatctcgttactgggtatacacccaaaggaaaataaatcgttctaccgaaaggacacatgcatccatgtgttcattgcagcgctgttgacaacagaatcaacccaggtgccctcaatggtgaattagatttaaaaaatgtggtacgcatacaccacagaatactatgcagctataagaaagaacaaaatcatgtcctttacagaaacatgggtagagctgtaggccactattgtaagcaaattaacacaggaacagaaaagcaaatacctcatgttctcacttataagtgggagataaacattggatacacatgggcataaagatgagcg

SEQ ID NO: 150536 - DNA, 180 bp, Homo sapiens
tgccccaggacctgctcctactcacacacgcattttcatttgtctttccacccctttcttacttaactcatgtactttggggaatgctaacttctacctccaattctagagatggcccagagtctcagagaatgtttcatttccctcatcagtcttggatttggggaagtcatgtgaact

SEQ ID NO: 150537 - DNA, 497 bp, Homo sapiens
gcagcgatgcaatcatagctcactgcaacctcaaactcctggtcccaagttgatcctcctgcctcagcccccccaggtagctgggaccacaagtgtgcgccaacaaggccagctaatttttaagatttttgtagagatagcgtctcactatactggccaggctgatcttgaactcctgggctcaagcaatcctcccacctcgggagggtgcataatcttatgcatttcattctaatacaaacctaaaactcaaaagccccaacacattttgatcctcaaaaatactttctacttttctagaatccattataaatagatcttcaaatgaagttccaaggtctattatttctattttgctgtcagaagttgggaaagcccagaagaacgttccttgttgctctggaattgaaacagagatcagagtcccagccattggacttgccacttaggagtcagtggacctcagcaggtcacctgctgcactgcagagaccactg

SEQ ID NO: 150538 - DNA, 462 bp, Homo sapiens
tctaattctcttgggtagacatcttggaatgggattactggatcatataataagtatcttttaacttttcaagaaactaccaaaatgttctccaaagtagggaaccatttgtgttcataccatcagtgtatgagcattccagttgctccacatcctcataacacatgacattgtcattctttttaattgtagccattctagtggttttgtagtggtatctaattatggtcatagtttgcatttctctaatgaccagtggtattgagtgtatttttatgtacttgttagccttcccttttttgtgaaacatctgtttaaatcttattggattgtatgtcttcttttattgagttgtaaaagcactttctgtattctggatccaagtcctctgttagaaatgtgctgggattacaggtattagccactgtacctgggcacatcattcctttttaagggtggcta

SEQ ID NO: 150539 - DNA, 325 bp, Homo sapiens
tgtttctgggcagatcacgaggtcaggagatagagaccatcctggctaacacagtgaaaccccgtctctactaaaaatacaaaaagaagtaccgctatggctgcaggaacagggtagcctaaaatgtttatctatggctctagagcagtgctcacagcacagggctcagtcatataagccactaagacgtatttgataaatgtctgttaggtcactgaatgtccctagtgccacatacagataacagacaccaggacaaaaagaaaaagaaaaaaaaaaaggaaacacaaatcttttactcggcacattactatatgcctaacct

SEQ ID NO: 150540 - DNA, 391 bp, Homo sapiens
atactctgcaactttctttaatattttgttaccaacatttatccttatcaaatatgaatctagtggctctttttaacagttgcataatatcctatggtatcgttgtaccatagtttattcaattattccccagctgatataccttcaagagcattctaggtttttaccattcctaacaacactgcagttaaattcttgtacatatattcatgtgtatctactttgatatttgaaggatagattcctaaaaacggagtcagtgactcatgcatgatgtcagatgatactccaaaaaagttgcattgctgtagagtcacacctgcaaaatatgagagtacctgtttgcctcacccctgccaggtgttaggagtctttttaagtgttctctctc

SEQ ID NO: 150541 - DNA, 445 bp, Homo sapiens
acgcccgttaaccactcacagtaccaggtttgaatttcatatcactgaaggaggcactgaagaggcaggaaaaacagtcttgaatactgaacaccaccccttccctgtcgcccccattgcccagcagcagcaacctggtgctgagagtttctgtgtgctggagagagggagggccagcaattgtgaggcattgaactcagcactgcccttgttacagcagaaagcaaaaccggaccaaacccacctaatgcctacccatggagggagaatttaaaccagacctagccaaagcagaattgctgatcccagtggtccgaacttgagtttccacaggcctcaccactgtgacctaaagtgcttggggtctccgaataaatctgaaaggcagtctaggccacaaggattgcaacacctgacgagtcctagtgctaaactgggcccactg

SEQ ID NO: 150542 - DNA, 234 bp, Homo sapiens
cgtgcataaatgctcactaaatacctccctgtgctgggcctgagctaccaaggcgatagggcacagactttgcttctatattttgatgaattatcaaaaataggtaaatccatactgtactagggagcacagtggggttacttctctactgtaagaggtgctgggagtctagatggcttcctttctatagggggtgttagagaaagcctgcacttcggagagacaggcctgtgg

SEQ ID NO: 150543 - DNA, 133 bp, Homo sapiens
ggggtggctctctgagggcattctggcatgctgttttcccagaaaaatggtgaatggatgctgagaagtaaaaccaacagctgtccactacatactaattctttataaacagtgttatgcatgtttatcctgc

SEQ ID NO: 150544 - DNA, 256 bp, Homo sapiens
taactgttccaaaatggttggtttaaacgtgatcaccacttcaatgttgggactcctcgcagaaatcaatatataggttctatgattgcatatagggagagaagtaggtaaacaattagctccaagtatgaaaataatgcttaatctactggtagaaagccaaattcttttcttgatgaaaatgcattacatgaaattttaagtctttctgtctatagtctggttttcttttgaaattgctattagcaacacaata

SEQ ID NO: 150545 - DNA, 445 bp, Homo sapiens
gtggttttcagaaatatccaaaaattttccctcccataaggactgagtttaatttagaggagacataggaaaaggtatgaagttgagcaaagcaaaaacactatggataagaaacagaataggtgcagatttcaagatacaaaatacccaggagagtgaaaatccagatattactgtacagcaaaataaacatctaaaagtaagaaaattgtttttgaaaacaaggactatatggctctaggaaacatagagcaggaggtaagaaaacacattcctgaatctctgggagacaaaaagaggtcataaaaagatatcatggtttgagttctccactgtaacaatgtcatacaaaatgtaaaaccaaggaagtttaaaaaaaagatactctagtccatcaccactgcttgtagagcaaccctctcctagtgactgagaaaaacacttc

SEQ ID NO: 150546 - DNA, 414 bp, Homo sapiens
cagtcctaaccttgagaatgagtataaaaccacagttgtgtaaaatgggttacacagagtcgtggcacaaatgtcagcaatgccgatcttcctgaactctgactagtttaaatatctaaagagaatttccctgtgactaaagccccccccctgggtgtagacagctgcttggtataatgaatccagctgagggtagtgtactcatgggcagattggcatgaatgtggccacctgcaaggaattaaacaagcaggattcttgtggctcaaaaagaccccagtgttcgctcttacacgaactatcaaatttatctgtgcagcactgctattccgaggggagaaaggaaatatgactgtcagtattttccaaataactaaagttaaaaagtttaaaatttttcaaccaggcatggta

SEQ ID NO: 150547 - DNA, 371 bp, Homo sapiens
ccccccagttaaagaaaatgccacaaatggaaaatcaaactgaattttaaagtgtgtatctcaagagctgttttcaaacagaggctctccacatttggctttctacgttcaaacacattgtgctagcagagtaaagagaaggggatactgctgtgctattatattttaataatgtcagtaggtgctttgggctagaaacacagccaactgttctgaaatggaatctagttccgttagagaccttacgagatacagaagcagagactttcgttttatgcagggatttcagttagcaaaatgttttccctcttcctcatttttattcccatcctctcccatctggaaaagtcactaaggtacagaagacataa

SEQ ID NO: 150548 - DNA, 136 bp, Homo sapiens
gaaaggggcacgactttgagccttcctttttgtcccgtggctggtgggaagctgggatgactagagccagaaaagccaaatgatttgtccagtatcccacagcctgtctagggaattccaaacacttaactgcctt

SEQ ID NO: 150549 - DNA, 229 bp, Homo sapiens
aagcaaaaacgatacatcatctggtgaatggataaaaagtgggtatagccaaacaatggcagtaccaaaagaaaaaaatgaggacatgtctaaaggagaaaggagtcaacctgaaagaatttccaatggccaaagcttgaaataatttgagcagctaagtaaacagtattagattcaaacccaaaggataagtatcaatgagtccacgctgatgacaacagacttaagg

SEQ ID NO: 150550 - DNA, 286 bp, Homo sapiens
ggccattctcatgttattggcaggattcagttttgactgagggcatcagttcttctgtgactgttggtgggggccctcccttggttcactgccatgtgggtctctctgtagggcaggcagctcacggcatcagaactcacttccccagagtgaggggtgaaggtggggaggaaaacaagagcaaacaagcaagacagaagtcatagttttttgtaaatcttggaagtgacctcacatcacctgtgctgtgttctgttggtgagaagccagtcactaaatccaatca

SEQ ID NO: 150551 - DNA, 286 bp, Homo sapiens
attggcatttgcttgccagagcataagatggaaatgcaggaagagcctgggaagtgtctctcatatctaaggcagaatgctaccaggggtacaaacgagtagggcctggacatcttagctgctgctggacctccaggtcccaccggccatcatgctgactgaacagccactgtaagaacaggaaatggggtacagacaatgaagtccaatgttaaagaggtttccctgtccaggaaaacaaaggaacaatagactcctacgcttaatattttaagagttttgtggt

SEQ ID NO: 150552 - DNA, 513 bp, Homo sapiens
tgcctgtcactgagatactgatgaggctcttttttgccttgtattccgattctgcccacttgtctaaatcaatgattccactataaatcatgtaaaaagagtaagagtcttttctgagagcgagctatgatctcaaactccagaggttctgttaaaagcatgcctggaagagacggaacatatcaccagactctgtacaaatatgaaggcttgtgtgtgttagcggttcagattgctatttttctacataatataccacagctctgtttcagatactggccttttctccctgtaatttaaaaataaaaaagaaagaaacctctttcagaaacaatgaccaaataccgttcccgcttacgctggctaagtgaaaccaattcaggttttgaggccactttcagtggatgagggagaagcgacacgagctctctgcatccccggccactccttgcccaagcctcagaccacatggaactgaggaagaagggttcatgctctcacccagtcagcgca

SEQ ID NO: 150553 - DNA, 268 bp, Homo sapiens
tacaggcatgagccaccactcctgaccccatttctcatttttaggagtaatttttttctatgtgaaatagactggttttattgatagtgctagaaatgttttgagccttttgttcacttccacctgaagtatttacattatttatataccattttaagtctattattttctctaaaagttaaattccaaactaaattgtaaattatatttgtggttttggtacaaattaaaacaataatagagatcagagaaagaaaaatataactta

SEQ ID NO: 150554 - DNA, 385 bp, Homo sapiens
cccgacttcatacaacaaagctataataaccaaaacagcatgatattggcataaaaacagacacacagaccaatggaacagaatagagaacccagaaaaaaatccatacatctacagcaaactcattttcaacaatggtgccaataacatacaatgaggaaaagacagtttcttcaataaatggtgctgtgccttaagcagaggttaggtttgctgtacagacttaagttgatgccttctgcattgacagtctctagagatttagtctttctagtctttcttctcttcctggtgcagagagggagacaccctgtcaaagagatactcctttacaaacgtacacttcccttaaaaaagggcaacttttcagaactactcctgtatc

SEQ ID NO: 150555 - DNA, 285 bp, Homo sapiens
tgaaaaagactttaagcaaatgaaagagttagccaagtagttatctaggacatttagttagagaggaaataaaatgtaagttaaacaaagtcatgcaaggtatttcaaagactggcttatacagtaagtaaaactgtgttttaggcacttcatatgtatcaaattacttacttctccccacaacccaatgagtaacatagaaaagttaaataacttccttaggtttacactgagggagcagaatttgaatccaaattcaaacccctacaatatcctgcctctgag

SEQ ID NO: 150556 - DNA, 253 bp, Homo sapiens
gctggtaccttcgcacctccttttcctcagcccatcaagaagctcaagatctcacccaaaacactaccaggagtggacactggagatgacctcccgacatccattctgtgtcctcctctcccctgaaatcaggtgagggtgcagcgtggggaactgacctttgcagtggtgcacttgtctgagctaagagtaactgaatccctcttgccagagataagaaatgagatttaacctcattctagccgatggtacc

SEQ ID NO: 150557 - DNA, 367 bp, Homo sapiens
cacgctgattctgtggtcgttctagaggtatcccctctacgccccgctcaccacctctgcctcccgggttcaagcgaatctcctgccttagcctcctgagtagctgggactacaggcgcgtgccaccatgcccagctaatttttgtatttttagtagaggtggggttttcaccatgttggccatgatgatctcaatctcttgacctcgtgatccacccacctgggcctcccaaaatgctgggattacaggcgtgagctactgcacccggcccaacaatctcttacagatggacattgagatctccaattattctgctgctttaaactatacaacagaaattgtgttttgacttgaggcattttgggc

SEQ ID NO: 150558 - DNA, 359 bp, Homo sapiens
ctcagctgccaaagtttcttgaagcagctctgctcaaaggcatatgctgggctcacttctgagggaaatttcctttttggggaagttgaagcaaaggaatttcctgtgtgggcagacagagcttcctgacttgaaggcttcttggaagggaaacagtttcataatgaaatgacaaattaaagacataccagccgggttcacttcaaaacagctattgagagtgcaggcaaagccctattatactccctcacagaacaaaaataaatcccatcctgacaggtttctgtatgccggattatatccgtccccccacacctttcttcacagccttcttcatgcttcccttcctcccacccccg

SEQ ID NO: 150559 - DNA, 107 bp, Homo sapiens
ttctgtgttgctcacagagctttactgccttccagggcttgttttgcacctcctagttgctctttctaatgatttcagtgactgtcccacctcaacataggaaagag

SEQ ID NO: 150560 - DNA, 418 bp, Homo sapiens
caaagtgctcggattacaggaatgagccaccgcacccggccagtaatttttgtatttttagtggagagggtttcaccatgttggccaggctggtctcgaactcatgacctcaggtgatccacccgcctcggcctcccaaagcactgggaggtgcgagcccagctcctgatgttctttaagggtagtgctactggtttagggttacattattgtgggactggtagtcctgtccttagtgtggggttctatgagctggatagtcagaaaaagagcatacatttgggtcatcttgtttttagccagaaatgggtccagacaactctccatgtgaatccaggctaaggtgatttgatagcacttttagcatccttactccaatcttgagtcatgatttgagccacagggcaatctaggcatt

SEQ ID NO: 150561 - DNA, 397 bp, Homo sapiens
agccactgctcctggcctaataattttttatttatttatttttttgagttggagtctcactctgtcacccaggctagagtgcagttgcatgatctctgtctccagaaaaaacaaaaaacaaaaagataatatttgcatcgttattggctcatttttgattacttgggaaaacagctttcaaaagcttaaggtttttaaatacatgtgactttctatattttttttctgatgttctgtttatagcattttgtgtgtgtgtgtgtgtgtgatggagttacactcttcttgtgtaccctggagtgtagtggtgcgatctcagctcactgcaacctctgccttcttggctcaaatgattctcctgccacagcctcctgaatatctgagattacaggcatgc

SEQ ID NO: 150562 - DNA, 136 bp, Homo sapiens
acagcactataaagtccatcctttattccactgatataaacaatagtctttttttttttaatgatggggtctcactctgtcacccaggcaaaagtgcaatggttcgatcataactcactgcagcctcaacctcccg

SEQ ID NO: 150563 - DNA, 557 bp, Homo sapiens
ggatgatttaaaagcatttcatcttcagagaggcaatgtagttggcgtaaagagggagacgaaggagtaagaaagaaaggagagagctatgtagaaaggaagagagatgcagagcatatagttaaatagcctttgcattttctgaatctttcccatagcacatctttacaacatgccactgacatcagaagtctcccttgtgctacagtcaatctcacttttttcagatgagtaaatatattagaaaaaccctagggagaaagttaaatctaggagctgagcagcaattttacgaagttacagttccatgttaactgaaatttcattatccttctcagaaaatacaactatgtcagaatttcttccaaaaagcaccataagtttttgtttttttttctgaaggggttatgtatatcctccgataaagtttctttcccaattccttgatgattttataacaaccttacattttgtctacatagcccctcttatcacttatagcagaaaaaggggaataaagagatctatatgcacagtctcagaaaggggacttccac

SEQ ID NO: 150564 - DNA, 329 bp, Homo sapiens
tgtcggggattataggcatgagccactgcacccggccatctcaacagtcttgagttctggccaggtatcttgtagaatgtaccccacgtctggatttgtctaacatttgtctcaagatcatacactgggaatttgggtttttggtaggaataccagggaagtgatgcacccctctcatgacatatacatgacatcacttggttaggtgtctgccaggcttccccactataagtttgtgacttttccctttccctactttagtcgtgggaagtatcattaagtctagttcaccttcaaagggtggtaatgaggtgggaatatgggggtaa

SEQ ID NO: 150565 - DNA, 322 bp, Homo sapiens
ttaaaatcataaacatcttacagaggcatttctgtgcttcatggagacagatggcatatacaggaaagacagggagctaagacagacaagaacaacatacaggacaaagcacctgattaaacactgcctgaaaatctgattaatcttttgactcaggaatttaaggctagtcaaaaaagccttctgtgaacaccagtgacatttgatgtttgcacaaaaaattaataaataaaaataaaataagggggtaaaaaaaagacacaagagctttgggtgatatttggcactctgcctctgaaaatgatgacaaaccctgggtatt

SEQ ID NO: 150566 - DNA, 416 bp, Homo sapiens
cattatttcacacacttatttgcttgtttcttgctgaattccagattgcggtggtactttaaaaaaaaaaaaagctccaatatcaattttaattttgcttctaaccttttggaccagccacaccctgacacttaaaaaataataatgaaatgttagtataagaaaaattgctagctgactatcccagccttcctccttagtaactaaacctgatttggggcacattgctacctagactgtaatagactttccagtgtcctgcatggccaggtgagctctggacgatgatagagataaactaaattactgtaggctataatttaaggaagcctcctttaaaaaagtaaggaaaggatccttttttcctttctcccttcctcccttcatttctccttccctcccttctgcctccctcc

SEQ ID NO: 150567 - DNA, 577 bp, Homo sapiens
aaaaagagacccctcttggatctaagtgaagaagtgagcttgtgatgaatgtttgttgactgagcaatgacagaggatcacagcacccttgacctgccaggtcacctgatcttctcacagagacacaggtggctcccgattcagacaatatttgaagccctgaaaagcctttgctgcatttccacgaatatctagagtgggctggagaccccttccccgagggtccgctatttctaaccatggattgatcttaagagcaccaaggcctagctctgaaggtcacattcctcaacacagacctttctctaccaagaaagagaaagctgagaattttcccccagaattttccactggggcacaccacattggccttctgtgtgcttgggtttcccgtgcctggggtgtgaggggcccaggcagcttctgcgcagttgagtcatctctcttccatggttccccaccagccaagagaatggtatgaatgtccacaggcggcctcttcatgggggtctcaggaaatgggcatttgagggtcaggtgggtgaccctagtcccccacaaaggtagcatctggtgg

SEQ ID NO: 150568 - DNA, 320 bp, Homo sapiens
gggaccaggtgagccagggaagagttgctctttatttaagtgaaaagggtggtctgggccggcctggtccctctgcccacttgctcacaggccgaattggcagctgggactctgtaggtcactcgctgctcctgccacccgacgtgcacctcactgctgcccccaagaatcctcccagaccttcactggctccatcaccccctccttcagctcctggtcagcatagcctggcgcaggtgtgggctgcctttgccgtggccttgccgtgtgactgtgaacacttgtgagacccttccgagcctcagtttccccctgcgtga

SEQ ID NO: 150569 - DNA, 724 bp, Homo sapiens
ttttcttaattccctgatttgatggtaatttgtaaaagtaaccttcctttatttagtttttcctgtagtatcttagttgccatagaaactgtgtctgcctttttctcattcacattttgaccatttatgtaatattagttaaattaggcaattataataagtgtgacctggaagcatccacagctgactctggcaaggactgagctcaatgcaggagcagagctcagcaggagccacaagagagtggcctggtcctgcagccaggggacctcagcatgacttgcaggggcatcagaatgtagattttccatgggaccttttcattaggtcagctcacaagttctattgtgttacatttggctagttggagttaacattactgagcattttaaaatgtcagggctgtgaaagtaaatgccgtaattccctagttttgaaatttaaacattgcaaaaataatcacttgcttccagtactgttacctgtaccagatcagcccttagatttacgatggtttcattgtactactctgtgccttttgagttttgtcattcatcatcctctgttgtatttgaggcattagtgggtataaatgcatactgtagccagagtgcctgggtttgtgtgcccttactgtccttaactgctgtgtgcctcagtttgcccatctgcaaaatagggataaaagtgcactcagttgagtaagagcattccaatgtatgta

SEQ ID NO: 150570 - DNA, 292 bp, Homo sapiens
aggaaagtgggggaagccaggagtcacaggcctcacccagctcccacacaaactgaagagctgattatagtggaagacaaagggcatataatcttgggagttctagggccctgcccactaccggtccctctccacactactacagctgatgctttctggaaagcacgaccttgtggcaggaggccaaccagcacaaaaatagatcattagaccaccaaagctaaggaccctcatggagtccattacaccctctgccacctccaacagaacaggcactggtatccacagctga

SEQ ID NO: 150571 - DNA, 485 bp, Homo sapiens
tctaatttctgctatctatcttgtgtttatttttgaagaatcagtggatggacagcatggagaaatgacagtattcagaaagctaggcacggtgtcctgcacataatctaagagcaattcatcaatgcatgaatcatagctcctttattcaatcaattttagataaattagctgtctccagcaagtgagagcattgggtccctcaggcatcttcctgtatatgtcaggttaatgagaaaagatttgtatcatttgactttattgacctgagtatcagcaggtcgtaaataaagtgtatgggttcaacacatgggtttgagatgcagacaaaccccgattctggaattatagaagaagcgtttgccctgagccaggcctaatgagtcagcagcagaaaagagttcaagggatgattcagagcatcactacaacagggtcccataacatttcctatcactcaaaggtctcagtcattaagcatgaca

SEQ ID NO: 150572 - DNA, 778 bp, Homo sapiens
atataacatgtgcttacccagaattcctccctcacaactacaaagcttacataagacaaggaaagcaaagtcagccaagcatgtgtcttcagaaggctgaccctgatgaccttaatttttggaatcagggcctgcatgatacaccctatttcttggtaagaagattccaaggatagaggggaaaaggctcaattgtatatgctcacgttcttctctcaatatcaccctcaggaaagtcgttcatttttccaagaggtagcagataaagggaagagaaatcacctcaaaaagtggttggaccagggttctagtgaatttgttttccacatgttgctacaatagtcaacatcctggggaaaatgtgcagcttatgatatcagcaatgttcctatgtgtctttgtccattcaggctgctggaacaaaataccaaaagctgaatggtttatgaagcacaaacatttatttctcacaattctggaggctgggaagttcaagggcaagacgctggcagattctatgtctggtgagggtaagctcttcatagatggccccttcttgctgtgccctccatagtggaaggagcagagccgctttttgggcctcttttataagaaactagtcatatctatgagaaattcaccttcataacctaatactttctatgccttatctctactatagcattggggattaggtttcaacatatgaattttagggggatgcagacactcagaacatagcactacaatattttgggcaccagtgagtatgactctg

SEQ ID NO: 150573 - DNA, 623 bp, Homo sapiens
tttgttctgacaggcagttaatttggggataaacttggtcctgttaaggcttatgcttacctttgttaggggaagtacagagtagcctgttctctagatctcggttagccttctatagtatggtcttagtgatatcttgtttaaagaggtaatttactatggttgatagaatcatgaatgtttctagccttatgaggacactgttagttgttctttatatagctccttggtagttgttctttgcttggtttgtggagtctcatcttatgtgtgtgcagcattatattcagccagactcaagaggacctctatgcagatagcattgtttgtctttctgtgttgcttcttcctttttgatactccgtcccacaaattctagccgcttcagcttccccaaactgttttctgtctctctgctgagcaacacacctccctgttctatagtactgacagtacttccaagtagaaagagagggtgataatagggcttatttcatctgtttgccttctctcacagatcacagttacatgctgtctgttgtctaatgtttggaaatagttattatttgtatattttctccagttttgtagttgtggatggcaggatggccattctgtgtcag

SEQ ID NO: 150574 - DNA, 317 bp, Homo sapiens
gtagtttaagtcctttgccacaatcagttggtctactgaaacagtcctctaaaaggtctcaaatcctactcacactcctgcccattaatcactaacttggaagggtccttgagatcatctacttcaatcccctagacaagaaaccagcttaattctcaaagttcagtgttccttagcactgattactgctttatctaaactaatagcattttccaggtttaactaaagcatatgtgactagaggacaactgaaatacacttctggattcattttcaatggccactgtatttctgtttctcttaaaacaacaaacatg

SEQ ID NO: 150575 - DNA, 434 bp, Homo sapiens
  misc_feature (362)..(362): n is a, c, g, or t
  misc_feature (407)..(407): n is a, c, g, or t
  misc_feature (415)..(415): n is a, c, g, or t
gagcatgtttagtccacaaatggctgggtacatgctcagctgggtcccctgcagtgctgaacactggcagcaaagaaagaccccaagttcaagttcagttaaaaggctctctctggttttcccttcttcctaaatttatttacacatcaattgtccattagcgcttgctttttgctctttaaataatttttttgttttgtttttggataacctgtcatccaggctggagtgcagtggttcaaccacgactcactgtaacccagacctccctggctcattattcagtggttctttctctcgtgcatctccattctgcaaagactcagcacaaatttctctatgccacctttcctggtactcangcatctctgagcactgtcggattggtgcctcttgtccagcacttnggatgcanattcagggcaaaacctggt

SEQ ID NO: 150576 - DNA, 95 bp, Homo sapiens
gagagaatttctgcttccactatagaatatatacataaatgtaaaatacttacaaaagtggaagtagtgtattttaaagtaattacacttctgaa

SEQ ID NO: 150577 - DNA, 227 bp, Homo sapiens
gctttgtccctgactgccactcctcctctccgagcctcagtgctcatgtagaatgaggaccagagtctctctcagtgtcctctaaccaggcagttggctgctactgctggaaatgtcaccacagttacaagtacaaattcctgaaaggccggctattccctggctgcacaggcagtcctgccccaattagcaaatgcatgttctgggtcacattttgtctgctgctg

SEQ ID NO: 150578 - DNA, 366 bp, Homo sapiens
agttccaacccctgaggacaatggggcccacaggctgagcactttactaaaagtgccagagtgaagccagagattgaaagtcaccttcccgctcccagtgtgctgtctgtttcattatacaaactgcctatttgtagtccaggaaagaagacaaacttctccccatttctactgtcagtagactgaggctggaaaccagtatgcggcctcagtgtccttttctagtataccacatacataataaaaacccaggcagataccaggtgcctagccttttcagtcaaacatacacattttagttaaaggatgagaagttgtcagtgagaatttgtacagagttcacagtaagaaggtgaactactacca

SEQ ID NO: 150579 - DNA, 270 bp, Homo sapiens
cctgcagggagctggtcaatgtggccagaaccaagtagggagggagcaggtgctggagtgaggtcagggagtggggcggggccttgcaggagaggtcaggattccaggttttaattgagcgatacagaaagccatcggatgtcgatcggatgcaatgcagagagatgtctggctactgtgcagtaaagagatggtagagacagggctggggtgagcagtgaggggtccctgcagtggatctggagatacattagcatggtctcccgcctc

SEQ ID NO: 150580 - DNA, 195 bp, Homo sapiens
tgtgaagaatatgatagatgtaaattggaaatgagagttcatgagattgactttgaataggcccagaagaagacttctagcttttggcgatcatgagaacattgtatagaaaacaaatgaggcttccttgctgcattgactttaccaatgtatataggaatgctttttttttcccttaagtttttaagatgtatc

SEQ ID NO: 150581 - DNA, 162 bp, Homo sapiens
agggggagtccacaacatgtgagagaaagagttgtccagcatgaaggaagcaccactgtatagatgccagggaagggagcacagagagcagtgaaattggtggaagctgctgaaaccagctcctgaaaacctttgtaagctgtgtcaagggaaggttccatc

SEQ ID NO: 150582 - DNA, 415 bp, Homo sapiens
cctggagctcaagcaacacgtgcacactggagggatgagggtggttttatgaggtgcctgtgcagagtgttgtgtaacacatgggcatatcctagaggttgtatagcacatttaagaatgccctgaaaatttcacaggtatgttggccctggtgcatactcaccatccatgggtttatagtgaaggttgcatggttattcatctgtgccggtgttatgttgcatatgtatgtgtgtgttctaaaggctacatagctttaagcatatcctgagaattcttccagcgtattcgtcatgtactgaaagatgaggatgtcctgcagattatgggtgcttcaggtcttctggcgggtgaatgtgtgtgtgttggggctctagaatatgcttgtgccacagccaagccccttatctctctc

SEQ ID NO: 150583 - DNA, 196 bp, Homo sapiens
tccactatgtccacggttggctctacttacagagggctcgccactggtgcaaggcacatctcataaactggtgaagctggggcagactgcatcaagtagaatgcgggatgagaagggggcaggcctgctgagctccggctgatctgaaatttccagagaacttggaaatctggattttcatgtgaaatacccaaag

SEQ ID NO: 150584 - DNA, 393 bp, Homo sapiens
catgacagtgtagctaccaggtccgttggtttgtactgctacgagtcttgccatgtcgctggcgagtttatgtcatatacgtgtgttttcactttcctattttcagtggcctgggcctcggtgacatctgtgtccttctaagttactctttcagtcttgtcagtgtttttgtccttcttggatatggtgggatcagtagtgttaagaaacccccttaaaaactaaggacaaatgcaggcgccattgctgagcctctcgggatgcctgggcttggctgctaagtgcaccatggcttcccaccactcaggatctgtgggcttttactctaacatggcattttctcagatctttgaaactttgaaagtggaggagcatcggtaatgtatgagacag

SEQ ID NO: 150585 - DNA, 334 bp, Homo sapiens
tgctaggactgtgagtgtgagccattgtgtccagcctctcatgtattcttacacatatgttttgaacaggaccctaaacacaaaaccatgtatacagcaacactttataagtgataagacactttcaaacataattttgactgtatgatttttattttgtgtacttactacatggtatgtgagatttttggtgatgcaggagcattattacacatgtcacagttactagttacagttgatgtagagaacaagaactcaagtaataaggtaaaaatttgccatagagtttaactttttaaaaagtaatgtcgttttattctttgggcatttgcac

SEQ ID NO: 150586 - DNA, 318 bp, Homo sapiens
gttgacaaaccctgctttaggtgtgtagatgctagaaggttttttgttttattttctttcccccagacatctttcatcatcgctttagaagacagcaagaaaataacgtgggagtatgacaattacaactccagataaatgttcgcagcctgtcagaatggaagcctgggcttcttcctctgttccagtgactcaggaggctgaggtgggaggattgcttgagcccaggagttcaaggcttcagtgagctatgatcacaccaccatacttcagtctgagtgacagagagagactctacctctaaaaagtaataaaaaa

SEQ ID NO: 150587 - DNA, 499 bp, Homo sapiens
tggagtaaaatggtaactttaatttaatgacctttacaaggtagctaagtatttccttgtataaatttgatctgtgttacttgagtaggctattctagataggcttctttttcttttgtggttacaactagactacaggctatcatagtgttcattttccctgccgtcacatttcttgacacacagttaggtgcttttggttactgataggagcattgggattcaaatattcttttttccatgtctctgtgttctctggttttctggagtgactgggagcaatgctgcaattgagcctggacaatccaggataggcaaagttttggctcagtcttcaccttgccactttacctttgatgattatactgagaaataaagggtcttcagaaccaaataggggcaaaatagaattcttctgtatatttctatcaatcagaggagaattgtgtgcacaaaccttggtcttcctatgcacctatccatctgactctactctagc

SEQ ID NO: 150588 - DNA, 347 bp, Homo sapiens
agctgatcagtttttattagaattttccatgaaattttaaacaatggtttcttacaaacaaaccagccatcaggaaagaaaggcatgaataatttccaaattggacaatcagcggacaaataagtaccttgaccacacaagcggtcattcataaatcctgtagtgtaggagtttttcatttaagagtttcctctttaaaaaaacgatcaaggccgggcacagtagctcacaccggtaatcccagcactttgggaggccaaggtgggtggatcacctgaggtcaggagttcaagaccagcctgggcaacatggtgaaaccccatctctactaaaaatacaaaaattag

SEQ ID NO: 150589 - DNA, 596 bp, Homo sapiens
tcccagtgggcgtaacgccaagactgggcaggtggggaaaaataccagctcgtgggataaaatggagagttgctcgatgcatatggtgaacctgggtgatttagtgaggattagagagattgaaaggatacgggcaggtgggtggtgggagaaacaatttgttactatttttgaggggatggtggtgaaagggttgcattgcaggtttgcagacaggtgttgacataatcaagcattcatgatagtcctccaaaatatttttggctgcccatgggaaggatgaggaagtttaatggaagcattgtagcctgttttttttgtttgtttgttttgtttttactgttttcggctagactccatgaatgccggatttttctgaggctccgaggtagaaggaggcgtgatgagaatagctcagggaagatttgggagggagctgctaatggtccaagatggatccgtggctgcatctgcaacagcctgctcttccctggcgctgcgtgggggtggggacacgcaatcagtcgcttatattctagaaaatagagtcatgctaagctatcaacatgttttgatttcatgttttctgtgggcta

SEQ ID NO: 150590 - DNA, 482 bp, Homo sapiens
gcctcagcctcccgagtagctgggattacaggcacatgctgctgcgccaggctaatttttgtatttttagtagagacagggtttcaccatgttggccaggctggtcttgggctcctgacctcaagtgatctacctgccttagcctctcaaagtgctgggattgcaggcatgacccactgcacctggcctcttttgttctctggacagggtgccagctctgctgcttcttagccttctcccatggtgtttctctacggggaatacacacccctcccacctcaaaaccttgtcctgtattatgctgactcctgccctcccctcagttctcagcctaggtgcttcttgcacagggagcccttgccttgcctggctcctgctgtggctcacagtgcccttcatgttaccctctcaagcactacactatataattatttgttttctctgtgacttccagaagaggctgggccccaggagagcaggcc

SEQ ID NO: 150591 - DNA, 409 bp, Homo sapiens
ttgaatccatcacgtcttcacggacccacactcaccccatgtcctcacttctccccttccccagcttggagtccacgatcaaccactgtaatctctaccatggcatagatccttatcacccttgacccctcaggcttggtcattcttgcttgactaaatcacagttctggttaaatccttctctctcttcacctgttctgtgcttgcacccatgaggccaaatgtgcttggagaaaaccacagcaccatattgtttgtctcactctaagctgatcacagatcttaagtgggcccttgatgctacctggcagtctcattgtgtttccactgtctcttcattcccaccactctctcagacaactgttgcatactttctacttgctgttcaaacatccatggtctccttaca

SEQ ID NO: 150592 - DNA, 185 bp, Homo sapiens
agcattagcctggcccctgcagccaggaagggcacatggagcatcctttgggctgggacaatcagagggcttactagaggaagaaacatttggctggggattttacggagggttttccaggtgagagactgcagggccagaccctagcagggctgactgcctgcctaggcaggacgagatcagca

SEQ ID NO: 150593 - DNA, 337 bp, Homo sapiens
ataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtggg

SEQ ID NO: 150594 - DNA, 251 bp, Homo sapiens
ctcctgcgttagccttcccagtagctgggactacaggcacttgagcccgggagtttgaggatgcagtgagctatgatagcggcactgcaccgcagcctcagtggcagtgagaccttgtctctcaaaaaaatttgtaaatgaaaattaaaatacccaatgtaaatgacgagttaatgggtgtagcacaccaacatggcacatgtatacatacgtaacaaacctgcacgttgtgcacatgtaccctagaactt

SEQ ID NO: 150595 - DNA, 435 bp, Homo sapiens
tttattagcagtgatgatttcaagggagtattcttttaaagcaaggcagtatttaaatctttcttttaaatcacaagtcccttgagttgatagttataaaactgggttccactgggagttatttgtacatcttcaaggttggcacccttagttgtttgatgtagatgttctagataaaattcctaaagtccagctgttatgatttagcttaatatgtttgtacagaggggtttcctttgtcattgaagagatagagtcaaaacagaattagtcattcttgcatcttctatttatagcccactattattctgatgcattgtcaaagaatgaagtggacaagaatttttcttcctttctttcttttttttgtgtaaacaaaactctttttatactctgtggatttaactttggttgctaacttagtcagacaaggca

SEQ ID NO: 150596 - DNA, 293 bp, Homo sapiens
attcatacaacataagttatcccaagagagttgcaccagagacctagacctaccttgtaaatgaatagttggctatagtaaaaagaaaagataagaaaggccttgtagttgtgccaatttttccactgttgcacagccatcacctactgtgtaatgcataattggcttgagagatgtgaaagggggggacttctaattgtggagaagttaatgacgcacaaaataattaatccagagcctttgcattgtgttgtttccattttatggttttaggaaagagaatgtgacattca

SEQ ID NO: 150597 - DNA, 444 bp, Homo sapiens
ggacatgggatgccagattctaacccaagattgcttgatgtgttggaattataatggtaaaataaggtctgtgccagccactcattaactcatctgattctcacaagaaccctctgatcttggtggcacaatcatacccatttaccaaagaggaagcataggcactttaagtgttctgtactttgcctgaagactcagctagtaagaacagagttgcaagctggacatgtgcagtcagactccaagagctctaaaatcatactgagttcctcttgaatacaaacaaaaggagttaattatatggttcagatctttgatagcatcagactatgatttcctgttgcagccatttccacaaccagactcatgtttgtctcatgagtcaacaagcagctaaccttggctgggagccatgtggctcctttcaagggactatctactgtg

SEQ ID NO: 150598 - DNA, 264 bp, Homo sapiens
ccaattttggcatcacaaacattgaagctgagggagcagcaatgtctaaacattgaaattcttaagttattttgctttggatttgacttgaaacactgtaatttcccaaaacacccagtactttgactgttctgtcagttttttactttgttgcctgtgaaggcttatgtcagcgtcaagctaactggaggcagttttagttcttatcattatttaatgtcatctcccattatgatttctgacagtctctgaatctaacataaa

SEQ ID NO: 150599 - DNA, 334 bp, Homo sapiens
acaaagaatttgcaaaataaccattggtttaaaaagaagtatctacaatcctacattcaacaatatttatcattaaataatacatctcaatcgacagtttaatagcaccaatatagagtggcagaatgaaatcctctcacatttacaattgagaacttctaagaaatatccttggtaattccataaagggaatgttctaattttttacaaaagtaaagttctttaggataaggatttgattaaaacatcctattgataaatttattttgttagttaaatccaaccaagggcatctttagttgtacccttaaaattagagttcaagtagtcaata

SEQ ID NO: 150600 - DNA, 182 bp, Homo sapiens
tccactcatggtagatttaggtagacatacttaaggctaaatttagaaacttagctgcaaaatgatgttttgtatgacattcaaaagctggattaaaaggcagtaaaatctcttgcgttaagaaacgtattgctgtgtggcgataccttgttcgccgccggttgcggtcgcctgttcgaagg

SEQ ID NO: 150601 - DNA, 193 bp, Homo sapiens
ctagctgagccatacatccctcttttgctgttctttaacttcactgaggtataaggttaacccgttaaaatatttcatgttatatggtaaggaaataagagagtggaaaaataagaattggctaatatatattaatacataatgccacacttcatttgctgaaaaatgagttctctggtcaagcgatactccg

SEQ ID NO: 150602 - DNA, 293 bp, Homo sapiens
gaggcagagatggaggggacacaagatacggactctctggtttgagaatctcgttgttcacccgaagtggtaacaattccctgtcccacccaacagcaagctgcagggcagccatctcagcagggggatcttgacccaaatcagtcaggaagttctgcaaatgagcgaggaggaccgtttctcagggctcccagctcgtgatggcagctgtgggttcctgctgagacaaaccaagttgcccttctggctcatggctggcttcacttcccaaatgtaccaagtggtgtctccat

SEQ ID NO: 150603 - DNA, 289 bp, Homo sapiens
ggggagtctgaaagcagtgtgactgcccatggtaaattttttaacaccctgcaggcacaaggggagaaagcctccctttatgtgatccgtttagaggtgcagctccagaatgctattcaggcaggcatcctagctgagaaagatgcaaaccagactcgcttgcaacagcttcttttaggcgctgagctgaatagggacctgcgcttcaggcttaagcatcttctcaggatgtatgcaaataagcaggagcggcttcccaatttcctggagttaatcaagatgataaggg

SEQ ID NO: 150604 - DNA, 449 bp, Homo sapiens
aaaaatgatatttgtgctgagcatttagaagcaggtggaagttttccagctggatcaagtagagggactcctcagaacaaagacagcagagtagaaaggagcagcaaatgctgagagtattgaataattaagtatccctagatcacagcaaggaagcagtaggctggcaaaataagcaggcaccctctgagtgctttataatattccaaagtgaggaatttgaacttatgtaaacctggaacaattaagaaggtttaacgtattccaatttctttttcataaagatgactacaaattgcaaaggataaagaagatggaagatgaagactaatctgtagggagattttaagattgctttgaaagagtagttgttagagtggggggccgggggtagtgataccatttatcagagtaaagaacataggagtaagagtagatttgtggtaaca

SEQ ID NO: 150605 - DNA, 282 bp, Homo sapiens
cagaatccgcaaacttttcaatctctctaaagaagatgatgtccgccagtatgttgtaagaaagcccttaaagaaggtaagaaacctaggaccaaagcacccaagattcagcgtcttgttactccatgtcttttggcaagagaatgaaggaggctaaggaaaagcgccaggaacaaattgtgaagagacgcagactttcctctctgcgagcttctacttctaagtctgaatccagtcagaaataagattttttgagtaacaaataaataagatcagactctg

SEQ ID NO: 150606 - DNA, 349 bp, Homo sapiens
ggactcactgctctgagacttctttcccagatgctgacccacagtatctcagtgcctttcttatagatttacaatgcctttaaacagattttttaaaatatttcttcagcttttctagttgccttaagtggaaagtcagtctaaaacagctcgtatgccattactagaagtagaagtctccttagtgactttttaacctccaaactctcagtcacatctttttagataccaccaatcttttgaaagattttatatttatgatctctatttcttctctgcatagtcacaacttaatccactctagtctgacttctgcctcaagtatccaccaaaaaagataaagctgaag

SEQ ID NO: 150607 - DNA, 407 bp, Homo sapiens
ataatttaaggcttctctgtgaaagcatcttcaggctttgtactgggtaagtggaaaggcaggaaggcacggaaagagaaaaatgtcaaagaaagcttttggtataaaggggctgggaagtcaggaatcttaagggtaacagtagttgggaaaatagcactatggaagcaaaaaatgggacaaaaaggaccagcaagcaatggtgcatgtttaaatgaagggtttgggagattctacaatggtgatatgtaaggttttacagtatacatgtatgtacatacatttagtccagtcaactgcgtaaagagagccaccaggaggtgccaaggagaggaggttgacagctaatctagcgagaatgtgggaatgtggaggtgggggatacagagacaaaggcacatacaaaa

SEQ ID NO: 150608 - DNA, 510 bp, Homo sapiens
tagagtttcagcttctcctttaggtatatgatatagttcagattaatttttgtgtatggtgtgaggtcaaggtcatggtgaataatatttatctgaaaatggttatccacgggagctaagctatgaggaggtaaagacataagaatgacacaatagactttggggactcagggggaatggttgggaagtgggtgagggatgaaagactacatatcacgttcagtgtatactgctcgtgtaatgggtgcacaaaatctcacaaaccaccactaaagaacttactcatgtaaccaaataccatctgttccccaaaaacctatggaaataaataagttatggaacaaatttctaaccattaaagtgatctgaaaatggaatggaaaaaaaaatggatatccagttgctcagcaccattagttgacaagactttttttttttttttttttttttttttaattccaaccaggggtttccccactttttccatttccaaatttttcctttatatcc

SEQ ID NO: 150609 - DNA, 303 bp, Homo sapiens
aacaaagatcccaaaccgcagttcttctcttacccaggcttaccacacggctctgacacacaggggcacacacacacccaagcatgctttcacggggaccaggtaggtctccaacctctgccacagtctacacgcccatggccaccttgcccttccagatggattgatggggcggcggggagaaggctgttataaattaaacatcgagacactgtctgagcaccaggctctgccatccactcattggctggttccctcccaggaggctgcgggcacacagggtgggggagagggcaggggaag

SEQ ID NO: 150610 - DNA, 330 bp, Homo sapiens
gtttcatgctgtctcactgccagctgcaggcttgtaaacacaggggcgctgtagggaaggcccctgctgtcctcattccgggataaacagaggtttacagagccttgtaaaagaagagggttggctcacgaggacttctcttgctcaagtaagtggggcgattaaagtcgaatagaaagttggaaagatccggagagaaacaatgctgtgagcctcttcagcagtggctgagattacaggtatccagaaaagcagagttgagtttctggttccatttgctcatgttgtgcacacctagccagcagacttcagataagtggtggttttgat

SEQ ID NO: 150611 - DNA, 602 bp, Homo sapiens
gagcgccctgcacccgctgtctctcctggtgcaggccatcatgctggccatgaccctggccctgggtaccttgcctgccttcctaccctgtgagctccagccccacggcctggtgaactgcaactggctgttcctgaagtctaaagaaaaacctgcagatgcctccaaggagtccgaaaacaaatccgaagtcaacgacaagcaatgatggcgatggcgatcctagttaataaaaaggggggagatgtgggcggcaagccatccaggtgccaagccaagagaccgagggcatgagttgttccagtataataaaatatataaaacaacaagagttatactagatctagatcatagatatgattatatatcaatatcattaatcattagttttttccaattataatttattccaatattataataatcttcgctgcataatcataacctaagaaaaaccaggccatacagagataggagctgaggggacatagtgagaagtgaccagaagacaagagtgcgagccttctgttatgcccagacagggccaccagaagggctccttggtctagcagtaacgccagtgtctgggaagacgccccttg

SEQ ID NO: 150612 - DNA, 261 bp, Homo sapiens
ttaaggtgcaatgggagataaacaaggagaaatagctttggatttgaggtagcagtgtgtgtattcaggagaaaagtcttcatgaagaaatctgtgtttgaaacgagccttgaagagtggctagggtgaaagtgatcaacaaagacatagaggtaggaaaggtaagatatagtcagagaaaagggcatcattcacttaggatggagtaaagggtagatgagaggagtaggggaaaatatacacagaaaagatctactgggg

SEQ ID NO: 150613 - DNA, 271 bp, Homo sapiens
tgggacctggtcaatggaggagtggtcattaggggcctcatcactcatcactgggaacctggtcagggatgattggtcagtacgtggcctgctggccactatgtgaccttaggcagggggcttttctctgtcacctccttgcctccatctgcagggaaggtgagtcagggcaccctagagggtggctggaaagagaaggtgagaagatgtgttgaatccaatactgcttgacaaacctacaactttacaaatgacctgtgttccacctaga

SEQ ID NO: 150614 - DNA, 185 bp, Homo sapiens
cccttctgcttggagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatg

SEQ ID NO: 150615 - DNA, 589 bp, Homo sapiens
tgttttaagttgctctgagttctgaaatttacatttgcatttacatttggatttcccaaaaggttcttaatccgtatgctaatcggttacgcaaaggagaattagaggggaagttacaaatgcttaacacactaaccatgtgatcttcataaaatagagaatcagatctgagaactccagaaccaacggcagcatcttcccaagtgcccttttctaaaataaaaatctgatggtgttattcccatgcttaaagcgatcaacggattcccaccatttttattccaaacatctcaatgtttgattttaaatgtcctttcgtggcaaaataaaattaggtggctctatgtcattttctagatcacttttttgaaatattctggtccaggaaatctaaaagtgtagaaactattgcctcagctggcagatcttcacagctctgagggaacaccatttgtgatgggaatcacttttaaatgaggcatccaaaatactgggactggggggcagttcagatatacctgcctctggggtcacacagggcattttaaatgatcccggtctccctttcttggggaaggggcacgcaggc

SEQ ID NO: 150616 - DNA, 306 bp, Homo sapiens
tgttttaagttgctctgagttctgaaatttacatttgcatttacatttggatttcccaaaaggttcttaatccgtatgctaatcggttacgcaaaggagaattagaggggaagttacaaatgcttaacacactaaccatgtgatcttcataaaatagagaatcagatctgagaactccagaaccaacggcagcatcttcccaagtgcccttttctaaaataaaaatctgatggtgttattcccatgcttaaagcgatcaacggattcccaccatttttatttgtttgcaggctgcaaacaagagat

SEQ ID NO: 150617 - DNA, 183 bp, Homo sapiens
atccttttcccattagcttttattaataaaagaattacaattaggtcacaaataaacagacaaattattaattacatgatttgaggcttaggatgaaaacttgtcaaaattagtttgatatacagcaaagttatatgacccactaaaaccaactgttcaatagtttttgccttgtgtgaactg

SEQ ID NO: 150618 - DNA, 226 bp, Homo sapiens
tgatacattataaccttcaaatcctttgaccccgttcaagtttcacccattgtctcaatcaggtcctttatagccaaaggtactagttcagaatcacctattacatctagttgtcaggtctctttagtttcctttaatgtgaacacttccttagcgtttccttgacttccataaccttgacacagatgatgactctaggtcagttacttcatggaatgaccatcac

SEQ ID NO: 150619 - DNA, 209 bp, Homo sapiens
ggaataagatctatggactgtcgacgtcagtgccctgactgtggcattgtactatagttacccaaaaggttaccactgggaaacattcagtgaagggtacactggctcttcattatttctcacaactgcaggtcaatctacaattatctcagaataaaatgcttttaaaaattggctggatgcagtggctcatgcctgtaatcccagca

SEQ ID NO: 150620 - DNA, 607 bp, Homo sapiens
agtggaattgctggatcatgtagtcatggtaatttttgttaaataaaaaagtgttttggtactaaaaagaaaagttggaaaaccacctttaaccatttttgaagtccatattccttagaagaactgcaaagctctcctgcctctagtctcttttctcagctccacctctacgccagctcacactctgaccttccacatgccctggtcctgctgccccacgcccctgtggctccctccggctctcatttctacacatctggacagtcccactcactcttcaagggtctctccaagtactttcactgctggagacatggtggcctgaacattatgaagatctttcctgttaatcacacacctgcagattctgattaaaacaccaaacgtatcatttaagtgcataatcaggctcataagaaaataaggggaccctccagggacgaaagtgaagagggagggagctgcaagatggagaagtgggcaaaggctttgatgacagctgccctgagtgggttcaccctctggacacccagtgctcagttcagtgacctctgctcagggaagaggctggtagccctggactttagtgaggcacagattaggaaca

SEQ ID NO: 150621 - DNA, 296 bp, Homo sapiens
agttaagtttagtcacttatgtaatgccactagagtgtgttgagacagtggggaaatggcatgggataatgaagtagatattgaagggatgttcttagtaagatacaaaatgtctaaggttagtcagatttattagaaagcagggaggccgagtgctgggaaggaaaaagagaggtaaatgacctggcaggaacagatgcagtcttgggagaggaaaataaagtacactcccatgactgcatctgttcctgccaggtcatttacctctcttttcccgggggatcctcaagagtgga

SEQ ID NO: 150622 - DNA, 416 bp, Homo sapiens
atgggagaaatggaaagccaaatacccaagctatcttttagttgagctcccttcctgttaaatttttggccgcaagctcttaaaagaagaaaaactgtttggtgctagtttcacaggcttttctggctccctccaacatactgggcactgtgggccaaaagcaaactggacacagagaaggagagacaggttacaaaaatcaaattaaataccaggcaaggaccatataatggatgccatgacagtgtcctgcaggccaggaagagacacttcatattaatgacttggaaccacagcagcttacatttcctagaatgctcaccctgtgccaatgctgcaggccctttacacacacgccacgatgtggtccatgtgatggctctgtgcgggtgggaggtgtcatcatccttgctcaa

SEQ ID NO: 150623 - DNA, 161 bp, Homo sapiens
agaggatcacatcttaccacaggcattctatcacatttaatatcggtatgcctttggataaaggagaaaaaatttgctgccattgggataagtaaggagatctagattaaggaaagactggttttaaatttctcttcatctttccccatctttccctcctg

SEQ ID NO: 150624 - DNA, 719 bp, Homo sapiens
  misc_feature (719)..(719): n is a, c, g, or t
tccaatttctcctcattacaccttagttaaaaatccaaattcctttccttggtcttaaatgccctacacatcagtgattcacaaccctagtcatatattagaatcatctatggaggtttttaaaaaattattcatgcttaagctccatcctggacctattaggtcagaatctggatgtgatgctcaccaaaattttaaaagcctaccaggtgattcttcttttttgtcgttgttggagacggagtctcactctgttgcccaggctggagtgcagtggcgcaatctcagctcactgcaacctctgtctcccgggttcaagcgattctcctgcctcagcttcccaagtagctgggattaaaggcgcccaccaccaagcccagctaatttttgtatgtttaatagagatggggtttcgccttgttggccaggccagtcttgaactcctgaacttgtgatctgcctttctcggcctcccaaagtgctgggtttacaggtgtgagccaccgtgcccggccagttctacactaattctcaaatgagatcactacacaatgagaactttgctatacttaccctgttgccattatagtacaaaaccacaatgtatctgttacaaacattgaatcccgataggtgatcccatgcattcttggcatcaaagatttctcatagacccataagctgtgccctagttcaggtgttccccaccttatttgacn

SEQ ID NO: 150625 - DNA, 243 bp, Homo sapiens
gacatcttctccagctgtctgggaagggctcctctccacgctgtgcccttcccagacatcttctcagggtgggtcctcccccagactccctccagggggaagaaaacaaagtatcatccatttttctggtaaaagtacagtgagacaccagtctcactggtgacagagagagactctgtctctaaaaattaaggagaagaaaaaaaacttaaaaacattaagtgcagggagagaaaaggtggg

SEQ ID NO: 150626 - DNA, 685 bp, Homo sapiens
caaaagactacatataataccatttatatgacataccagaaaaactatagggacagaaagcagatcagtgatttccagggaatggtggtggcagaaggagttgactaccaagggtcacatggaattctcagggtaatagaacagttatttaatttttatggcagttacacaactctgcttttgtgaaaatgcataaaattgtatatgtggggaattttactatgtaaattatatatcaataaacgtgactcgtctaaataaaaaatttgtaccaacaaaataaaggagaaaacaatcatctcaatagattcagaaaaatgcatttgaaaaacttgttaaaaatcataacaaaaataaataaaaataaaaataatatcaacacccattcgtgataagggctcttgacaaactaggaatggaagagattttcctcaacttgataaagcataactatgaaaaatttacagatagtatcattattaatggtgagatatgcgcttttcctttaaaatgttaataacaaagcaagaatggccactttctccagttctattcaatattgttatggaggccctagcaaatataagaagacaagacaaaaagatagtagatttacaaaggaaaaagaactgtatgcacagacaaagtgattatgtatgcaaaaatcccaaaggaatttataaaa

SEQ ID NO: 150627 - DNA, 466 bp, Homo sapiens
ccacaaagagcagacagtaaaacacagataagacagcttgagcacagagggaggtgggagggaaagtctcttaggcaactgccaaactttacccttatacatggggcccagtaaaacagtgggccttggtaagcatattcctttcccttcatgtgtgctaagatagggaagctaaaagcagactcgggggatatgcctgcagttgcagaaagatgtatgggaacagacacacaactctccctcccaggtaagcacaacaaagagacacagaagcagtacaagcctctgataaactctcccactcagaatccttaaaaactcgtggcctgtaagagagtgcagtttctgatctaattcagtcaaaagtccctcccaggtttgaaaacctgttgactgtcgagccaccctttgtgtttctctcctctttctttaattcttacaatcacaaattattttctattaatga

SEQ ID NO: 150628 - DNA, 551 bp, Homo sapiens
  misc_feature (7)..(7): n is a, c, g, or t
agagagntgaatgagaaaagtcccagaagtgcagaagacttgggtgattatctgagggtttctttccttatcacatgacagagctcttgaagccttggctaggaattctaggcttttagattctttgggcaatggctactaaatgttcataatgttgctcagttgcaaaaacaagacattcaaactatagccaggcacgtcactactctgcatctaaacaagaatctctaaaggtggaaagtgaagtgaaaaagtaggcaactcacctgattcttcatgttgtcccacttcatcaaattgctgaactttctgttctgccttggccaggtagatttttgttgactgaaggtaaaataatgatgcttttgcccaagtaacctttgcaagacttacaggttcagtggctaaagccaccctgaaatcaatatactaactgtctgtttactggaagggtttacttattcaacaagagatacgtcatcacaggcctgaaaaatcgatgtgttctcctggcaatcctctctaaacctgcagcacctagataacaactg

SEQ ID NO: 150629 - DNA, 446 bp, Homo sapiens
catgtgataaggaaagatggactcagataatcacccaagtcttctgcccttctgggacttttctcattcaactctctccctgacaccaggcacgtcactactctgcatctaaacaagaatctctaaaggtggaaagtgaagtgaaaaagtaggcaactcacctgattcttcatgttgtcccacttcatcaaattgctgaactttctgttctgccttggccaggtagatttttgttgactgaaggtaaaataatgatgcttttgcccaagtaacctttgcaagacttacaggttcagtggctaaagccaccctgaaatcaatatactaactgtctgtttactggaagggtttacttattcaacaagagatacgtcatcacaggcctgaaaaatcgatgtgttctcctggcaatcctctctaaacctgcagcacctagataacaactg

SEQ ID NO: 150630 - DNA, 435 bp, Homo sapiens
gaaataaaaatttcacttgaagtagattaatcaacttaacaatgacaattggatgctttccagttttaatggtaagggtagaagaaaacaagaggattctggatgtctgaaaaagagtactgggtaggagaaaacgaagtacagaaaagggattgtggtgagttaaaaccatcacaaatcctaagagggattcaacagaaaatgtccaactggtgaactacaatagggtatgcatattaattatattaaaatatggatataaatttcaggaatccagggtggggtaagggtggtaggagaaagcaattttttttttaaaaaaagtaataaactgtctgggcacggtggcttacgcctataatcccagctattcaggaggttgaggcaggaaaattgcttgaacctgggaggcggagtttgcagtgagacgagatc

SEQ ID NO: 150631 - DNA, 245 bp, Homo sapiens
gatttatgaaggtactgtgagaaataaatgaggtaaaattggacattgttgttggatccttggtgtctgtatgaaggtgctgggtcagatacagtgtttggtacacagtaagttgtcaatataaggtagcaagaaaaattgtgcttaaaacgatgcgacccgaatgaaatattaggtcattaaaagccccgtggagcattatcaagtgtgaaaacaaacatttccttttccttagagaacttggt

SEQ ID NO: 150632 - DNA, 274 bp, Homo sapiens
atggagccccggggaagggatgctgagggaccgaggggcatttcaggtgctggagggggaggtgatgagagcacagggaggggccggatgagatgcgggtttagcatttctctgaacataaaatgtacactttcctagtcattcacaaaagcagtaaagaatatggagtaagtacattgtttagtagaaaagagcagaacagacccaagcgctgtctatacacaggaggcaggtggcgcgtgcacggctccccggtgggcctggcggcatctgg

SEQ ID NO: 150633 - DNA, 206 bp, Homo sapiens
tcacagtgagccaagatcgcaccattgcactccagcctgggcgacagaacgagactccgtctcaaaaaaaaggacctggaaatgggttgctggaggataacattttttaaattagcttttgagtaccaccatactgttttccatagaggttgaaccattttacattcctttggacagaacacatgagttccagtttttcaacattc

SEQ ID NO: 150634 - DNA, 839 bp, Homo sapiens
tcagggagaagaaaaatatccctttactcacacaaagcatttagtaggtttagcccctttactgaagaagattggggcatcacctctcacactgctggctccctggatctctgtatattttcctcttccatctttcttcctctcaatctactcacccttcctacccaggaagaggcacaaattcctcatcctcagcagagagatttggtggtcctcttttgggaattccccttacacctcaagtatgtcattacgatgaacattgtatttcccggcgggccattctaaccctgtgctgtgaccaaggagccagcttgctccctctgtccctcagccaccctcggcacggtatcgctgccccgcctgctggcttctttgctacaggatagcaatagcacttctcacatcacatgcagacacaacaataatcagaggaagagacatctgtctttttcttggtttttgctttttttttttgagaaggaagaaatattttccgagaaatttctcagcacacacctctcagaggacattggctaatgctgtgtcacatgcctgtgcttaaaccagtcacctgcaaggggacaggaccgtgaggattggttcactcagactaaaacttgctctttgggcctagagataggctccacctcaaggaagctcagggccatgtgagggaggcaggtagattcctaaacacaattggaattccattaacaaggaggaaatgaatttggggtagacaatagcatctgccacattgactgcaaatgtgaatatgagttagcaggagaaaaggagggtgtacttctaggaaggtggaagggcattcagcgata

SEQ ID NO: 150635 - DNA, 466 bp, Homo sapiens
acttggttgaagctcctttttacaagccctcatagcaacatgtatctctcctgcacatttacacacttaacactcacgtttaattattttttccctgcgttttaattcctgaacctctttattcccgctaacttccactctaacttcaatcattccttcttgaagaagcaaaagctcaagacccagagtctaaagctgcaacagaccaagccacctgtaatatcgggcacagtgaaaatttaactgggcttttattttactaggactgtaatttttgtagtgttctgattaatgcctacaaagttcccaaggttttaaggggttgctccagctttatagtttgcataagtcctgttacttttagcgcattgattttgtggaaaacatggttttccagccacgcattcaggacattattgcagaaacaccggtatcttcctccagaacacaccatcctgttctatcc

SEQ ID NO: 150636 - DNA, 434 bp, Homo sapiens
cttgaaatcctgacctcaggtgatccatctgccttggcgtcccaaagtgctgagattataggagtgagccactgtgcccggcctattattttttaaatattctttatctgtggttggttgaaatgatggatgtagaacccatgagtttggagtgctgactgtacatggggttcatgctagatgagtagatttatgctgctcttgccagaagaacaaaaaccaggtgctagatatgttcatttgcttcatggtggtgacctttttactatctaaatgtgtaccataacactatattgtatacgttaaatatacacaatgacatttctttaaaacataaataaacaggccaagcttggaaggctatatttcaaaacgttatgagaagctctctctgggtgttggggtttgggtattatttctctcttttttgtttg

SEQ ID NO: 150637 - DNA, 436 bp, Homo sapiens
gtaatagttaatagtgaaaaaaggaaaaaggtcttgagatcaaatgagtctgagaacttctaatttattacattctggttgaggtttatcttctgggtaaaacttaatgcttgtattcattacagcaaatgctgttatgaatgtttaaaaacttaatccttaaaacttagacaaaatggtagttttttattatagaatgtggtgttaatttcttcatctagcactttaaatgcaggtattttttttttttcattacaaggaagtaaaatgtacctattctttttcttcatgataccttttttcttggtcttcctcatgttcttctgcctattggtcttcgaaccagaaaactttcagcgtttacccactattttgaacattattgatcggccttcattatttatattagtttctttggacagggtatgctctctct

SEQ ID NO: 150638 - DNA, 250 bp, Homo sapiens
gattttctctgcttttagaaaattgtaccctgttaggagggtaggagacagagacgtcatcttcgtcaagtaatccaaaggatggaatgtcctgagaccaggctatgcccttctcagttgtgagtttaggcacggggtaggtggggtttgagtggctgtggttatgtctaacagctgggctgaagtctccgtctttaagtcgtcctttctatcctttagagcaaaacaatgttcttgtaggcctttcatt

SEQ ID NO: 150639 - DNA, 1154 bp, Homo sapiens
cacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatatt

SEQ ID NO: 150640 - DNA, 1099 bp, Homo sapiens
cacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatatt

SEQ ID NO: 150641 - DNA, 750 bp, Homo sapiens
gggggagggggcgggctccggcgggtgcagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatatt

SEQ ID NO: 150642 - DNA, 436 bp, Homo sapiens
aacctcgggaccttacatccccacgatcacctctggaaagagggatggctgcaaggatttctgctgtggggccctgcctctaaagatacccaatacagtgacagtagccttctcctaccttctttttactttttgctggaatgcagtggtgcgatctcggctcattgcaaactctgcctcctgcaattctcctgcctcagcctcccgagtagctgggattacaggcacgcaccaccacgcctggctaattttgtgtatttttagtagagacgggattgcaccatgttagccaggatggtctcgatctcctgaccttgtgatctgccgcctcggcctcccaaagtcttactttttaaaatgtcttataattgttgattaaatgtcagatgttgcatgttaaagaacagtagaaactgaggtaaatagtatttatatc

SEQ ID NO: 150643 - DNA, 266 bp, Homo sapiens
agcttattttgggagaggccagccgccatgtcatgaagacactcaagaagccctgtgaagaggaagcaaggcctgccaacaacagccagcaccaactttccagccaagggattgagccatctcacagtggatcctccagcccccaccaagccttcatatgaccaaaccaacaccaacatgtaactgtgacctcatgtgagtccccaagccagaatacccatctcctgtctcagaaatgatgagaaataataaatatatgtgctcac

SEQ ID NO: 150644 - DNA, 332 bp, Homo sapiens
attctcaggtgtgtgttgatagaaacgtctgggaaaattgagcctcttggctttgcatctgtttatcatacacaagcattcattgaatgatgtgctttgacataacaaaatctgtacaatcatcaacacaattaagacccattatgaatgaacgctttctcagatgagcgaggggtgggcagaaggcatggcccggaatgtcattattcccttgtatcttcaacctcccaggattttacctaaagaaaggagagtcaaggagagatgtttatgtgccccaagggccatgcttttcagtagcaagaggtccctgcctgtgatagaaaaaaaga

SEQ ID NO: 150645 - DNA, 191 bp, Homo sapiens
agaggtggggctctgtgtgtcagccttcctggaaggcacttaaatgagttcacagaaggcaaagtgaaggacatacgtaggtgactcgagtgtccaccatcgacctgttctgcaacccagctgtcaaaatcctgccccaagctctttgacataagggtacttctggtagaatttttttaaaacttaattac

SEQ ID NO: 150646 - DNA, 523 bp, Homo sapiens
ggactcattccaggagagtgccgtgggggtgaggctgtgccactctgggcctccgcctcaagaaggcctgacagcctcggtgtttgctcccttgggagctttgagcaccactcaagtcgtccaggtggagaggccccatggagagggacaggccctgagatcacctggaggagaagcgaggcctgaccatcacagcatcagagccaagcctccaatggcttcatccccaggaccatcttctcaagagaccccaagcaagagcagcagaagacccacccagctgagccccgccaccccacagagccatgcaaggtcacataatggtcatttttagggcactgagtttgaatgaccagaacagagacttgctgctcttgaggacatgaagaaggtgccccagcttctcattcctctctgcccaggccagtgatctgaggctttctgtgggaaatgaaacatagctcctgcctggcccttaggatacacacgtcattcaaaatccctagcctaagaaaatcaatgc

SEQ ID NO: 150647 - DNA, 553 bp, Homo sapiens
tttagacagagactccttctggcctgagtgatgaaggaagactgtctcaataaataaatacataaataaataaaattataacaatctcagaaggcatgacacctctaggacccattctcatcctacatcctcctctttctggtgctgagaaaaaaaagaaaggaaaaagaaaagtcaaaagaagagggaaggaactggtggtgattgactagcagactggctgaaatcagtgggaacccgtatggctgactgcaatccgcacagaacgagcttgctgatgtcacagcctgaatttccacctgctgtttcatactaacgccaccaaatttgcacatgcaacccacgaagaaccttggagataaccggacatgattaaggactttctagacttctcctttctttccaccaatcacccgctaatcccagaatcctccccctaaaccttttctaataaaagtactgccttaagaccagcaaagagagacagatttgagctggattcccgtatcctcgtgggtcagctcacaataaagctttccttttctcaaaacct

SEQ ID NO: 150648 - DNA, 849 bp, Homo sapiens
  misc_feature (248)..(248): n is a, c, g, or t
  misc_feature (283)..(283): n is a, c, g, or t
  misc_feature (297)..(297): n is a, c, g, or t
  misc_feature (300)..(300): n is a, c, g, or t
tgcggagccgccggagacggtcgggtttgccagggccgggcgggaccgcggggaccatggcggagccgcctcggctacctctgacttttgaggatgttgctatttatttctccgagcaagaatggcaggatctagaggcatggcagaaggaactttacaagcatgtgatgagaagcaattatgagactctcgtctctctagatgatggacttccaaaaccagaactaatatcctggattgaacacggnggagagcccttcaggaaatggagagaatcacaganatcaggaaacatanttngctcctctgttgatatgcattttgatccaggttttgaggaacagctgttttggggaagccagcaggctatgaattcaggaaaaactaaaagccatttccaattagatcctgaaagccagtgttcctttggatcctttgtttccttcaggcctgaccaaggcatcaccctcgggagcccacagagacacgacgccagggctcctccaccactagcctgcggccccagtgaatctaccctaaaagaaggaatcccaggtcccagaaatctggatcttcctggtttgtgggacgtccccgcctgggagagcacccagcacccttggcctgtctgcggggaaagctgttgggagaacaaccatttagtaatgcaccagagaggccactcaaaggaccggacacgtagggcctgggagaaattcaacaagagggcggagacgcagatgccgtggagcagccctcgggtacagaggcacttccggtgtggcgtgtgcggtaagagcttccgccggagctggtgtctgctgcgccatctggcggcccacacgggga

SEQ ID NO: 150649 - DNA, 440 bp, Homo sapiens
tagagaaggggtttcaccatgttggccaggctggtcttgaactcctgaactcaagtgatccgcccgcctcggcctcccaaagtgctgggattacaggcgtgagccactgcgcctggtcagaaaagctgcctaaacagaaacaccattgaagaaaaaagagattgcagtcttctctgtttctgccatgttgaagcttggatacattgcttttgtgtcttctgtagaagaaatcatttgatttgtttatttcttttctctgcaatatgtgaaaagtaaatgttggtggtgtctagtttattttaaaaaaaatagtgcattcctcaatgcagttggaagggctaagatttaaataacattgaaaattataactgaaataaagcagagtgcgccctgaaccccctcccccctccacccccaccacctccgctcccacccatccc

SEQ ID NO: 150650 - DNA, 527 bp, Homo sapiens
  misc_feature (510)..(510): n is a, c, g, or t
  misc_feature (518)..(518): n is a, c, g, or t
tagagaaggggtttcaccatgttggccaggctggtcttgaactcctgaactcaagtgatccgcccgcctcggcctcccaaagtgctgggattacaggcgtgagccactgcgcctggtcagaaaagctgcctaaacagaaacaccattgaagaaaaaagagattgcagtcttctctgtttctgccatgttgaagcttggatacattgcttttgtgtcttctgtagaagaaatcatttgatttgtttatttcttttctctgcaatatgtgaaaagtaaatgttggtggtgtctagtttattttaaaaaaaatagtgcattcctcaatgcagttggaagggctaagatttaaataacattgaaaattataactgaaataaagcagaattcctgacttttctattgttcagtaagttctattgatttcctctgtgatatctttggcaggcagagtctcccttcattattctaaatttggtgaaataaaaattgtattagtttttaataaaaagnggcctcgntggcctcaa

SEQ ID NO: 150651 - DNA, 2308 bp, Homo sapiens
tctatcatttatgagtactatgtccataggaaagccacttcaactcactgtactttttcttacctgtaagagatcaaacctgataaagtatcaggtttattccagctctaacactctgaaatgccacaaaatgcactccccaataaattaagattaaaggaatgcccaaaccccaaacatgatcattgtgatcatttcttatgaaacataagaatgagacataagaattttatatgagatactggcagaatttgctgagtcagtctcaggcaacatttaataagtaaatatgcagctaagcagtggactataatgcttttacacagccagaaaatagcaatattcctaaaattaatgaaagcatacacaaatccactcaggatgctaggacacaggcagctgaatgatatgagcttataatctattcttcccagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaagtaagtgagttacaattccattaatgtaatataaaataaggttccctgtttcactaacaataccacccaattcaattcacaatttaaagtcataataataacagtagcatgtctaacatcttgggggcactctctatgtgctagatattaaagtaaatgtgttttaaatagatttttactgaattatcttattaatcactaaaacaatcctatgaaataggtaccattattttctttacttgacatataagctaattgaggcttatggagattaagcaatttgtcttagattatgctactcttaagtagtaactctcaacctgaacccagctttgtctgactccagaacacaagtttttaaccaccatgatgggtgaactctatcactgtgccaagtattaaaaacatgcagatgaggcagccgatgtctcagccagcacggagctcagggattgagcagggaaaccaacataccaacaataatactggaataatgtaagtgctacaaagtggttggatcaaaggacatttgaacgtgaacatttaaataaaaggaaaaagccacaggccaatttattccaataaatcaaacttctcatgttgccatgttccaggtcttttacctatacacataccgtttttatataagtgtagttgtagtttagatacaattcacattctgctttttcactgaatatgtgttaaatttatatgtgcctttccatagtgcttgtaagacattacattttgctgaaggtaggaaatatatcatcatttttttccagaactcaaatatttttcatgtgatgtactttagcaatcattcatcgctccatctcataaatacttagcacttacactgtgccaggtatcttctgaggcctttaataagaaataggaactcattgctttgtaggctttttcctgtaaggatttctactttatttcttcttcttctacccttggggggtaacgatagtgtgtctttggagcctggtggggagaaatctctcttctcaattatttattcatatcagaattttagggttccagaatcattctcatagctataaagtagcattgatagtcccccacagagaggtacctaccaattgtcctgtttccctcttcacagaaattgtgttgtatgtcattatcttgtggggtaatttgtgttgaagaaggaaagccacattgctccaagcaagtggctttcagattggatcacttgtgctggaaatgaaattgacactaggttggcagcacggaatggtggttaaatgcttgggccctggagcttgacagcctggttttacattcttgctgagcaagtttcattcttcttactttacaaggctgttgatgggatggaatgaaatgaggtaagttcagcataagaatagtacctggcacaaaagaactcggtctacattagcttatgttgttgctgttgattgaatgagctcaagctgggactatagatattttacacaaatgtcattcactgcaatttaataactagcagaaaacaatacaaacaaaaaagaaaaaacaaagcattctatcaacaattatacaatgacggacatctaggaattttagtggatatgtttcttaagttgctgtgtgtcgtaagatatgtttttatactatgaagccccttgttaatgccaatattgttaggctatg

SEQ ID NO: 150652 - DNA, 664 bp, Homo sapiens
gcggagtcccagcccggcagagacagggcactggtttccctctaccagagttcctgacccagccgagaacaaaccgcgaagcaagttcagcccaacaacgatggtgaaaagggtcctcctgctcacagtgtgaataacaggtaaaaaatggggatggggaaaaaaactttctaatccactccctggggtcatgttgagggcaagttattagaaagcagaatccataggcaacaaagttaagtgtgtgtgtgtcatagcagcctgaatcgcacacatgccttttccttttgattttctcagaatatgctttcctaaccaaggtaagcttgtagggtgggagggagagaggggaaagaagggagggaaagggtgcagagaagggcttggaggtaaatgtgaccataggacccctcctccctttagttcaatgagcccttcacctgtaattgtgcctggcaaaaatcgtgccttacaaagatactagacttctggatggcatactccttcctctgagtatccttatggttagaatattgtgttgaatcatcgcactggaaagaacttaattgagggttcagctcaacttttatttgtttctgcaaagtgacagaaagcatgccccccaccaaaaaaaaaatgaattttcaatataagcgctcaccaa

SEQ ID NO: 150653 - DNA, 2407 bp, Homo sapiens
cagggcactggtttccctctaccagagttcctgacccagccgagaacaaaccgcgaagcaagttcagcccaacaacgatggtgaaaagggtcctcctgctcacagtgtgaataacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaagtaagtgagttacaattccattaatgtaatataaaataaggttccctgtttcactaacaataccacccaattcaattcacaatttaaagtcataataataacagtagcatgtctaacatcttgggggcactctctatgtgctagatattaaagtaaatgtgttttaaatagatttttactgaattatcttattaatcactaaaacaatcctatgaaataggtaccattattttctttacttgacatataagctaattgaggcttatggagattaagcaatttgtcttagattatgctactcttaagtagtaactctcaacctgaacccagctttgtctgactccagaacacaagtttttaaccaccatgatgggtgaactctatcactgtgccaagtattaaaaacatgcagatgaggcagccgatgtctcagccagcacggagctcagggattgagcagggaaaccaacataccaacaataatactggaataatgtaagtgctacaaagtggttggatcaaaggacatttgaacgtgaacatttaaataaaaggaaaaagccacaggccaatttattccaataaatcaaacttctcatgttgccatgttccaggtcttttacctatacacataccgtttttatataagtgtagttgtagtttagatacaattcacattctgctttttcactgaatatgtgttaaatttatatgtgcctttccatagtgcttgtaagacattacattttgctgaaggtaggaaatatatcatcatttttttccagaactcaaatatttttcatgtgatgtactttagcaatcattcatcgctccatctcataaatacttagcacttacactgtgccaggtatcttctgaggcctttaataagaaataggaactcattgctttgtaggctttttcctgtaaggatttctactttatttcttcttcttctacccttggggggtaacgatagtgtgtctttggagcctggtggggagaaatctctcttctcaattatttattcatatcagaattttagggttccagaatcattctcatagctataaagtagcattgatagtcccccacagagaggtacctaccaattgtcctgtttccctcttcacagaaattgtgttgtatgtcattatcttgtggggtaatttgtgttgaagaaggaaagccacattgctccaagcaagtggctttcagattggatcacttgtgctggaaatgaaattgacactaggttggcagcacggaatggtggttaaatgcttgggccctggagcttgacagcctggttttacattcttgctgagcaagtttcattcttcttactttacaaggctgttgatgggatggaatgaaatgaggtaagttcagcataagaatagtacctggcacaaaagaactcggtctacattagcttatgttgttgctgttgattgaatgagctcaagctgggactatagatattttacacaaatgtcattcactgcaatttaataactagcagaaaacaatacaaacaaaaaagaaaaaacaaagcattctatcaacaattatacaatgacggacatctaggaattttagtggatatgtttcttaagttgctgtgtgtcgtaagatatgtttttatactatgaagccccttgttaatgccaatattgttaggctatg

SEQ ID NO: 150654 - DNA, 525 bp, Homo sapiens
attaaaagattgttttctgtcacctttattttgattcattctttaactccttcaatatgtatagtattttatatttttatatcatttaaaaagttatattaggatcataaaaattttttgagtagaaaaagaaggcatggttatacccattttgtcaatggggagactgaagttcccgctgatgaaatcagctccctaagaatttccagaattaagaggggaagcttcaagaggattgatggtctttagtctccaagccaggtcttttcccaacatcccttcttgcctcttttttatttttgagtatatgttgtcaaagttctgaatgtaaaaagcaaaaatctatgtgtcttggattaaaaaataaaatttcaaagacaagtatattcaaatatattaaaataagtttttcagttaattttctactagcattatattctcctatttagtgtctttttgcactaagctttgtaaacattatatgatattaaataaaatggtagaactattgaaatgttaacagta

SEQ ID NO: 150655 - DNA, 326 bp, Homo sapiens
ccttaaaacaatctctcttctacttttccatctgtgacctcttctctagcttagagatctgagccgggaatttgaaaagcatcctctattcctttttccctcttaactacacttctgttggtcacaaaatcctctcaattctactcataaatatctctggattccttttcctccattcttctccagaaatatttagaggcagaattgagatttggggtggtacctaaattttcagtctcatatcctgactagttgtatctaccagcactcaatgttggtacctaatttaagccaggactgaactgatgtgactcttctcatataat

SEQ ID NO: 150656 - DNA, 243 bp, Homo sapiens
ttctttgggttgattttaattgctgatcactgagcttcctgtacctagacagtgtcatctttctctagatttgggactttttcagccatgatttgcttaagtatgctttctacacccttttcttcctcatcttcaggaattcctattatgcagaggttagtctgcttgatggtattccacaattcttgtaggtcttctttacccttttttattcttgctcctctgaatgggtaatttcatatg

SEQ ID NO: 150657 - DNA, 219 bp, Homo sapiens
cgtgggtccttacagaggtgtgtgtgcgtggttctgcagaacaccagggcccgccaccctcttcctcctccatctgctccatgtaggtctccctccctagcctaggttatcagttttctgaatgccctgttgatgtccccaaccaccctggaagccccagcaggtgccccacagtgcaaacaggcggaaaggctacaaatctgccaaggaagccccaca

SEQ ID NO: 150658 - DNA, 231 bp, Homo sapiens
caaccataagtatgtgttaaatttaatgtgaagtgtgagtaaaaatatctttaggagaaaaaagtctgtgttcctcatatcttggttggaggcgatggtcaggaaaggcttaataaagggaaggtatcagttgagaaaagccttgagcagcaggcatagtttttttgatagactgagatgggaatggagctgcgaccagttatatcggggagtatgagggaacacacacag

SEQ ID NO: 150659 - DNA, 338 bp, Homo sapiens
aaatacctgccaatgatgggttccaactcattctgtcactgggcaccttgcaattcaaggtgacctgcttcttagtaaacaggcaatagaacgttaatgatcagccgaggatggaaagtcacaaagctcagccctctcatattgagaagaaaaacaatgaaattctgagagagctcagaatttccctggaggcagggtgcccaaagctgcatatttactgcttcaagcccttagcaaaagacaaagggttggggtggggggcgtgcttgtcaacccagacagcatctccatctcagttttgcttgtgtttttgtttgagacagagtctcactctgtta

SEQ ID NO: 150660 - DNA, 481 bp, Homo sapiens
ctcccaaagttctgggattacaggtgtgagccactgcgcctggcagaatgtttgattttttttttaagtggacatcaaatttattttcagttaaaaatgctgaaagtaatacatttttacttcatctgtcatagtgaatgttgataatgataaaatcttatttctctaagcactttgccatagctaaataccttagtaaaacatgcgatagacaagggtccggtcactagccacagaaaggctgtcactgttatagcagaatgtaatagggaaggaacattttatgcctcaataagaacagtgtatttgcttgagatagtaataacctctgagaagctgattaattggtaatcacttaagttagatgattttatattgtttgatgtcttataatctaaacgtccctgtgctcttttagagtgtctgccttgaccagtcagcatttcaggagggattgtgactgtcagttaagtgctttgaa

SEQ ID NO: 150661 - DNA, 503 bp, Homo sapiens
gcctgtaatccctagaggctgaggcaggcggatcactgaggtcgggagttcgggatcagcctgaccaacatggagaaaccctactggaaatacagagttagccaggcatggtggtgcatgcctgttgtccccaggttgttcaggagcctggcaacaagagcaaaactccagctcaaaaaaaaaagaaagaaaagaaagctggagctggtggcttaggccatcacctttcccttggctggaactactggacagaccccttttgagattgtgcctgtggtgctgtggagatgtgtgtagtggtctaagctctatggtggagcttgtgtatttgcttgagatagtaataacctctgagaagctgattaattggtaatcacttaagttagatgattttatattgtttgatgtcttataatctaaacgtccctgtgctcttttagagtgtctgccttgaccagtcagcatttcaggagggattgtgactgtcagttaagtgctttgaa

SEQ ID NO: 150662 - DNA, 665 bp, Homo sapiens
acatatcctcgacacccccccgacgggacggcaggaaaacaaaccttacttgtaactcaaagcttctttctgaagttgattgcaggtctctccagccccggacctgggccctgcagccaccaagatgctgatgcctaagaagaacggaattgccatctatgaactcctttttaaggagggagtcatggtggccaagaaggatgtccaccttcctaagtacccagacctggcagaagacaagaatgtgcccaaccttcacatcatgaaggccatgcagtctctcaagtcttaaggctacatgaaggaacggtttgtctggagacatttctactggtaccttaccaacgactgtatccagtatctctgattacctccatctgccccgtgagactgtgccttccaccctataccacagtcatccagagactggcaggctttggcctaaaggtctggagggtgagcaacccgcaaagctcacaaaaggggaagccaaaagacacccacagacagagtgctgtgtcccctggtccgatgagaaagccgaggccggggttgggtcagcaaccaaattccggtttagaagcagatttggttgtgggtgtggtcagtgacctcagtaaaactggagaggattattttgcattgaataaacttatagacagaaa

SEQ ID NO: 150663 - DNA, 577 bp, Homo sapiens
aaccgtccatgggatagctgcttcctgaggaaaaaacaacgccaagcgaacgccacactcttgcctgtaggaactgctgggtgcccactgtactctgatcacttctcaagggtttctgatggcccaagatgctaagttcctccacgcatcgtcagggcggctttaacttagccaagcaggagagctccgtctcctattgcactccactcatcccccgtcccagcatcccatgtcctgagctcctagacatgagcccttgtgcccatttcattgatgggaaaactgagctgcagcaaagggaagtgactggagcaattccgtacagttcgtgataggcccagagcaggactccctaggtgtgggcactgctacaccctaatgagcaccacaggggaaatccacgctgactgaagcgtgggagagccatggaaaaagctacaatgccaaagacgttttttatgttgtcactgataagtgagctgatttaactggcctcctgtgcgcctctaatctaacagtgtggtgagtcataggcccagtcgttggccccgttagccgggcatggtggcagacacct

SEQ ID NO: 150664 - DNA, 461 bp, Homo sapiens
ggagtgctgtagaggcaggctcatcttctgcctccctctgagtcctcatgtgagaaacaggaaatactgatcaaaggcctggtttattttcataaaaccctcccgaaagtcctctggatgaaggtggatagagtcagctttacaggccccactaagtgctgcaaagatgagcaaatacattgtttttgctggcagctggccaggggtttaatgtgactcaggactgaggacagctagaaggtggcaagtaacaagaggcccacatttggtgacagtggtactgcctctcaggggcccgctgtcattaacttttgagaagaggggtctgtgggcccatctggaagccctcttgtgcaggtgtgagcaggtgtgagcttggcagatgtgagcaggtgtgagctcagggcgctggaaggccctgctagggagtgggacggatccagccttccagctggtacata

SEQ ID NO: 150665 - DNA, 285 bp, Homo sapiens
acagacaacagtgatagaaggaagctcgtgtcaaggtccagatgagggacccagacaccaaggaagcccagcatgggggaagaaacccagcgaagctgctgtgttccccttttgatggagagatgagactggctaggcatgagagtgcagagacctcaacataagccccttagtctaaaagaaggatgtagcctcaggaagggccctcagtagggaacacagggttttctgagctggctgccagagtgggaaatgaacagccacctcctgtactatggcagcagg

SEQ ID NO: 150666 - DNA, 613 bp, Homo sapiens
acccttgtccctaaatccttgttccagataaagctgaggagcctgtgctgggactgggttgtggcttcttgggcagggcttactgggaccaaggatttaccagctgtcagaggactgtgtctcctggagctgttcaccagccagggctcagccctcagagcctcatctgggccaggacagagctttcttcacctgatactcagagtggagaggacagaaagacaagctttgtaggccatcacccaactgccttaggaggcttaggatagtccatagaaagactaatgtccccagaagcagaaacagaagagagaagatgtaccaggtagcagcttgtccacagggatctgacgtaaaggtgctttctcatggaagcaaattaataataaatgctgtttgtgtgaaacctccactgtgccaagcattaggtcaggtgactgtgaataatttaacatttattcacagatagcatgaaaagccacagtccatttgccatttagcttatttgattgagagaaaactgaggcacaggaaggcacagtgactgagcaagagtcacacaaacacaaaggggagatcagggtcacatgaggtctgtctgtagccacaggcc

SEQ ID NO: 150667 - DNA, 447 bp, Homo sapiens
ggtgttttaaaaaattctaaaagtaataagatttgcatagtgcctatacttttagattcactgtttttccacacaaagtccatgtttgtatttttcagtaaatatgtattctaaaataaactaggcactttttatttaggcatagtaaaccatgaattcctctttactccatcacttagaattcctatctgaagcatgatagtaggagagccctctcctgataacagtagatctgtactacaagtatgctagtaaggaaccctactaaaaacagctattttgaagaaataatgtacttctttggtaagtattaggtatgtttaaataggtactagtatggaaaagttttcttagatatgattttttaaaaaagaaacaaaaatggactgttttctacaaatcacagtgtagattttataagagttaaagtcaaaatatatttggagc

SEQ ID NO: 150668 - DNA, 304 bp, Homo sapiens
atgctgggtaggcagtgacaggtatgctgttcagggaatactagatgactacttttgaactcagtccttgtcaaacctctgacagtgcagtattgccaggttttaaataaatgaaaagcgaaagttccaatttgtcaaaacaggtacaacatcagagtaattagtagagcaaactctataggtttcaacgtaggatttcattaatagttagctgtgtttaaatatggtttaaagattaatcatgtgggaggctgaggcaggagaatcgcttgaacccgggaagcagaggttgcagtgagccaag

SEQ ID NO: 150669 - DNA, 333 bp, Homo sapiens
tccctctgtagtacagctttatctattgcacacactttccttttcagtattcaccccccattcacggctctgtcctgtctgttcctctctttccaactgccatggaaccctgtggtttcaactttcaaactttccatggttccttcccttccaatgaagaaaaattaccaaaaactggatcatcacagatgtgtcaaacagccttccttcagacttcagactaacttcaacatataacaggtttcaagattacttaccagggtatggaaaaatagcctatatttgtctaccttgtgaccaggacttcattttcattgcctgttctgatattac

SEQ ID NO: 150670 - DNA, 195 bp, Homo sapiens
ggttaagaggaacctggcttctttacatctgtgttcaccttatttgtaaaactagggtataattgtactttcttaataggtttttgtggttattctgacaaataacataatggcacagaatgcatttagcatgctgcttacacatactacgtgttcaataaatattagctattctccttagaggcaagtcccagg

SEQ ID NO: 150671 - DNA, 170 bp, Homo sapiens
ttatagcaatcaagagaaatataccaaaagaaaaacagacaatcgatagaacagagtccagaaatagaccaatacatagaaagttaattgactttttatgaagatacgaaactggattaatggaaaaaggaaacaccagtggtgctggcacaaatggctatcaagatgtt

SEQ ID NO: 150672 - DNA, 321 bp, Homo sapiens
agagtaaaaatctgtctcaaaaagaaaaaaatgtacttaggaggggttaattgtggcgtgtttatggaattctttccttattctccttttagtggggcaaagagaagtaagattcttaaactcaaaaatataggataaagaaacttacagagattttgctttttaaagcattgatcttacgctgtctaggttttaattttgttttgctttgcttttctacacagtttttaaagaaatatttcaagaaatgttggttatttattaaacagggatatttgtacctatgtggcaaagaggcatatttggaatattctctggcaa

SEQ ID NO: 150673 - DNA, 297 bp, Homo sapiens
accgcgcccggcctttctcttgatttttcattcaatttacaacacgttactgaggacaacagtgtagcctggttttgacaaaatttttttattgtcttcatcattttgttgtattctgagttctttcacatagttcttttttttgtgttggttacttagaataagaataatctcaaaagtattgtcagtgttcatagtttgtttttttttttgtaaaaaacccatttcagatttttacctcctaaatgattagaatcagattaaaatagttttgtttcgagtgaaaaatgctgtcag

SEQ ID NO: 150674 - DNA, 174 bp, Homo sapiens
catgacaaaagtcgtgaagagggtgactgaggtttctttggcaatctctgcagtgtgtccaggctcagaccagggagggattcggagctcacaagccataaggcagtacccctaccgcccaggcaaatgagactcatgggtgaccaaagccatcctggtgacccaggacctggc

SEQ ID NO: 150675 - DNA, 487 bp, Homo sapiens
ggagtgaagcagagacaagaccactatcactactgagcctgataaaacattctagcttaatactatcttttctatttttgacacacagtctcactctgtcgcccaggctggtgtgcagtggcacgatcttggctcactgcaacctgattttaaaaatggctctgtcgactgtataaagcactttgtcttttccatcattaatttgatcagaaagcagaccactgaaaacctttcctccaaaacaagagtcagcaaactttctgtaaaggactagggagtaaattttaaattttgcaaggcagacagtctgttgcaattactcagctctgcccttatagggagaaaataaccatagtcaatgtataaatgaatgggtgtggctaggttccagtagagctttatttacaaaagcaggccattttttcccacagaaatgtgatagaaataatttgtgctgaaattttcagctgttgcagagtttttcacc

SEQ ID NO: 150676 - DNA, 234 bp, Homo sapiens
gcccggtgccactgcacaggaatgtcctattttaagcattaccaagtagaaagtcgggacaaattactcagctctgcccttatagggagaaaataaccatagtcaatgtataaatgaatgggtgtggctaggttccagtagagctttatttacaaaagcaggccattttttcccacagaaatgtgatagaaataatttgtgctgaaattttcagctgttgcagagtttttcacc

SEQ ID NO: 150677 - DNA, 266 bp, Homo sapiens
aaaaaaaaaaagtcccatgagattctcatttaggcagaaaccccatgtaagatgccctaagacaatgtttctgtatgctatcatgagtcctaatcaaaatcacttcctaactgaaatgtcaattagtccttctgaataaaacatagttgtttataagtcttggtgtacctgactcactcattttagtgcatcgaggtaggtagattggagggtgactgaggggagggcactgtcagttgtgaggttgtcttctaacagagtatgta

SEQ ID NO: 150678 - DNA, 356 bp, Homo sapiens
ctcaaactctaggcctcaagtcctcctgctccgacctcccaaagtgctgagattacaggcatgagccactgtgctcagccccaacaattatttttgacagataatagggatgtctccttgctctctgtgtctggccaagtagccccaggtgacactcgtttttttttgtttttgagacggagtcgtgctctgttgcccagcctggagtccaatgccgtggtctcggctcactgcaatctccgcctcctgggtttaagtgattctcctgcctcagcctccagaggagctgggactacaggtatgtgccaccacacctggctaatgttcttatttttagtagagacgggatttcgcca

SEQ ID NO: 150679 - DNA, 550 bp, Homo sapiens
cctgggtctctggcccagactggcttgctcctagctcctcttcttccctccctccatcccctactcggtacccctagtcagctcctggaaatggtttcagtattggtgggacctcagaattgcctttcgctgcagtccatgtcactatcacttcttgaacatccactccccctcttcttcaccgagcctaactactccgacccctccttcaaaacagctctgagccactgcaccaggaagccttccatgacctctccaaggtactgccatgaccttctacctacttcttgtaattgtttatgggtctgagcgtcttggaggtggggctgtgtctttatctttgcttcctgagtacctagcacagcacagcagtgctcaatacacacaggatgaataaattaacggatccagcagttcctaatgataatgagtcagatgctagcttaagaggaaatgacagtgcttctaaatcattaacagaagtaattttaagtagagttctctgtctctctggctgtctctatgcctgagaggaaaccgcggcagtaaa

SEQ ID NO: 150680 - DNA, 536 bp, Homo sapiens
tgtcagcccagcccctgacctacatggaagaggttctgaatattgagttcaatggccaatggtcaggaatttgatcaatcatgcctgcaataatgaaacctccataaaaagccctaaagactgggattcacagagtttctaggttggtgaccatgtccatatgctgggagggcagtgcacctggagagggcaaggaagctccatgctgcccacccccacaccttgtgatatggtttggctgtgtccgcacccaaatctcatcttgaattgtagttcctgtaatacccacatgttgtgggagggacagaatgggagataattgaatcatggggcagcttcccccatactgttctcatggtagtgaataagtctcagaagatctgatggttttataaagggaaacgcctcttgcttggctctcattctcccttgtctgccgccatgtaagacgtgcctttcaccttccaccatgattgagaggcctctgcagccatgtggaactgtgagttcattaaacctctttttctttataaatt

SEQ ID NO: 150681 - DNA, 459 bp, Homo sapiens
tttctccttctcctgcttttcatcaagctaaggtctacttttcaaactgtcctcagcttaaacatcatccctccagggatgcctatcctgatcaacaactttggttcagatgtattaccttaacactcttacaccttgttttagtccttatcacacattttttgtttgtttttgagacggagtcctgctctgtcgcccaggctggagtgcagtggtacgatctcggctcactgcaacctcctcctcccaggttcaagcgattctctgcctcagcctcctgagtagctgggactataggcgcacaccaccacgcttggctaatttttgtattttaatagagacagggggttttaccatgttggccaggatggtctcgatttcctgaccttgtgatccacccgcctcggccttccaaagtgctgggattacaggcgtgagccactgtgcccggccaaagcc

SEQ ID NO: 150682 - DNA, 233 bp, Homo sapiens
  misc_feature (17)..(17): n is a, c, g, or t
  misc_feature (20)..(20): n is a, c, g, or t
  misc_feature (23)..(23): n is a, c, g, or t
  misc_feature (32)..(32): n is a, c, g, or t
cctagaggatcccccgnggntcntgcagaagngtgggttcttgcagaaggatggtagaagcaggtcattaagacctcaaaagtcattatggggcatttggcttttaagacaagtaaaacagaagacaacggagggtctcaagctccagttgtcaagaattggctgaaggtggtcgggtgcagtggatcacctgaggtcagcagttcatgaccagcctggccaacatgtctgca

SEQ ID NO: 150683 - DNA, 474 bp, Homo sapiens
agatctggggaagatgaagaggaagaagaagatgttgatgatggcagctaatgttttttgagggcttattgtgtgctatctgtggttctaagcatgtcacataccctgcactgaaaacagctccacaaggtagatattatttctgtttcacagattgagagactatggctacaaaagatgaggtaagggacccagggttaatggtgtggccaggattagaaccctggcagtctgaggccatctccttggtatgtcttcttggagtgagggcagagaaccccaaacccatttggaagcatcatgtggtgttataaagctgtcatgggagagcgggcctccagtggggtaacacctacctaacatcggggtttgagcatggggttcttggctcagaggtgactggtggccctggtgccagggctggtctaaaactgcctggtgcatctctacctcctgctggaggctgagactcct

SEQ ID NO: 150684 - DNA, 325 bp, Homo sapiens
aagatgtcattatcgtgtcttctcctgtgcctggtagcaggtcctgaaggtgaacgtctcagatgtcagacatgggtctatcgggttaggataggtacatgtgactgacagggactgattctccatgtaatcacatgccctgtcccaggagcagctgcaggagtcagccctggacctgaatagcacacacttaccctctgcctcacctacactgttactggccactccgtcacaaccagtccttactagtggacctggatctgccggctctcagggaggggctgcaatggataaaatccattgctagtggtggtgggagtccatt

SEQ ID NO: 150685 - DNA, 211 bp, Homo sapiens
ttgttgttgttctccaagatatcgccctgtttctgctggttgcgttcaacagccattttgcacacactggtgaagagatcttaaaccatttcagaggtggcccataaaggaggcaaaaggggacttgccgtaaaaattatttccatagacatgcaaagttgattatataaggtagaggtcagttaagattctctggcatccattacgagac

SEQ ID NO: 150686 - DNA, 117 bp, Homo sapiens
ggagtttgagaccagcctgggcaacatagcgagaccccatctcttaaaaagatttaaaaattagccaggtgtcgtggcacaggcctgcgttcccatatactgtggaggctgaggccg

SEQ ID NO: 150687 - DNA, 212 bp, Homo sapiens
aaaaagaacgtggttgggaaaactgtggcagagaaaatcaggcctcatagacaacaaaggttagagaaataaaagtaaaaattactgtgtatatattctacaataaacctgagaaattctttataaaaaaatccaaaattaaccacatttctcaacatgaaaaacttcctagactaattcatcactggacccatttactcagttgtgatttt

SEQ ID NO: 150688 - DNA, 788 bp, Homo sapiens
atttcaaaaagtgaggaagcaggttctggagagaacagcaagggtgtggctggaaattcattttatacagatattgtgggtgcgatgtgtggatttaatcagtcatttcagcagaagttagccatagagatgggattataccagcagagacactgccaggcctggaccaatggggacagagacaggacatagtgtcccgtggagatggatgtcctggaatttgacaggacagtagagttattcatctgtgaacatgcactatcctttaagaaaagaggaggacgctggaggcaactcagaggttggcagggctggcactgccaccacagacaagggaacaaagctgtgtccttcttagtttcaaagggtcagactgttgctcagagccttgggggtggggccactgcctcgggccatggcgcccggactacaggctactgccccagtgggcctggaaagcaggatgctgagctgaagaggattattcttgaggcttaagagcaaatggaatttgcctcgctagattttggacttgcttgggacctatcacccctttcttctttccgatgtctcctttttggaatgggaatgtctatcccatgttggtcccaccactgtgtcttggaagcacataacttgtctggtttcacgggttcacagccggagaggaattttgcctcaggatgaatcatgtgttaagcctcacccatacctaatttagatattcagacgagactgcacctagagttgacgctggaatgcgttaagacttttggggctattggaat

SEQ ID NO: 150689 - DNA, 183 bp, Homo sapiens
acttctcctaattttcaagacttataaagctacattatttaagtaatagtactggtgtaaagaaagatcaatgaaacaaaatgaagagactcacacatatacagcccattgattttcaaagatacaaaggcacttcaataagggtaatttttttcaataaatggtgccaggacaattagatag

SEQ ID NO: 150690 - DNA, 185 bp, Homo sapiens
tgggatgagccctgaactaggagccaggcagcctagagtctaggtctggctctgtgaccttggacaagatgctttatctctctgggacctcactgccttcacctgtaaaatgggcagattgagccatctggtttctaaaagaaacaactcctgcttctggatagatggttctagatgagagtgta

SEQ ID NO: 150691 - DNA, 272 bp, Homo sapiens
ttgttatacataataacttctatggcttcgggcaccgagagagggaggccctaattcctttaccagaactggaacccttgtgtacataataacatttttaggaatctatgttcatagctggggacagagtggcagaatggtgaaatgttcccactggtgtcacacccatctcagcgagagtcagcctttgtcacagacctgctccgtgacctcgggaagatgatctgacctctcgacacctggttttcctcctctgggaagtggggatacta

SEQ ID NO: 150692 - DNA, 844 bp, Homo sapiens
tgtgaaagtgaagggctcaaagtgtggtgaaagcaaacaaattaatgtctatttatcctttcaaaagccattttaaaacatccatctcctatcctctcttttggtacaattttctagaactcacaagtccttggccataccaaaatggaaaaagcatgttatctagctgtttgactgggttaattttatgcagcaactccccaagagagaaatgaaaataagttctccatagtgatgagactcccgggtgtcagcctctgttctctctgtagtcatttttcctagtggttttttgttttgttttgtttttaacctcatccttgatggcccagtgactgaggcaaaggaaaccagtgaacttcgaagaaatctggggtcaccagtcttctgtggtcctgggagcttggcatggctttaaagctctactctgctaccctccttctccttctcagtctgtaggtacatcctctaaaccctcacccagctcaggcttatatgttttgctctaatttatactgcttccacctccagctctggttgtaccaaggagttggcttcctttaggattgctgggagaatctaagattctgctcttcaggggtctggttaagtctacacagccctgagaacctagtgtgtctgagctgcttctccctgactattgctcatcggctgattctagtcaggatagcaccaggcccctctgctttggatgaatacagcctatagtcttctcctcactttcaacattcaggccccagtcttctcctcacttcccacattcaggccccaggccctaaccatttctctttaacatcctttaatctcatctcctctttcccag

SEQ ID NO: 150693 - DNA, 490 bp, Homo sapiens
gaaatctttttggtttattaacttggtgaataggggataagcaataaaaagtcttaactaacttcagggtctagcaccctgtatgcaattcgaaaaggcaccaaagtacataggacagtacctaactgctgacacatcccccatgaatgacaagtgtactcatctctaggtaatgacctagtcatggagcaaatgatacatcatccagtattatggggccctctcgtggacaaaggcatactttgcacgcatgaatcatgaaaaaacccagcttcaattatctgtataaaagaacatgtgcaaaaagaggactagcatcaacgaaaaaagccatgaattatctaaagggcttagttgcccacaatctaggagagtgatgggagtgtcagtacgctaaagcagctgtatattccactgccaaaccatctgccataaagcatcaccgactcatccgacggcctatgccccattaccagcacaagaaccaacg

SEQ ID NO: 150694 - DNA, 424 bp, Homo sapiens
agaatagtgttgagctgtggacatctctgggctcttgatgtccaggacagggcttggctccaaaagggtttgtaagcatcaaactccttgtctttagaacggaagaaggaagatgatgatacctaaaagaggtgttatcagaatttagacagagtaggagtgtgggaaggaacccctggcttcacaaagatgtccttccccagccaggaattctgggaatgatgagccatgggctacttgcctaccaaagtacccaacaacgtatctttagaaatcaccaaagtcacaggaaattcttccttggagtattcctcatccagtacgtattcctccagtctttccacaagtatgcactatttccctgcacatctacttgtactttggactgaatgtactcatttgcttactcattcaagacatttct

SEQ ID NO: 150695 - DNA, 340 bp, Homo sapiens
cctggctctgaacttaggcctggctctgaactaggcctggctctgaacttaggcctggcgctgaactctgggcatgctccatgccaaagtgttatcatgagaaatcagtccaccaggagtgagatttgaatcctctagaaggattaaggcgggggaaaagtatctggacagtttccccttatttggaattaataaactaaatttttatagcttaactctctctgtagttatgagagatgagatgcgtgtaacaattaacagttactcgttcttcctaaaacaactgtgttatcagtttcactggcttcaccccagcgttttgagcctcatatgtgatagt

SEQ ID NO: 150696 - DNA, 472 bp, Homo sapiens
  misc_feature (215)..(215): n is a, c, g, or t
ccgtccataatgtgtgccaggaggcggagcgtgcgctgagctgagatcgcgccactgcgctccagcctggggcgacagagtgacgactctgctctcacagaaacaacaacacaaatatcgggatgacggccaagaacggtctgatgatcggaactgggtcagagtcgcggaatgttaccgatcttggtttggcggctactcaaactggctcccanctttgaagaccagaggaattaggtgacagaccggatgtgaggataaggtcccgagctgggagcctatatctcgtggtgccccgttagatggtacccgagtacaccatagcatggtcttttggcacagcagtaaatagacaaggaaagaaaaagagccaggcatggtagagggtgcctatagtcccagctacttgggaggctaaggtgggaggaggcttgaaattcaagttcaggatgggcaacatagcaaaacctcg

SEQ ID NO: 150697 - DNA, 273 bp, Homo sapiens
agaatcgcttgaacctggaaggcagaggttgtagtgagccgagatcatgccactgcactccatcctgcctgggcaacagagcaagactccgtctaaaaaagtaaaaataaaaattcctacctccattcacaccatttatgaaaataaattcacaaatatgaaaaaagagtcatttgtgaaatatctaagctaaaggaactataaatatgaactttttaagcctgattcttctttcacttacattttgttctcaaataaaaggaaggtttttct

SEQ ID NO: 150698 - DNA, 558 bp, Homo sapiens
ttcccccctgcttttggtcctcctttgctttgccttttctttatctgattctttacacatatcttctgaacacagctaggtgtcataacctctaggaatccttcactgaactcctcaagcaaagttaacaactccttctcagttcttccgtgatattttatagtgtaaactgtatttacttaactatacactaaataaactgtagtgtattttcgtttatatgggaatgtggtgatagtctataactactagtgacagtttgtaaccatcactacactcccatgtagctgaattatctgttcatgcatcttcctccactagactatgagcttaagagattatgcatttttcttcaatgccacacagaaggttgtaaacaaatgtctgttgaatgaatactactttatccatgttataccaatgtaattttgacaacacaaactttttacttataaggcacaatgatacaggaaaacggttgaatgtgtttaccctcagcaattaatctaatttttaaataatcaaatctttttctaacagaagtagtgtacaagtaac

SEQ ID NO: 150699 - DNA, 363 bp, Homo sapiens
accatttggagtttgattgctgtcagccattccgatgggttgtaatactggtttgcctccaccagatgttgctgaaacactaatataaatggaacattccttttgggataagtagcattggatttggatggctagagtaacttcagtgttaaccctggctaaatcttttctgcaattattaatccctccatgacttacacagaccatctaagacatgcttaaactttcctacttgtcctaaacatccttctttttaaacaaccaaagattctttttaggacaagtgtttaccatccataaaatcattttatgacttccccaaaccatccacaaaatgcttaaaccttctgacttgtcctgaac

SEQ ID NO: 150700 - DNA, 372 bp, Homo sapiens
tagctgggactacaagcacgtgccaccatgcccagtctctctctttaagaacaagtaaaacatttcccagaaatacccctcacatctcattggctagagattcacgtgattgcctggcaaggagaaaaggggtagctgcggtcagcttaggttggcagtcagcaaaccacagcccccctggccaaatcttccagccacttacgaaacacttcctgcagcccccaaatataagataagactgaaggagaactaccaaggcgctggcagtcaccaaggcattccagcaagaaaccctagaaggccacaaagcagacatcagctgagcaggctgggccacttgccctttctccctttctgcttttagctgtttct

SEQ ID NO: 150701 - DNA, 362 bp, Homo sapiens
gttatatttcaatagcatggatgtgtatatctcacacatatatatgtacaaactaaagtcttgaaggatatgtaccaaatataacagtccttatttcatctttagtttcttcatgtattcctgcattttctaattttcacattaagtctgtattacttttaaaatagagtaacatttaattcaaagagtactcaatcatttcaggatattcctaataaactattaatattttaaaaagttaacgctatcaagtactgtatcggtatgggctttcaaagaaatataaatgattttcttaagtagacaaataagcatatcaattgtaataaataccgctctgctattgaaacttctaaaatagg

SEQ ID NO: 150702 - DNA, 761 bp, Homo sapiens
cagggaagcatgagaaggatacagtacgtttcctctgaagtcgaaagagaagaacatcaacaggattactcacagaagttgctctgcaacctctaagtttgggaacctgataaatataaagtgattgtagctatttttctgaggaatgatactgtgtccagaatttattccttccggtgggttcttggtctcactgacttcaagaatgaagccgcggaccctcacggatggaacaccaggctatagtttcaggaagccagacttgacccagacttgaccttgcaaaaaatagcaaccccttcagaactggtaaagcaatgagaaagaattgctcagaacttcatggagctgagccattcacccatcctggaacatccaccttcctctggaattatttttttaatgtttttttccttcttgtttaatccactaattctctctcttttcctctgtttctctctctctcatctctgttcctttccatagcaacatagactatatatgagtaaatatttgaatatatttaataataaaagtacatacacaaatatttacagaactgctcaatcagaaaaaatacacttaataaataattgttcaccaatggccttgatgtgctgtaatttgtatttccaccaaatgagtcccagttaccttttatgtgtattttccatgcttgttcacctatttgattttatactaaaattatattaaatttctctctaatgttttgattttctaataaaatgttggtcatgttt

SEQ ID NO: 150703 - DNA, 418 bp, Homo sapiens
cctaagggactctatccagacattaaaatagaagtcggcgctttccctttcttccccttatttccttttcccttttctcatttcaactgaagacctttgtaccagttctggagctgttaatcactgacagttgggaactgctactttttgtcctatttaaacttaatgcatctgtacacagccatatttcttcccctctttcttagagcagagtgtcttccctcttgtccaagattaactcaaccacctgggtgctgtgtgtaccacatatgttctgcctttttagggactgtgccgtcagatccatccacgttcgcctctttccccttatccctctttctgctaatatagacgtgctcacgattctaatctttaaaaaggacattccccctaaccgccaaaaaaaaaaacccatgta
